United States Patent 12,642,819 (COMPOSITIONS AND METHODS FOR TREATING INFLAMMATORY BOWEL DISEASE) - sequence listing, part 74

SEQ ID NO: 36 - DNA, 2374434 bp, Collinsella aerofaciens
cccgtgggttataccctaagagcaaaccaccctttttaagggtggttctgattgcacaaaaaggtacaggtttttgtagaggggtatggagatgtatctactggcagtacatttcgcgtaatctgggcaaacgcggaataattgctcgtataaaggcctatgtcgaaagatacaaaaacctgtacttttgcgactgcgcctacttgcgagcgagaagcctgttctaaacgcccctgcatttgcgtgtgccgcaaagcaagaaaaagggggcgagaacatggagcagacggcacggcgccaagaaaagctgccgggcgcatttaacggcgtaactaccaacagccagcacggccgcgtccgctggtatctggttcacacccccaatggaaaagagcgcgagacctgcgaaaaggtccgctgcatcatcccgcatagcctaatgcaggacgcttttgtgctgcaaaaggagttctggtttaagcgggacggcgcctggtcgctccaaaccaaacccatgtacaaggaatatttcttcgtcgccacgcacgatgccgccgcgctcgatagggccttggcccagctgagctttggctgtcgtatcgccggcagtagggagcgggcgtacatgcccatgccggacgacgcgcaggactggtaccgcagcgtgctggacgacgacggcgtggtgcgcaacagcgtcgcccgcatagaagacggcgtgctgcacatagaacaggggcccttggtggggcaagaggcccgtgtaaagaagatagaccgtcataagcgctggtgcctggtagacgtgggcgatggcgactccgcttttagggagctgcttccgttggacgtgcccagtaagacgtaagggagacgtgcgccggcaattcattcgcaatttgaattcatcgattgggggatccctggaatcagggacgtggatttgaacgtgactactaaagagataactgagagtggcgcatccatgggggagacgctggctattcagaagatacaaccgagcggcacgctggcctaccgctttttgaagaggctgttcgattttgtgttcagcctttgcgtgagtgtggtgctgtgtattcctattgccgttgtgtgcgcgtttatttgcttcgagtcttctggaagtcctgtgtatgcgcaggagcgtgtgggcaaaggcggtaagaccatcaagattcttaagcttcgcagcatggtcaccgacgccggcaacgtgcagaaatatctgagtcccgagcagctgcatcagtgggaggtcgagcgcaaggtcgacgacgacccacgcattaccaaggttggtcagttcatccgcaagtgctccatcgatgagataccgcagttccttaacgtgctgaatggtgacctttccgtcatcggtccgcgtcccattacaagagatgagctcgagcagcacttttccgacgaggaaaaggcagaacttttgtctgtccagcctggcattacgggcctttggcaggcgaccgatcgcaacgccgccaccttcgagagcggtttgcgacagaaaatcgagctcaactacgtgcgcaaccgttgcttccgaatggactggaaatgctttaccggcacctttggtgccatgttcggcaagaagaggacggggcgttagatgactaatccaattcgtgtcgcgcagatagtcggaaaaatgaatggcggcggcgttgaggccgtcgtcatgaattactacagtcatattgatcgtagcaaagtgcagtttgatttccttatcgattccgattcgtcgcttgtccctcgcgaggagattgaatcactcggtggcagagttttcgagattccgccctaccagcacgtaattgaataccagcgagagcttcagcgcctctttagggaagagggctggaagatcgtacacagtcacatcaatgcgctttcggtttttccacttcgcgctgcgaagaaggcgggtgtccccgtgcgtatcgcccatagccactctacgagcggtaagggtgagtatgccaagaatgctcttaaggctgtgctgaaaacgcaatcaaaccgatatccgacgtatcgctttgcatgtagccggtttgccggtgagtggcttttcggcaaagatgctaacttcgaggttgtatacaacgctattgatttgaacagcttccgcttcaatgcagaggctcgcgaacaagcacgagccgacctgggccttgttggcggtcagtttgtaattgggcatgttggtcggtttatggcgcagaagaatcatccgttcttgatcgatgttttcgccgaagtcgcaaaacgccgcgacgacgctgttctgttgcttgtcggctccggtgaagacgaggattcaataaaggcattggtggatgaacgcggcctttcagactgcgttaaattcttgggacagagaaacgatgtaaatcgactataccaggcatttgatgtgttcgttcttccaagcctttatgaaggcctgggcctcgttgatgtcgaggctcaggtgtctggtttgccatgtctgctaagtgatgttattccgcgtgaggtggatgtaacaggggaatgtacgtttctgcccattgatactcctgtcgaatgggctgatgcgatttgctctctttcaaaaaagtcttatgagggacgtaaatccaactctcttgattcatttgcaaattacaacattgatcaacaggctgattggctttcaaggcgatatttgcagctagcaaacggagatataatttgatggacaaaagagtcaaaaacgtcattattgttgatgacactgctgataattttggtggaactgcccaaatcgcctatatcactgccgtggttcttcgtgacagcggatataacgttgtttactttgctggttgcgggccaatacatagccgccttaacggttttagggttgttgtcgcaaatgagaggccgtttctcgaatcgactaataaggtttccggtgccattaatgggctgcacagcggtaaaacttataagaagttttgctctctattaaacgaatataatcctgatgacactgtcgtgcatgtccattcatggactcatgcgctttcatcttcaatttttgatgctatcgccgatttaggctttaacgtgctcgttacactccatgaatattttcttgtatgccctaatggtgggttttatgattttaagaagcatgaaatctgccatttgaaaccatgttccgcaaagtgcatccaatgcaattgtgataagagaagctatggacagaagctgtatcgagtggctcgcatcgctcttcaaaatcgctcaatcaggcgtgctcatccaaagttctgttacctttcggattttacctacgatattatgcgcgggagtgaattcgatgatggcatgccgtgcattctccccaatcctatttctgttgaaggagagttttcgcctggtataccgtctgaaaagagcggttacttgtttgtgggtcgtttcgataaggagaagaaccccgagttgttttgcagggctctcacatcgttgggcttgccaggaacgttatgtggatctggtcctgagttcgagaggctaagagacgcttatccaaatctaaattttttgggttggtgtgataaggatgttctcgctgaacagttcaaaacaactaaagccttggtgatgacttcatcttggtatgaagcttcgcctttggtgtgccttgaagccatgctcaccgctggtattccatcaatcgttccggatacctgtggagctattgcatatatcaaggatggtgaaaatggtctcctatttaaaaatggtgatgcttcctctctttgcgaggcgatttccaagctagaagacagcagatattacgaaaagctttgtgaatcaaccagcctctcggtgccttctctccaagaagaccgaagctatgagacttacgcaaagagggttatcaatctttacgaggggttatatgtttaagaggattatatatatcgttaagtcggacttagcgttctatcccccctgcatgtcacaaataagaatgattaaagatttgggcgtgcagattgaagtctggtttggttccagcaaggatacggctaaggaaattctaaaaagcgagggcattccttttacggagctcgttgatccgcatctgagcgttggcggaaaactggatacattgaataactggactcatttccgcaaagccgttctcactcgcctaaaaaaagagccaatggattatcttatctggtttggaactgctgaatccgcgcttccgctttacggggcactttccggtattccctatgtggccacggcgcttgagctgtgtgatgatcaaccgacaaaagaacgactatttgcggcggtttgtcgcaaggctcttgcagttacgtgttgcgagttaaatcgtgcctactatatgaaaattaaatgggggctgaattcgcttccctcagttttcccgaataagccatacgggctcaaatcgggtgaaatcccctctgtttcgacaaacgtcacaaagcagatcttggatgagcttgacggaagaaagatccttctttaccaggggctattccagcgtcctgaatatgttgcgcccatcgctgaggctcttcgtatgatggagtctgattacgctttcgttcttatgggaaaagatcgctacggtacgactgaacgaatgaaggagatttacccggatacttttgtgtatggttttgttccagcgccaaagcatttggaaattactgcaaggtcgcgaattggcgtcgtgctttatgatgacacatcgcttaataaggccttttgcgcgcctaataaaatatatgagtatgcagcatttggtctccccacgcttgctaatcgtttgcctggtttggtttcaactgttgaggctagcggtagcggtatgtgtgttgactttcagccagacaaaatcgctgatgcaattttgcaattcgatcagaattatgaaaaatattcggcatctgcttttaatttcttcaattcgactgataacacgcagactatgcgctcgctgcttgtaaagttgggctgtgtaaaatagtggaaaaatgttttaagaagagcctgagttatgctaaagcaaatacgcatcttaaggctagtgaaataaaactttcagatctttgtatttacattggtattctgtatgtttttaagctgggctcaatctcatatttaattccgaaatttggcgtaatttactatggtcttgccgtaattcaattactgctcgctctgtttgtttatgctcggggcgatgttcggctgaataaggtgcattttggaattgctggatattgtgccactctattattttcaacatacgtaaatgatgcatcgatgcagatatcactcaatgaggtgttttgtttgttgcctctattggtgacagcagacatgttgttttatagaagagatatagaggtagttcgacgtgtatcaagattttcaatattaatgatttcgctcaataccctcactgcccttattttccgaaatgcaatgtttcgagatgtgactggcgctcccacgatatttctactgggtgcggacaactctcttatccccatttatatggtttcctctgttttggaaatgtataaaagaaatctagaggatgcggcttgttgcattccagtcgtttcgctcagcaatttgctcctcttttcaatgctaagggatattgcgtctggcaagttggtgggtgttttactagttctccttctaactctagctttcttcaataagtcttttaagttctctttttcgcttgctctaggtattaatatcgccttttttgcgattttcgtttatggacaaagcacaattagtggcttaactgggatttttgaattattggggagaaattcaacctttaccgagcgttcatttttatgggcatttggttttaggctattttccatgagtcctttgctcggcttaggcagctacagcgctgttagtttcaataatcttgttagggcgctaacaattactggactgtttaatactggtaatcctcataacagctatttgtctatattaatttccggcgggttgcttgcattttcctttgttgtatttactgtccttcaggcgagggttaaaccttcggatcctttttttaacatttttttattcacctttttattgcatgcgcaagtggagggacgcgatatcgtctatatcttcttcatcgtgattgtcatttatagatttttccattctgataatcagctttcgttgcgagaagatagccgggctgcaattcaatcgtttatataggatatcgataattaggatggttaaagtgaaagatctttgggccgtaaagctaatatacaaccgcttgaggcgtgctttgcttgcttcgagaataaatcgtctactgggaaatgaagatcagaagaacttgaatacgctatatcgcgatgctcttcttattgctcattcatttgagaaagctctttgtattgaaggctgtcgcgatgattttggaatacaaaaggccgaccgtctccttgattatttaacgcttgcagcaaaagatccttcttttgataatcattcatatgcttttaccgagtccatggcggcacttgagaactggcttgttcgtcgagctcagcttggacttgattgctctaaatggcagcctggttttgaatcgctcgctgaacaaacttcatatgaagttggccgaattgacttgagtgatagggctggaattgtttccgattcttttgcttctgcctctgattgcgataagaatgcgatcaattttattaacgggagacatagtgttcggtcatttgattcagcccctgttcctcaggaaacgctgacgcaagttgttgagcttgcgcagagcgcgccttcggcgtgcaaccgccaaccaagccgcgtgtatttttccggaacaaaatctgctcaggttgtctccgctgccgtgcgtggcaataaagggtttgagcaatcaattttccaatgggcagttattactgccgacacttctctgttttcatgcgccgaatataaccaatggtttatcaacggcggcatctatctccagtcctttgttttggctttaaaggcttatgggattggttcatgtattttccagtgggttgttggtgactcgggaaaagagatgcgctcgtccttaggcatttcagcaaatgaagtgatcattgcggtcgtcggatttggctatccaaaagaaacgttcgcgagacccgttgctcggagaatgcctgtttccgaagtcgcgtgttgggcagattaacgttgggatgctcgctagagtattatttgattgggaattattaaatgaaaattggaatcattacctaccattttgcccgcaactacggtgcgatcttgcagtgctacgcactgcaagatcagctttgctccatgggtcatgatgtttgggtgcttaactatcaaaatgttcgtcaggagcgcaataattcccttcaccacaaaagggatggttttctatcaaatttagcggttaatgtcgcgttgcttccttttgaaggcaaaaggcgttctaaggagcgcaaatttgctgaatatgagtcgcgttaccttcatctgacgcctcggttttattcaattgacgagatacgcgattttgttaatgaagaaagtttcgatctccttatctctggtagcgaccaggttttcaatcctaatattgccgatttcgatgaagctttcctttttccctttgaaacgtcggctcgtaagggcagttttgcggcaagtctcggcagcgctactgaaactgaattagttcctttttcagatgacctagcttccttcgatgtcctctgtgtaagagagaatactgatgcacccgtggttaatagcttatgcgggcggtctcccgaggtggttgacgaccctgttttccttttggattcaaagcgttgggcgcaagctgtcgatacttcggttgaagaccgtgggtatgttttgggctactacattaataaagaggcttctgcgcgatatttggagcttactgagcaggctgcatctgagcttggattgcccttgaaggttataaatgtgcgttttgggcgtgactcatttaagcccgagatgattactgatgctggccctgaggatttccttaagctattcgcgggcgcttcttttgtctgtacggactctttccatggaacggcgttttcactgctattcggaaagcgttttgtgtcttttgaaccaaaatcaaattctagtgacttccgcaagagggatcttttaagcaaggttggagaaccttggagaagcgttgcggtcgattctacttctgcgagcgcccttgtcagtgagttatgtgggcgttctgctcccgctgctcaggaaggaatcgggcgtgttcgcgaggcacaactgctgttcctcgagaagatgacgaaggagaattagtttggcttttaaagagaaaaagcttcttcagaatactggctggctgcttgcgttgcaggcaataaatattgtgttgccttttgttacggtgccttacgttacccgtgtcttcggtgctgaacggtacggcgtgttctctattgctcttaattggataacttattttcagcttgttgtcgagtttggtttcaacctgagcgcaacgaaaaaggtcgttgaggttaaagatggggaagagcttaacgacctcgtgtccgctgtcgttattgctcgactaggacttgttgccgcctgctttgtcgtagtaataattctcggtattacgtcggccgcaaccggggaccagctatcctgtatgcttgcgttgttttctatgcttgttggcattgctttacagcttaactggctttttcagggtttgcaggacatgaaggtcatcactatagccacggcggctgcgcgagggctttctgtcattctgattttcctccttataaataaccccggtcaattgatgctttactcgttcctgtattcaattactttccttgcttcgggtgttattactcatgtatttgcttggaagcgctatgggatcaaaatgggttttgcatctataaagcagatactcggtgagatgcgagacggaatgccgatttttctttcatctgccgccggcaagatcattggaaatgttggcgttacggtgctcggcggttgtcagccaagcgcggtcgttggctcgtatgctgccattttgaaggtgccgcaaatggcgagcctgatgtttactcctgttggccaagcgctgtatccgcgcgtaaacgaagaacgaatgaaatctcggcgctccgcggcgcggcttgttgctaagtttggtattcccgtggtcgtattgtttgcggctggtttatttggtatggcgatccttcgcaatcctgtagtcgagattctctatggcaaagagtatctagtttgcgctgatacactcattccgcttgctatttgggtgttgctgggcatcgtaaacaattttctcggtgttcagcttctcattccttttggatatcagtccctatatagcttgcttatgattgtcgattccgttctttcgttggtgcttaacgtttggcttggccatgcttggggcgccatgggtgttgcgtcagctattgcgatatccgaggctgtccttacggtagctttgtttttggctcttctttctgtagttaggcaatcgtccgctgtttcttatagctctcatgcccataaggctcagcacatgagaaaggaccgataatgaaaaaaatcatgctcgtcttcggcacgcgcccggaggcaatcaagatgtgcccgctcgtcaacgagctgaaggcgcgcaaggaggagttcgagaccgtcgtgaccgtgacgggtcagcaccgcgagatgctcgaccaggtgctgcgcgtcttcggtgtggctcccgaccacgacctggcgatcatgaggccgggccagacgctattcgacgtgacatgcgacgtgctgctcaagctcaaggcggtcctcgaggacgagaagcccgacgtcgtcctggtccacggcgacaccacgaccagcttcgccgctgcgctcgcgtgcttctacctgcagatcccggtgggccacgtagaggcgggcctgcgcacgcacgacatctacagcccctggccggaggagttcaaccgccaggcggtcgacatcgtgagcgagtactacttcgcccccacggaggccagcaagcagaacctgctcgacgagggcaagcccgagtccaagatctgggtcaccggcaacaccggcatcgacgccctgcgcaccaccgtacgcgagggatattcccacaccgagctcgcctgggcggagggctcccgcctcatcctcatcacggcgcaccgccgcgagaacctgggcgagcccatgcaccgcatgttccgcgccatccgccgcgtgatggaggagcatcccgataccaaggcgatctaccccatccacatgaacccgctcgtccgcaaggcagcgcacgaggagctcgacggcttcgacaggctccacatcatcgacccgctcgaggtgctcgacttccacaacttcatggcggcgagccatctcatcctcactgactccggcggtatccaggaggaggcccctagcctgggtaagccggtgctcgtcatgcgcgacaccaccgagcgccccgagggcgtggcggccggcacgctgaagctcgtcggcaccgaggaggacgtcatctaccgcgagttcagtcgccttctctccgatcaggccgagtacgaggccatgagccacgcttcgaacccctacggtgacggacatgcgagcgagcgcatcgcggacgtgctggcgcagtagttttctctgagctgttttatgaagctgctcttttggaacataaacaagaaagacaatgccgaccttgtcgtcacgcgcatgcgaggggatgaggtcggcattgctgcttttgctgagtttttggaactgacttttcaaatgagctgttaaatagaactggttgaggtgccgtcaaaaatctttcgcaaattgatttaaccggcctcggccccgtcttcttttagccctccgtctttcccttcagttcgtccatctcctccagcttcgacatatccaggtactccctcttgcttcactttgtgcttcagcctcgccgtcaccagcatgaggaccgagttgccgtccgggaagatcccgacgaccctcgtcctcctcctgatttcgcggttgatgcgctcgatcccgttgttcgtcctgatttggcgccagtgctcagacgggaattccgtgtaggcaagcgtctcggcgaacccgtcgcgtatcgttctcgcggccgttccgcagagcttcggcacgctgagatcgacttccccgacgaccgtgatgagttttctcgcgtagcggccgccgtggtagccatcccggcccgccgtcctctcgtagcgctcggccccccgacaagctcggacgcctccttgtcgagcagcgcgttaagcgcttcctcgacggtcttcctcatcaggttctatatgtcattgcgcagcaactccccgtcgactgataacgatattcacagacacggcccgcgccctttcgtcaatgatttgttgtttggccgctggaaatcatatgacggggtgcgggccgtgttccgctatgcggttgtcaatttataaaagatattatgcgtcaccaccgtttgacgaaaaactaataaacaatggttctgctgcacgtgcatgggggtaatatctactcagacgttcagtgtctggagcatgacgttttatgtccgcacgttgacctttctatgaggttaactgattgctgggggttgtcatgctgctatacgatgaggcatttctacatgctaataatttttgcgagatgacgcttaggtcatctcgctgattgctgcagattgatatctatttccgtgccgcgatggcgtttcatgttctgaggttaggcttcctgctttggcctgcgccattcagcatctcactatcttcgtttatcaaactgaatgggttggataaaggccatttgtccgtcgcccattggaggtatatctgcgaattagattggagcagaaatgcaaaggaagatgtacaccgcatttgtatcctccgtatcttctcttaaagaggagcgcagagcaacgctcgacgttcttcttgatttggacgtatttccagtggcaactgagcatttcgttatccagtcaaaggatgggataaatgatatcgagcgtcttatagacgactctgatttctttatccttcttatgggtagcgaatacggtcctaagaccaagattggcgattttaccggtagctggacggaatatgagcttgtgtacgcactggaacatgctcgaagtaacaacactaagatcattattattgagctgccggaactaaaacgcatctcgtcgctgtcttcttcggaaaaggagactttgaagacttcggaaaagaatcagcttggtttcttggatcgccttaatggaaacaccatctgccaggttgcagatattagttctctgaaatcgaccctatctacctttattgagggcaatcgtcgcgcaaattcggcttcaggttgggtgcgagcattgtccgcgcagggctgttttggtattgagtttggacggacctatcgtcaagttcatctttcgccgaatgatgatacgtatatccgagtcgggaccgcagtttttagctgcagtaagcaatcggctacgatggttcatgtcgatggagtcaaccataaggcgagtcttgacgctaacggaaatattatccctcgcaacggtaggagcaagacggaatggcaaggcgaatactcttgccaagacggaagactgtgcggtgtctatgaggcatatagacgggacaacggtgcgtttggcggtaaatctgtgactgcgggacatcgtcgtggcgtccatgaatttgcaatttccgatggctcggaggcgtttatggatggaacatttcaagatgctgttggcagaaacaatataaacatagcctgcaagtctggcgagatttacttctttgagagcgaggagcttatgaatcgtttcctcaagcgcgaatgtcctgaattgttttgtacgttgccggcggaggggtaaaaatggactatcaagcgattattgatgttgttaagtctgtcaaaccgcttttctttgataacgatctgaggtctcagtcctcaatgaagggtgacgctgactttgttacgcaagtcgatctaaagattagctcgtatgttaagtctgcacttgctgagttaacgcctgaaataggttttatgagtgaggaggaagaccctggcgaggtgaagcccactcgttggattcttgatcctgttgacggtactacaaatcttgtttttgactatcgtgcaagcactatttcgctagcacttgtccgtgatgaaaagcctatatttggcattgtttacaatccttatagcgatgaattatttactgctaaaaagggcttaggggcttttttgaatggtaataaaattcaaacatccgaccgtgagctcgctaattgccttatcgagtttggtgctggttcaacgcataaagacggcgctcatgagattttcggtatcgccgaaaaagtattttgcgactgcctggatttgcgtcgcatgtgttcttctgcgctggcaatctgctatatagcctgcggaaggactaatggctatttcgaaaagaggctgaagccttgggattatgccgctgccgcactcatcttggatgaggcgggaggactctcttcggagtggaatggacagcctcttcagtataaatctgcttgcagctttatttgcgggtcgcagacggcgtttgaatatttaaagggagttgtttcttaactctgactaattgattgacgacgattgccatggcgattactcgtacaaactattagatcacgctttgaaagaggggagcgttatatgagtcttcgtgattatcacattcttattagccattcgtgggattacagcgatgactataggacgataaagagctggcttgattcagccggctactttaagtggtcggactattctgttcctatcgagaatccgattgacgctaagagcaaagctgagcttaagcagaggatcgcgaatcgaatctcttgctgtagctgcgtaattgttctctctggaatgtatgtcgcctacagcgagtggatcgactttgagatcgaaactgctttgaagtataacaaacccattatcggggttaggccgcggggccagttgcgtgtccctgatgaagtgtcctctaatgccgacattatggttggttggacgagggacggtattgttaacgctgttcgccaatatgcactttaggagaactatgttttttaagaagcgaaaacccgactcgagtccttccgagaagtcatacaacaaacaactgccgaaagatcatcccaatccgcctattagggttgttcgtgggaacacggaggaaatacccgacttcccttgtgcaggatctccctgccctggattcccttcgcctcgtccgaaaaagaagaattaaatgggtaaacgcagccgaaagcaaatagagggcgagggtgcagtcccgggtttcgattcagttgactattctgccgaatatctttcatggatgaccgagctgtcttatcagacagaacttagtcggcgtgattcatatgaacatttgtctaactgtttgctaagctgcgtctccattatttccgtcgctttattgacggtggccccgctgttatttgagagatatagctacaacgacaacggggctgccgcgtctgttctgctggcgagtggctatgttgtcgtcatgctgctgctaggtgcttcatttctgctgtcgttgcttagtcaagtcaggctcaagatgagcgttctcgcatcaccgatggatttgaatgatttcgttgcgggcgagattaatcgtggtgcgccttttgcctctccgatggaagttgccgaaggtaaggtaggggcggtgcagtcccactttgaatcgcttaatcgcaagaacgagtacatgagaaagtgcctaatggcatcgatggttctgctgatcgtggctgtttcggtatgcttgttcttggtttgtcttttttcgttatttgagtttttattgccaccgttttggagttgatgtaatgcaaggtcgcaaggcacttgttgtcggtattgatgagtatgcgtcgtctccgctatatggttgtgttgccgatgccaatgcggtggccgaagtattagggaaaaatggcgacggctctcctaatttctccattcatcttgagagaaacgttgagtgtccttttgaattgaagcggatgatcgaagactgtttctccggggatcctgagattgcgctgctatattttgctggacatggtggaagatgcgacgtcactaaaaatggtttcatcttatctggcaagggctatccagggggacaactttccctcgacgagatcctggcgatagcaaatagctccaaagcgaaaaatcgcgtaattcttctcgatagctgtaattctgggtgcatggggactcctggagtgcttggtgggacatcctgcttgcttggtgagggtctaacaattctgagcgcatgctgttctaacgaatgtgcggaggagcttaacgggcgcgggacatttacgtcgcttctggtggatgcgctaaatggcggtgcagcagacgtgatggggcatgttactcccggtggggtctatgcgtatattgataaggctctcgggccatgggatcagcggcctgtgtttaggactaatgtcaactcgtttatttcgctaagaaaagtcgtttcgcaggttccggatagtgtcttgcggcagctgccgtctttgtttgatgcgcccggtgctcaactgtccttggatccgtcttttgagcccaccaacaatcccgattgggaagagcatcgaattgttgagccctatgcgactaaggataatatggagaagttcaagatccttcagcagctggagggtattggccttgtccgtccagtgggggccgagcatatgtattttgctgccatggaatctaagtcgtgcgaactgacggctctgggcaagcagtattggcgccttgccgatacggggaagatttaggcgattgcgtcgaaaacgttaatgtaggggcaacaccttgatttccgtataacgatgaacggacttcgtcttggaatctgaaatcagcacaacaacaggttctaagaatgaatgatggctattacagaattcttattagacctggcgtacgacacagcctccttgttgcacggggtcgtgggaaaggctttaagcgtcgtggcggacgctgagaccgagctgctgtacggtgacggggtgaacttggacgggtgctgtgagagggcaatcgccaccttcggtgacatgctgttgttgcgcctcctgcagttttgctcgggcagcaagcgaccgttaagaacatgtgaagcattacgctgcgcgcgttatttgacggtcacacatgattggggaagtgaaagcggtttaagggagaacggaatggcgcagcgtgagtacgatagttttgctattggagtgtttaattgcggcaacgcagcagcacacgttgatttgtcaattaacgtgtgggccgatattgggcgttcttctgaaattgatttcggtgttcaaatcccatgcaaggacgaaattacggggctctttatctttgttcctttcagaatagatgagaacgatgttgttgatctttccccctcgtttcgtgataacgagttcaatcaagttttgttcaatcgggattgcaaaaccacgtgctgcggcagtcaaacaattgttattgatgactgtggaaattcattattggtcctgccttttgcgtgggatgaagggttgactgttgattatttggagggagggtccttactttcgctttcctacggcgtctcggctctttcgcgtaaaacctcatctttgtatttcagaatgcgaattcctttcacgtcacttggtgacctgctatctggccccgctgatatgagagaggttattactggacctattgttccgtttcgtaccatgatttcacttccggtcaatcaggttaggggtcttccgaattcggtcgtacgtaggcttgttgattctaaaaccgatgttggagaaacgcatattgcggtaatcgcttcgcgacaatgggaagtgaattccgtttttactccgtatagggttaggcttttggaaactgttgcttgggaacaatatcagcctagagtaaggtgcagtaatgctgtcctgtttccaaaagaccgcgacatgtttgtatatcagtggcttatatctgactgcagcacttcgttacaactagaattttcacgtaagcgtattactgtccttaccttgcttttttatctcgtcatcctttttttaataaacttgttgagcgaagttttgattcgtttggttttgtgaacgccaaaaatgtcgttcgggtatttacttagtagggcaccatcttctggtttataggacaaaaagtgtgtctactttaggggcgtcggcgcaggtcgattcctagcttgtattacgaaatcgtaccgtcgctattgcgcgtgggcactagggtcaacttggcccccagtgcctttttatgctaggagtttaccttgtttcgttctgcgatgtagtccgcgaaccatttgcgcgcgttgttcttgaggatacggatgttgtcttcgtttgtggtgctgatctcctgaagcgctcgttcggcgataacgttctgatcttcaagagactcgtcgacgcttgaacggtatttttcagcgaccgatgctatgtacctgcttacgaaggtctttttctccttatcgctcagggccgcgaaatctactttgagattgagcctcgagagcagttccggtgggaacttgtcctgcacctcggttctcggtgtgttcgaggtgaatactatggtatagccgttaaggtcgtgttcttcgccctgggaatccgtgaacttgccgttctcgagcaggtctaggaagaagctccagactgcggaatctcccttttcgaactcgtcgatgagaatgacgcccgacttactgcgttctatcttcattgttagctcgccctcttcgctgcccatgtagccacgcgggctgccgatgagtgaattgagcgagtccttgctgctgtagttgccgaagttgatctttgctaacgattctcccggcgcgagaaggctactgaggatccttgcagtctcggttttgcccacgccggaggggccgatcaggaacagggagagaatcggctgttctccgatgctgttaaacagcctgaaaatttcgacctgtttacggaaatcatctttgaatttatcctgcccgatgaggttgtgtacgaactggtcgagtaactcttttgtctctgagtcgtctaggtctatcaggcgttttggtttctcttcagttggcatggcttgatcttcggtatctccttcgatatcgcattgtcgtacggtgtcaaatatggtgcgcatttcgtatgcgtatctgcctgctgttgtttcatcggcgatgaacaccgtgttttcaggcatttgatagagaagaccttcaaatgttgcggccatgcttcctttgccgacagtgggatcgagtagggataaaagcgatgaaacatcgagtgccatttcaccctctccagcttgcagcgcaatttgtgccgtgctagaaagagataacgccgaggtgtaggcatagccttcgctttcgagccagtttctaagacgggcgaactggtcctttctgtatgtgattaagttcagcatagattattcactctttttattgactgcctggatgacggcgatgacatcgatgtaggttgcttcggtctcatcttcttctattgcctgattgtcaacttgatcttccgttcgttctttggatgagccattaatgaagccgtcgtcctccggttcagtcgtctttccttttgtttgatagtattcgtacgagctgcgaaggtccgatggtttaacttttcccttgcagattccgatgattccgactttgccgatgagaaggtcatcgactgagtagccgctctcgaagagatccgctccatcaatagggatcttcaagataatgttgctgctttcctcgtcaccaattctcccgataagcttgaacgacgtgcccgacttgatgaaggactgaaataggtgccccacatcgaggccgccagcctccgggattgtaatcccatcgaacgttcccgacatgactgttatgagggtacgcacttcatcctcgttgagtagcgagaggcgtacgttatcgatgtaaacaaggtcgccctccgatctctcttctttgccaaaatcgaggcagtttcttttgatatcggctagcatgcggctcactgtgtttatgtactcgaacgtatcgatcatctttgttcgcttctcatgtccgaggtttccgtttgcctgcgcggtaaattttggaaatatcggaaccttggtttcgccttttgcgtggatttcagcgtttccagaggtagccttgtctttttcattcgagctatctttccaaagtgtgttgtctagcaacatgcgcatctcataaaccttggaatggttcatgtagtacaccgtgaagaggtctgtggccttggttttattcgacatagcgttccaatctatttgattcgtacatctgttctgtcaattatacctaagggtacggtgtcttgaagatgcgcggcgacttgaagctgggaaagacccggccaccttcgattgctgcatgtcccgaaaggggttaatcggcgtggtgcgtactgcgaactgtacatatcaatcgatttcattttggctgcaattaaatagtgaatcatgtgacatagtttgatggacttaaattgccttagcccctccgtcatgcgagttaaatgactacggtggagtagaattgttttaattagtgactttatggcggtgtgatatggatctatcaggaatactctcgcaagcaggttttgctttccagatgaaagtgtttctgaagcaggtgacagagttaaaccctaatacagttgccagctatgaatatcttgatgacatctcagcttctaccagccttgacgaattaagcgggcggattggactttgtgaatctcggcttattcaggtaaaaaacaccaatgttgctaaacgagatgttgtccaaatttatacgaactggattcttgccgttagcaagcacgagtcgatttcttccctctggctcctttattcggatgataaaagcctttccgcacattttgatgccattaccgccaatcaattcattgagagtcttgctgaaagggctaagaagttcagtaggtcaaatgccgcgaagctaaaggcctctttaaatgatgacgacattgtcagactcttttcttgtgtcaaagagaaggcgagtgcttacgccattaacgagaatgcaattaatgctgagattagggataatctttcaagtatttttcaccttacttcgaacgttgatttatttgatgagcgagttgctgagttgaggagaagaattcagtttaatgtgtccgaagcgatgctaaaagcaattccttataaaatcgactatgagtcatttatgcaactttgcgagcagatatgcgcaaaaatttcttcaaaacgatttgagccagattactcagcatggatggctgctgctgatggcgatttgcttgacgtcagggagtcgtcgcgtgaatatcgacaactgcactcctgtcgggaagatgctttatttattacgcaacatctgtatttctgtgaatactatcgctctataaattatgagagacttgcaaagtgtcaggctgacactgttgctagtttggaaaacgctacatttaataacttttgcgattcgtgtaacctgctaaagcttgatggcaaagacgaaccaatccgacggctaatagaaactaagcgctgccaaaatagctatgcgtataacgatcatgaaaaatgggggtcatgcatttggcttacgagggaagaaacacctactgagaaaagaatttcatggaaagacgaaaccaatgattagctattcaaatgatctttttctccgccaaagagcaatagtagacagcatttatgttgactatttgcttgccattctttcttgcgctgacagcatgagcgttactaaattattggttttaacattcttgtcgaaatcaatcgaatctcatggaaacgagctgttgaacggtaggtgctcaaaaaatctaatcgagagagctgcctgcgcggtttctggttcttatagctctttcttatatgagcttcaatattcagttgaagccatcgagatagccaatgtgggcggtctcattgctattgaagatgcttttgtccgcctcactaacgagggacgaactcagggctgcagggtgaataattcgtttatctcaaaattgataagagaagtcgcttctctagacgataaatatgttctgtcggagatgattcgtaatgtttagcattgagtgcttggaactaatctcttgttctggggagtcgtttagatactccttttcgagcggagttaattacattcagggtcctaatagctctggaaaaaccgaattttacaattttcttgactatatgctcggggctgagaagaagaaactatccgagtcgccttggttcaaggggtcgttacaggcggccaagatgcagatctcttttaatggtcatggtttttccttgtatcgcgatttggctggcgatgagtttggactagtaatagatggaataccttataaggtatctgatctcgcggaatatagaaattacctcaatacgctgtttctggaatcggcggatgaccctaccaacctctctgaatatgtcggccaagagctgacatataggacgttcaccttattttcttttctaagcgaagctacggtcggccgaattagtggctttttcagcaaacttcttgaaacaaaatatcgagtaaaacagagacccttatttgattatttgtttagcatcaatccggatcgaatcgcgttccttcagcgcaagataaccgaacttggcaagcgagctcgcgagctagaatctcaacgtgactttttcaatcattatttagacgcagttaatcaagagcttgcaaagctcggaatcgtcgagcgtttcgatggcagcaatgctgctgtcatatctgaattgattgagacggctgctatctccattaatcttgattcttcttcgagcttgatggcaaacgatgttgttgaggcggatcagctaagaaacgatatcaaggcgcagaagcaaatgattcgcgagcttagggggacaaaggctcaggacgagaaacggtatcgccttctggataggttgaactcattgattgctgacgatgattctagggctgatcttttgggccaaacttgcaatctgcttggtgaaattgaagcgtcgatacccagaaaagaccttgattttcaaaaggaattacttgctcgcaaagtgagcagattaactcaacttgaagctaagttaacggctgcaaacgtggtgtttaatccattagactttaatgaaaaaagcaaggctgttttggtgtcaaatgagtatttatcccagtatttggcgctctacaagcccgatgatcttgatgatataaaaaaggagatttctcgtctaaaaaaggagcttctaaaccttaagcattctgatgatgatatttctatctattcaatttctgataccgtaaccgatctgtaccactcggcttctcaggtgtcctcctttgttgaatctgattttaagcaacttgattttcatatcaagtttcaaaaggaaggagtggggcttcaacccaccttttccgaaggggacgatagcgttgacgtgtttactggaagtcgcgctcgtcatactttgatgcagatctgcggttatctcgccttcatgcgttacttacttcaaaagcgtaacgttccgtttgttcccctccttgcattcgatcatgtctcgtcgccatttgatgacggaagctgtagggcgataggagcgataatctcgaagttttattcgcttgtggataaaaaagaagtacagctatttttgtttgagactgaagagccggatgctttgggcgttgatgtagataagtatatttctcttgtttcaaacggaagaactggtttcaacccattctacaaagctgactaaagtaatctgttttccggtgggggtgtgaacgtgcccggagttaagaatcagcattatgtgccgcgtttttatctcaagttgtttaccaatgaattgggctacctcagcgttgtaaggcgcgataatattgtattgaagcccatcttccgatcgaaaccctgggcatttgcccacatgagcaccgctgctcgaaaagcttcgggtatagtttattgtttatacctgcaccaaatagatggctgctaaaatatgaaacatagccggttcgaattagcgtttgcgtatcgcaaacggaagtgcattgtctgcgcattatattctgctacgtgcctatcaggtgcgactctacggaggaaccggctaacagctttaaggatctccgatgctcaatggatttcagtcgaaagcggatctggctgggtttcttgacctgtccttggaaaaacttgacctctttgtaaatccaacttccatgtatcagctatatagaagtagattggtgccaaaaagatgcggtggctatcgagagctattgattccaaggtctgatctaaaaaaggctcaaagaattatcgcctgtgagcttgaaaaaagctacagcccattgccttgtgtgcacggtttcgttaaaggtcggtcaattaaaacaaatgccgaaactcatgttggctcacaagtaattgtcggcttggatattaaggatttctttccttcaatttcgtcaaaacgagtatacggccttcttatttccaagaggctgggtctaacccctgaggttgcattctgtatttcgagacttgttgcgacgccgaaagggcttccccagggcgccccctcatctcctgttatttcgaacatgatttgcctcggtatggacaagcagctcatgcatctattccatgagtatcattaccaatattcacgatatgcggatgatcttacgttctcatttagaagttccttcttcttttaccgacacttttattcaggcggaaagctcagattgcctaataagctacgaaacgcaattactaacttccatgggattgcgtcattcgagctcaacgaagataaatctttttatagtttcagtttttcaagacagctagtcacgggcgttgtctgcaataaaaagacgaatataaaacgtgaacaatatcgtcgtcttcgctcaacgctgcatcgactaagtgtcggtgattgtaatggcgcaatgggttgctattacggaaaatccgttggcgagataaccgacgcagagattagaatgttcgaaccatctctccggggaagtctagattattacaagtcccttattaaggacccatggacatcggggccactcatgcgtttgggcagtttgtacaacaattcaaaaccagaagacgcacccgttttcccagtcgcacttcatcaagactcgattctgtatcttgaaggagtagattgcgaacaaaacccatttgagggactggggttttacttaaccggctacggtcttgtaacggcatggcatgtgatatgcgatgccgtttcccgcgatatggaaagcggggaaataagaatttttagctcaaacaagacaccgcttgctaggtttatatatagcaacgacctacttcaggagaataaacgcgatgctgcgatactaaaagatgtaccctctgaaatgataaagaacactcctcagctttcgccaaatattgatttacctacaaagggggagaagattactgcctaccagcatcatttttccgaatctggattcagctttgaacttcacggtggggaactgctcagattgggagacccaaatgaagagggtacgctctgttatacgaattgttcatttatgcacggaatgagtggcgggccagtgtttaatggtatcgggcaggtaatcggcatagtacatagcgcgaccgagcagggaaaactgggatcatttcttcctttaagggattgctttcgttcaactgacgtttatggaaagtggattatcttctaaagagatcatgtgcggctctcttaatcaggctggctctcgtccttctgcagaactccgcgaggttgcatgcctgcgggtcgaacccgccgccctcctccgtggctgtgtttcgtcaagaggaattgagcaaaaagagcatcggaaattgagcagcctgagcatcgggaagcgggtagtgtcgagaaagtttgtgtaagggcccttgcggcccctgtgtccgatatccggaatcagttgatatcctaggccgcctccacgctgtcggtaagttccaggctggattcgatcatcttcctggccgtcttctctagctccgcccagtcgtgctcgcccgcggcacccatcctgaacgcggcgtcatgcatctcggccatcttcatctccgagaagcacctcgatgtcgaccacgtctccgcctggtcgcacatgacggcgcccacgagcctgagcagcgagctctccgacgggaagacctgcaccacgcgcgattggcgctttatctccctcttggcgcgctcctgcacgttgttggtgcgcaggcgcttccagtgcgacggcgggaagtccaggtacgcgagtgcgtcgggctccgcctcctcgagcatcctcgccgccctcgggcagcacccctccagcatctcgcacgccgcgtggtacatagccacggcggtggcggcgtccccggcgcggaagaccgacgagacgatgcggcccacgcggcgcctcagctgccaggagccggcctcgcgcatgcagtcgcgcatcaggtgcacggcgcatcgctgccaggccgccccctggaagacctcgcctatggtcctgaccaggcccccgtgggcatcggagacgacgagttcggtgccgatcgcgccgcggtcgcgcagcttccgcaggaaaccgagccacgattcttaggactccgtgtccaccacggatgaggcgtatttgtcctggcgttatgttccgcgcttattgggctatgcgcaatacggcggcttcagtatgaggccggcttgcgcttcttcgggatcccacactgacaccttccaagtccgatttatgtccgcgccggtatttatgctttaagcaaagcggcacgagtgaacttgctacaagcctcatgctgcaagcacgttaaccaatcggtcgtgaaggcgaggtgagtatgaaaggtagaaaccagcacgttacgaagcgggcggatggcaaatggcaggttaagggtgagggggcgcgtcgcgcttcctttgttacgacgacccagggcgaagctataaagcgcggtcgtcaaattagttctaatcagcactctgagctaatcacccatcgtcccgatggcagaatccgcgcaaaggattcccatgggcacgatcccttcccgccgagaggataggggcttgacgccattgtggctgcgggcatggattggcgtgtccgcagccgcaagcgccttccggaagtatgcggcaaattctggaatccccgagcacaacggcttttccacatataggatccgcaggtagaagcattgcggcattccggagcgctcggcacgccagggatttgccgcatacttccgagtttttggccttgtgccctttgttctagatgctgcaaacacttgattgatgctatttaaggtctataatcaaataaaaactctgaaatatcttttcaaaacaatgaaaggaattttgaggacgatgctttgccagtttaccttcaggaactatagatcctatcgcgacgaaactgagctttccatgcaggcaacatcgatgagggagttcgagcgctcccttatagagtgccctgacgggcagagcttccttccggtggctgcggtttacgggcctaacgctggcggcaagtctaacctgctcgaggctcttgactatattcgttcggcggtggcaaggccgatcagattgttgtctgccagcactgatgcgccagaaggtaaccgatcttcaataccccgttgctctgcgtttgagttcgatgacgtgtcggctgctaagcccaccgagttcgagctctactatcgcgcgggtgagcatgagtaccgctatgccctgtccgtgcatgcggacgagatcgtgtccgaaggcctttggcgacgaaaattgggagcatcacgcacggcgatgctgttcgagcgtgagggcgcagaggttgaactcggtcccacgctgagtaagctcgtgacggctgcgagattcaacccgaggctgccgtacctgtcgtttctctgcatcaactttgacgtgccggtggtcaaggaggctgccagctggtttcttgacggggtgttcctgaactataacagctcctatctggagcagatgctcgaacaattgctcgatgaggatgactcacccgaggtcacgcgttttttgcgcgccgttgatgtacgtattgatggcttcagagtggagagggcgccggagtggcgcggccagcgcgtcttcgtgaggcacgaggtgggcggcaaggcgtacgagctgcgtttatccgaggaatctgccggaacccagaagctcatggggttggctgcgtatctgatgacagcgcttgagcgtggtggcaccgttgtggtagacgagctcgacgccaaactgcacccgaagcttcttcgctatgtgattctgctgtttaaggatcctggggtcaacaagagtggcgcgcagctcatcttctcgtcccaggatgtgtcaaccatgcgaaacgatgtgttccgccgtgacgagatatggttcgctgcgcgcggcgagggggaggcgagccaactgtggtctctcgccgacatccacgaggcaaacggtaatctggtaagcaagaacgcggctttcgacaagcaatacctttccggtcgctacggcgccgatccgtatctcacccgcatcgaggagtgggattagcatggtggcgaagaagtcgaagggctggcgtagcggcaaacgagagggccgctcgcgcatggttcagatgacgcgtcatcttgtagtgagcgagggcaaggagaccgagcctcgctactttgagggtgtgcgtgcggcgttgggtgcggcgaacgagcgtaaggttgccattgtcgttaaggggaccggcaaacacacacttgacctacttgactttgccgtcgaacattgccgctatgcgcccgagacattcgaccatgtgtggctcgtgtatgacaaggatgactttcctgcgtccgactttgacgcgatggagcgcaaatgcgacgagctctccgatggttcgaggaccttccatgcgttgtggtcgaacccctgcttcgagctgtggctgcttctgcactttcgctacacgaccgcgcatatgtccgcgtccgactgccagcatgccctcgcgcaggagatgtcgaagaacttgggcatcgagtaccgcaagaaccttgacgggatgttttgggcagtggatgataggcgaggcgaagcattgcagcgtgctgggcgcctcgccgcgtaccatagggaactgggtaacattaagccatctgcgcaaaacccttcaactaagattggcgagatattcgatgtgattgggccgtatctggttggatagtcgagttcgatcaggcttgctagagcatgggtccacgaaagaggctgcatgcagggttgctttctgccttggattggattggccttttggggcacgaataggatactagcgtgaattagcggtattgacgcagccaacctacgggcttgcgtcctgcggagaggcggctgttctctggacggccgtctctctctttgcgtccatgatgagaagaatatttcgccaagtttggcggtctcgatcgtgtggtttcgacttgtggtcgagtttgtaggcaaacggaggatatcgacaaaaaagagtcaattgcggtgggagccttcgggcgatacctgaagagggtggatgtgtcggccctcttttttggatgtaagattcgacctgtcaaaacttacatctcaattgggtaaagacgaaattacgggtgtttttctgcccgcatgtaattttactgacgcgtggtcgcttggccttaattcgcggcgggttttcatggctcgcatggactttggtcacattacttttctcgtaatggagtatttgattagactctcctatctcttgccgtaatataattacggcaagagataggagagtctaatgcttaagtgttttactgttgatggctataggaattttccgaatccggttacatttaattttgcggcttctcgtgattaccagtttgcagaaaataacgttaaaaacggaaccgtgaaaaccgcgcttttgatcggcagaaatgcgtctggtaaatcaaattttggttcagctttattcgacattacgctcggctttccaaaggcattcgattatcctgaccaggatgatcgtctatttttgaatgctgattgcgggcgaggcacagcacggttcacctatgtctttgaatttgacggtcgcgaaatcaattacagctatgaaaagacttctcccactacttggtttcacgagagcctatcgattgatgagagcctcattttcgatttcaataacgcgcgcggcgttttcgtagagaaccaccttgaacgaatcggtgcagctgggatcaattttgaattctccgatacttcgctgagccttctttcttatataacgagtagccttccaaccaatgttttaggcatcttggctgaattacgccgatttgtctcgcacatgaggctgattcgcatggaaggatttcgattaaaggggtttgaaacaagaaaggtggtcgacaaaatcatacgcgagaacaaagttgcggaattcgagtcatttattcgcaattttggagtcgatgagtctctgatcgttattaaagagtccgacggctcgcctgttttgtatttcaatcatcccatgcgatgcatcccgtttgtcgaggcatgttctagcggtacaagaactctggttaagttattctctgagcttgagcttaacgagtctgccagctttttgttcatagatgagtttgacgctttttgtcactttgagatggcggagagccttttgaagctctttgcttccaaggcatcttgtcagatactgtgttccactcacaacacttcgcttgttaagaatggcgttatgcggcctgactgcgtatatcaaatctctgcaaaaaatggcattcgaaccttggccgattccaccgatcgtgagttgaggctcggcaacaacattgaaaagctcctccgtgccggagagtttgagtagtcatgaatagagcgtctgaaaagaacgtcctgcttattgttgaaggggctaagcgcgagcctcagttgatggagcgattgtttgaatcatttgacctttcagacaattttcaaattgttccagtcaagatcaacgttcacgattttctaaataagctctttcaagaatacggttgcgattttgaggccgttgatcttaagccctttgttgctgagcttctttcggacaaagatgatgcggctcagcttctcgaatcaagcttcacggacactctgctcatatttgacttagatcctcaggacaatcggctcgattttaaacggcttgagctaatgcaagactattactgcgatagcactgatatgggccagctatatctaagctatccatcggttgaagcgtatcgtgatttcgatacctttggatattcgtcgctagatgacgccctcgttccttcagatgtgatttttggtcaacgttcgtacaaggagtgggttgccagaaggggagattcgcttgcggatatcgatcgcattgatggctatacatttgcctgcattgttgccgttcatgccctgagatcgctttggttaactaatgagcaggtgacgcaaaatgcaaaagagtctttggtcgatttagccgggactgtgatgaacattaatcattcggagctattgctcaatgagattgaccgtctgaacaatgattcattttgcgcctgctgcacctgcttattcttcattgcaaattggcctaagcggctttacgacattttgaacaaggcgattaagagggggttgggtattcgtttgttctaaagagtctccttcgccctttattttcggaagtgcggggaaaaattgaaaaccgccgagcacaacctgattttttgcaacaaaaccgcaggtcgcggaagcacaaagcaggggtctggccggctgatctcggctttaccccgcacttccgaaatcgcccgtcggaagtatgcggcaaattctggaaccaccgagcacgccgccatttttgcgcaaagaaaccgcaggtagacgcgttggcgctactcggcatggtcggccagctctgattttgccgcatacttccggatttgatgccttttatcctattttggcgcgttcgcacactctaaagatgttcttaaatcgcccttaaagattttggacatatgcacaggcagcgtacaatacgcatgtttggcatgattgagatctaaagggaggggagcacgcggtggaagtgctggttgttggcaatacttcgtatgtcgatgatgacttttgtgccaaggcgttccctggggaccatgttcaggttgtagctgcgagcgatgcgcagcgcgatggggcgtcggctccctcgtcttggaacgagctgctgcagcatctggaccaggcctacgagttcgatcgcgtggtctacctttccacctaccttacgccgcataccgagacctttggcgacatcgagctgctacgctcggtctttcgcgcctgcatggaccgccagatccagctgctgtttgtgacggggccggcgggcgccgatggcgacgtcgatgccgccggccaaaccggcaagggcatcattgcccacgcggccaacgacctgtgccgctactatgctggccgcgacggcatccaagccaagatcttgcgcgtgccctatctgtacaccgcttcgccggccctcgacgacccgtttttggtgccgttgttccaagcttgctcgcacggctcgctcgtgctcaagaacagcgcggatgcttcactccaggccctgtgcgccgaggaactcgccgtcttggtgagccgcatcttcgatagctgggaccccgtgtttgaggagctcggcgttgcggatagctttgcgcacacaatgggcaatctgggcgaggccctaaagcggctgttcccggggctccaggtaacctatggcgacgactcggaaacccccgtggtgccgagtgataccgttcgcatgcgctacggctggttccagcgctacgacgttctcactgacctttcgaccattcatgcccgctgggagcagtcccgcgcgggcaggcgccatccgctgcgccgtgccatcgaccgcatgcgcgagcacacgttgcccgtcatatgcgcggagaccgcgctcgcctgggtgctctttgagtgcctagagcgggtgttttcccaatcggcgcagcttaacgtactcgactatcgcctgctgtatgtggtgctgattggcacgctctacgggctcgattttggtctggtcgcggcgctgctggcctcgattggcctggctgcgagctactttacccagtatggctataccttccagggcctgttctacgagccctctaactggctgccgtttatcgcctactttgtggtgggcgccgtgtgcggctatgtgcagctgcgcaaccgcgaggcgctcaaggccgagcgcgccgagaacgagctcgtgcgtaaccgcaacgactttttgggccggctctaccacgacgccatcgaggataaacaggcatacaagcgccagatcgtgggtcgccacgacagctttggcaagatctttgccgtgacgcaggagctcgacgtgctcaacccgcgcgatatctaccgcaagtgctgcgagctgctcggcgagattttggaaaacgactcggtgacgatctaccacgtttcgggcggggcgtttacccgtttggtcgccgcgagcccggcaatttcggccgatgcgctgcgttcgttggcgctcgacgatcttaaggccatgatggagggcgtggaccattcgggcctgtgggtgaaccgcaagctggtgccgggtctgcccatgttcgcctacgtgatggagcgcgacggggtaccggcaatctttgtctttgtgcgacgcgtggccgagagccaaatgactctctattaccaaaacctgttccgcattttgtgcggtctggtggaaagcgcgttgggtcgcgccttcgattacgaggccgtggcgcaggacaaacgctgcattgcgggctcgcgtgtgcttaaacaggatgccttcggtcgcgagcttgccgccgagcaggcgcttgcagacagcaagatgggaagctatttgctcttgcgcgtggtgccggggatggagcccgtcggcgagctggtcggggcgattgggtcggcgatccgcgagagcgacgccgcgggcctggtcgacgacacgctttatctgctcatgcgtcaggccaccgaggccgacctgcccgtcatttgcaagcgcatggcctctaagcagattatcattgagcatgtcgacggcgagggcgttgtggcgctgctgcggcagattgcttccgccagcaccgacgacgagggggatgccgcttgatctcgcttgttgttgccgtgctcttattgataatccacgcgctggtgtgcctggtgctctggacgctcatgaagttgggcctgctcccggtccgcgggcacatgcttgccgtaatagtgctcgttccgctgtggggtcccttgctggtgctgctgctctgcgcgcgtagccggacttttggcgatgcgtcttgtgctggcacgttggaatcgctgcgcttaaaggacgacatgcgtcgcggcgtgcaggttcagcgccgcgaggccgatgccggcgtggtgccgctcgaggaggcgctcatcgtcaatgacgcgggcgaccgccggcgccttatgctctccatgctcaccgaggacccgggtgcctatctggcgcagctccaggccgctaaactcaacgatgacgttgaggtcgcacactatgccgcgacggctgtggcgcagatctccaaggagtccgaccttaagctgcagcagctggagcgggcgtttaaggccgatccgagcgcgcaaaacctggatgattactgcgactaccttggcgactatttggcctctggcctggctgagggccgtgtggcgcagatccagcgtcagcagtatgctcgcctgctcgcgcgtcgttgcgagcgcgaagacgggacggcgctgcgtgttcgcttcgccacggcgctggccgatgccggcgagttggacgaggccgaggccgtgaccacgcagcttgtggcgaatgcgccggacgaacaggaggcctggatgctctgcctgcgccttgctgtgacgcgccacgatggcgagggcgtgcagcaggtgattgacgcgattgacaaccagcatgtgtatttgagcgccgacaaccgcgagaagttggcattttggcgcgatggggaggaggcccgatgagcgtggtgcagcatgtccgcgaccgtgcgggccattttcgctggatggggctgctcgtggtgtgggcggtctttatcgccatggccgccgtgctgctgatcgagcgcgccggcgtgcagtatagcgccgggcagcacaagctgggcatgcttgccgctaccgatgccatgcccgcaagctcggcgatctttggccaaaagcctacgtgtctggtcattagcgactcggaccaggatggcgtcgaggacgtcaaggaccagtttgaccagattctgctcgacatgaagatcgcgcaccgtgatatcgatattgccaccgatggcgcggatgcgattccctcgctcgcgtcttttgaccgcgtgatcgtgctgatgccctcgctcgatgcgctgggcacgcacctcaccgaccttatgagctgggtgagcgccggcggttcgctgatgctgggcatgaccccggagagctctggttacttgcaggcgattgcgcccaagctgggtatcgataccgtggggtatgagtacaccacggccgagagcatcgtcccaagcaaggactttatgattggcgggggccaacgctacgagttctcggatccctttaaatcgtcgctgctggtttcgttgcgcgagacggcgcatgtgtgggccaaaaccggcgatacggaggccccgctcatttggtcgagcgattgcggcagcggtcgcaccgtagtgtgcaacattggcatttacagcaaggtcatgcgtggcttttacgctgcggcgattagcttgctgggcggtgctacggcctatccggttatcaacagcgccgtgttctacttggacgactttccgagtcccgtgccctcgggcgacggcacctacatcaagcgcgactacggcctttccattgccgatttttacaccagggtgtggtggcccgatctgcaaaagctcgcgcagaagtacgacattcgctacacgggcgtgatgatcgagaactacgaggacgttgtcaatcaggtcgagccggtgcgtcaggcggataccacgcagtttcgctactttggcggcatgttgctgcaaatgggcggtgagttgggtttccatggttacaaccatcagccgcttgccctctcggacaccgactacggcacgatgtacgactataaaacctggaagaacagggagacgctcgtcgcagcgctcaacgagctcatcgcgttccaagacgaggtcctgcccaatgcacatggcacggtgtatgtgccaccgtcgaatatcctttcggcccgcgcgcgcaagatcatcggcaaagacgagccacgcatcaaaaccatcgccagcacgtattttgaggatggcaccgacctgccctacgtgcaggagtttggcgttgccagcgatggcatcgtggagcaaccgcgcattgtctcgggcggcatggtcgacgatacctacatgcgtctggctgcggtgtccgagcttaacatgcactacgtgagtacgcactttttgcaccccgacgacctgctggatcccgaccgcggtgccaaggagggctgggaggtctacaaaggaggcctgaccgactacctggattggctgaccacgtcggcgcccgacctgcgtcatcagacgggctcggagtgctcgggcgccatccaacgtttttcgtccgtgacggtgagcgtggatacgagcgacgatgcctggacgctcagcctgggcaacttccacgacgaggcatggctcatgttccgtgccaataacggcgagccgggcgcggtgtccggtggcgagataacgcatctgacgggcaacctgtacctggtcaaagcgacggacaaaacggtgacgatcgagcgcaaggaaggtggcgaccgatgagaatctgcttggtgctcgagggttgctacccctatgtgcacggcggcgtatctacctggatgcacggctacatccaatccatgcccgagcacgagtttgtgctgtgggtgattggcgcgcatgctggcgaccgcggcaagtttgtctacgagctgcccgacaacgtcgtcgaggtacacgaggtatttctggacgatgccttgcgtcttacgggcgaacagcacgaagccggctttaacgaccgcgagcgcgaggcgttgcgccgcctggtgtcgctctccaacccggattgggatgtgctgttcgacatctttcatcaccgtcgcgtgcatccgctctcgtttttgcagagccgtacgtttatggacatcttccgcgacgtgtgcctggccgagtacccctacgttccgtttgccgacgccttccacaccatgcgctccatgctgctgccggtgctgtacctgctgggcagcgaggttcccgtggccgatgtgtatcacgcgatctcgaccggctacggcggcttgcttgcctgtctgggagcgagcgtccacaacgctccggtgctgctgaccgagcacggcatctacacgcgcgagcgcgaggaggagatcattcgcgccgactgggtggtgccgtcgtttaaggaccgctggattcgctttttctacctgctttcggaggagatctaccgccgcgcctttcgcgtgacgagcttgtttcataacgcccgcaagacgcagatcgatatgggctgcgatgcggacaaatgcctggtcatccccaacggcattcagttcgaccgctttaaggacattcccttaaagcccgatgacggctgggtggacattggcgcggtggtgcgcctggcgcccatcaaggacgtcaagaccatgatctatgccttctttgagctgcacgagcgcctgcccaaggtgcgcctgcacattatgggcggcgtggacgacgaggagtacggcgctgagtgccacgcgctggtcgataccctgggcgtgcgcgacctgatctttaccggccgcgtcaacgtggtcgagtacatggaaaagctcgactttaccattttgacgagcatctccgagggccagccgctcagcgtgctggagtcgcttgcagcgcgccgtccctgcgtgacgaccgaggtgggctgctgtcgcgagctgctcgaaggcgccccgggcgacgactttggcgtggcaggttttgtgacgccgcccatgtatcgcaagggcttggccgatgccatggagcgcatgtgcacaagccgcacccgccgcattgagatgggggagcgcggccagcgtcgcgttgccacgtactttttgcacgagcagatgctcgccaactatcgcgagctgtacgacgagacagcgcgtgcgtttgacctgcccagagagggggagtagccggtggccggaatcggttttgagctcaaacgcctgtttaggcgcaagggtctgtttgccacgatgcgcgcctatggctacgccggcattgtgtgcacgggccccatgctgctgggcgtgctactccaggtgggtatcttggtgctgtgcggtttgtggggtgtggggcgcgccaaccaggatctgctggtgtgcatggtgacctatacgctgctggcatcacttacgctcacgagttttttctccatgccggtcacgcgctttttggccgacatgctctttgccgagcgcgaggatgagatcctgccttcgttttggggatctaatgccatcatgctcgttgcgggcatggtgctctacggcgtctttttgctgttctcgggcgccacgctgctgcaggggctgctgtgcctgtggctgttcaacattatgattgtcaactggaacggcatgagctatctcacggccatcaaggattatcgtggcattctgtgcagctttgcggccgccattggcgtggcgtgcctgtgcgccctggcagcgctggcgctgggactgccgccggtcgagggcctgttggcgtcaatcggcctaggctacggcgtcatgctcgcctgggatgtggtactgctgtaccggtattttccacggagtgaccggagtccctggcgttttttgcgctggctcgaccaatttatgccgcttgcgcttacggggctgtttaccaacttggggcttttcgcacacctggttattatctgggcgggccctattggcgtgcagatcaaaggcctgttttacggggctccttaccatgacgttccggcactcattgcgtttttgaccacactcgtcacgaccgtcaactttgtggtgtcggtcgaggtcaatttctatccgcgctaccgtgactactacagcctgtttaacgacggcggtgtggtgggcgatattgtggtggctgaggaggagatgctctccacgctcaacagcgaactgcgcttttgcgcgctcaagcagctgtttgtgaccgcggcggtcatttcgctcgagaccacagtgctctcggccctgccgctgggctttaacaaccttatgcacgggtattttcgcacgttatgcgtaggctacggcctgtatgccgtgggcaacacgattctgcttatcttgctgtactttaccgactacaagggagccgttctggcctcgggcctgtttgccggtgtggcagagctggcgaccgccgtgtcgttgcttttgccgcagcagttttacggctttggctttttgttgggtgcggtggtgttttttatcgtggccctgctgcggctcgatacctataccgccaacttgccgtatcgtatcctgagccagcagcccattgtggcgaccgacaaaacgggtcgctttacacagctgggccgcttgctcgaccgtgccgagcagcgctatgaggagtgccgccgcaagggcgtgccgcacggcgcgtttcagcgcgcagtagttcgcgtgtatcgcaaccattggggaggttctgatgatcgataagttgatgtctcgccgctgtctgatcgaggcggctaccggcgcgctgctgctttcgggctgctcatctcaggacgaatcctcgacaaataaggtaaaaaagcaggacaagattaaaaaggccgaggcctccgaccagtccaagcatctgcgcgataaggacgagctgtacgaggtctacgacgactcggacattgtgaccatgtacctgacggtctcgcgcggcaacagctccgagaacaccgaccacagctgggccgagatcaacacgtactcggtgtatgactatgccgacatgggcgtgacgcgctatcaggttatgggcctgctgcagccgggcgacgaagacggcccggtggccggcgaggttggctatggcgaggaagcgcccaatgccaccgtgcaggtgcgcggccagacgtcgagctcctacacgcaaaagaattacaaggtggagctcaaaaaaggcaagggcacctggcgccaacagcgcgcgattgcgctcaacaagcacatgggcgagggtatgcgttttcgcaacaagatggcctacgaccttatccgcgggattccccagatgatgggcctgcgcacgcagtttgtgcatctgtgggtgtgcgaccagaccgaaaagtccaacgatacctttgaggactacggcctgtatacgcaggtggagcagctcaacaagacggcgcttaaggcacatggcctggataagagcgggcacctgtacaaggtgaacagctttgatttccatcgctacgaggacaccattaagcttgccgacgatcccgactacaaccaggcaagctttgagggcatgctcgagattaagggcgattcagaccacaccaagctcatcgagatgctcgatgcgctcaacgacgaatcgcacaagatcgatgacgtgctcgacacctactttgataccgagaacctggtctattggctggcgtttcagattctgacgggcaactgcgatactcagaaccgtaactgctatctgtatagcccgctcaactccaatacgtggtacatcctcgattgggataacgacggcatgctgcgtaagcttgagctgagcctgaaggggttctcggactatgcgagctgggagcgcggcgtaagcaactactggggcaacgtgctattcaatcgtgcgctgcgcagtaaggcgtttcgcggtgagctcgaccgcgccgtcaaggatctgcgctcgtatttgaccgaggcgcgcctggccaagatgattagacattatcgcgaggttaccgaatcgctggtctttgcttcgcccgatatcgaccatctgcctgtcaccaaggaacaatacgagcaaatcgccgcggcgattccctccgagatcgaggagaactacaagagctttcgcgagagctataataagcccatgccgttctacattggcgtgccacagatcgataacggtaagctgcgcattaactgggatgcgtcttacgactttaaggcgcgtgacattcgctataccgtggagctggcgcgcgactatgccataagcgatgtgctttttaaggccgaggacgtgctacttcccgaggtgacctgtgatgcgcccgatgccggccagtattttgtgcgcgtgcgcgccaccaactccgacggctatacgcaagatgcgtttgactactatgtgaccgacgacggcaagcactacggcatgaagtgtttttacgtgcaggacggcggtaaggtcgtggaggatgcgtatgaggagggctagcgcgctgcttgagcgcttggcagctccgcctgtgcgtgccacgcaggagcgttaccgccacgagctcaaatatctcattaacgagggcgagcacgccgcgcttgcctgtcgcatggcgccggtgtttaaactggacaagcatgcgcgggcgggtggttacaccattcgcagcctgtactttgacgactactgcaactcggcctacgaggaaaaagacgctggtattctcatgcgcaaaaagtatcgcgtgcgcatctataacggcagcgacaaggtgattaagctcgagcgcaaaaagaagtacggtagctggatctacaaggaggacgcgccgctcacgcgcggcgagtttgagcagatccttgctggcgactacgactttttgctgaggagcccctatccgctctgtcgcgagttctacatcgagtgcatctgcaatatgatgcgcccgcggaccatcgtggactacgagcgcgagccgtgggtgatggacgagggtaccgtgcgcattacctttgatagcaacgtgtgtgcggcggtggggagctttgacatctttgacgcgacgttgcccgcgttgcccgtgctggagcccggcaagctggtgatggaggtcaagtttaccgagttttgtccgcagctggtgcgcgatatggtgccgccaggtgcggccgaactcacggcggtctctaagtactgcctgtgttatgacaagaccgcctacctgcgcggttttaactactgggaatcggattttgggaaccgaggggatatttagaccatgagcactagggacttttttaagaactccgtcttggaggcgtttggtcaggtcgaccccgccaagattggcctgtcgctgctcgtggcgctcgccatgggcatcctgatctactacgtgtacaagcgcttttttaccggcgtggtctattcgcgcagttttgccgtgacgctcgtgggcatgtgcgtgctcacctgcatggtcacgctcgcgatctcgacaaacgtggtcatctcgcttggtatggtcggtgctctgtctatcgtccgctaccgtacggcggtcaaggacccgctcgacctgctgtatctgttttggtccattaccacgggcattacggcgggagccggtatgtatgcgctcgtggggctcacggctgtggtgatcgtggtgatgatcgccagttttgcgagccaccaggacaaggcgcgcatgtacatgatggtcatccactacacgggtcagaccaccggcgacgatatcgtgcgcgcgtttgggcgcaccaagttttccgtcaagtccaagaccatgcgcggtgacaaggtcgagatggccgtcgaggttttctcggacggtgtggatatgccctatgccgacgccatccgcgcactcgatggcgtggaagatctaacgctcatccagtacaacggtgaataccacggctaattttgttccggcgttctaacgaacgccggaccgctcgacgctgcttgcgctgacgttttctcgacctgggtgggctggtcttggtttggttttatgtaaaggatggtgccgcgtggacgtgcaacagctagaagagtcctgggctgcaagggccggcgcgcgtgaggcgcgtcttgttgcggcctcgcacgtgccggtggcgctgtcgctgctggggattgtgcgtcccagcgatcgcctggtcgtgtttgccgatgactttgccgatgcgtttgcgcgcggctttgatgcctgcgacgttgtgctcgtgggggagccgtcggttgcggcgtttaccgccgcgtccgagggttttgccaccgcgtttgatgccgaggtgccgcacctgtggtggtttgtgaattcaatcggcggctttggcctgcgtgttcccgatttgcgcgcgctgggtcgggcggcgcgtgaggctcatgcgctgctggttgtggacaacaccgtggcgtcggcttttggctgcgattcgctgcggctgggtgccgcgctgtcgctcgaggcactcgaccgtgtgtgtgccggcgaagctccgcgcaagctcgtcgccgtctcggtggcgcgctcgcagctcaagcgccatcgtgtggatgcagctgccgagtgcacgcatgccctgcttgagggctgcggcttggccaagcttgatttgactgctgacgaggccgacgtgctggagcgcggtctggactcgctcgatgctcgcatgcaggctcacttcgaccgcgcacgtgcactggccgagtatctggctgccaacgagatggtgcgcaacgtgcgctatccagggctgggttcgcatcccgatcatgcggttgcaacgggaatcctcgagcacggctttggcccggcagttgagtttgaccttatcgagcgaagtgcgggtgagctgttcgacacattgccgggggagttccgcacgtcgcccgccggcggcgcaacgacacgcctttcggccccacgcggcaagcaggggggagccatccgcctcttcgccggcaccgacgaccccctaaccgtagccggcgccctagacaacgccctccgcaactagctattttggggcttgtctcggggtagtctttttgggacgggctttttagctactttgggactgggccgtgggggactgtgccacgaaagcggcctatctactacgtttaacccttagggggcgaccttacctgccttttttgaaaactggcaagctgtctaccagcggttttgttttcaagaaatctggggtggtcgagggtgttcaactaaacgtagtagataggcccattttatggcgcgcgtcttaattagttcgtgcggcggatcaataatcagaccaaatagactactttgcgttgatgctggctatgagggcgtcggctttggtggcgatgacgatgttgatgtcggcctgcagctcctcgtagaccactatggctcgctcgccggcgggggtgagcgtggatccgcgggcgccgtcgcgctcgatgagcttacagcctagctggccttccgcttcgtttacaatacgccacgctttggaataggccatgcccatgctcttggcggcgcggttgagcgagtgctcgcgggcaataccctgcagcagtaagacgcagccgtggccgaacacgcccggcagatccttgtcgcacgcttgaatgaccaactttgccgtcgtcttgtactccatgtgctccacgtctccccgctaaagtgtttgctgggcaaacgcaaagcctgcgtcaaaccctcgtgtgctcttcttaaatcatgcattgtagcagtcaaagtgcgttaagatacttccccagtattgggcgcccaaggttgggctgggtcctacgaggcctgcagccgaccggtcgcatggataaaggagaaacatggctacgttctttcccggtgagtcccacacgttttcggagtatctgctggtccctggttactcgtcctcgcagtgcatccccaacaacgtctctcttaagacgccgctaacccgcttcaagcgcggtgagaagccggcaatcaccctgaacatccccatggtttccgccatcatgcagtccgtctcgggcgtcgacatgggtgtcgcgctcgctaccgagggtggcctgtccttcatttacggttcccagacccccgagtccgaggccgctatggtcaaggccgtcaaggatcacaaggccggctttgttcagtccgattccacgctgacccccgacatgaccatggagcaggtcatcgagctcaaggagaagaccggtcactccaccatgccggtcaccgacgacggcactcccaagggcaagctcctgggtatcgtcaccagccgtgactatcgccccagccgcgatgaccaccagaagaaggtctccgagttcatgaccccgcgtgagcagctcatcgtgggcgacaagaacatcagccttaaggttgccaacgacgtcatctgggacaacaagctcaacgctctgcccatcgtcgacgacaacgatcacctcatgggcatcgtcttccgcaaggactacgacagccacaagaccaaccccaacgagctgctcgataacgacaagcgctacatggtcggcgccggtatcaatacccgcgattatgccgagcgcgtgccgctgctcatcgaggctggtgccgatgtcctgtgcatcgactcttccgagggcttcagcgaatggcagaagcgcaccatcgagtggatccgcgccaactacggcgaggacgtcaaggtcggtgccggcaacgtcgtcgacgctgagggcttccgcttcctggccgactgcggtgccgacttcatcaaggtcggtatcggcggcggttccatctgcattacccgtgagaccaagggtatcggccgtggccaggccaccgcgctgattgacgtctgccgcgctcgcgacgagtactacgaggagaccggcgtctacgtgcccgtgtgctccgacggcggtatcgtctacgactaccacatgacgctcgcccttgccatgggtgccgactttatgatgctgggccgttacttcgcccgctttgacgagagcccgaccgagcgcgtcaacgtcaatggtcagtacatgaaggagtactggggcgagggttctgcgcgtgcccgcaactggcagcgctacgacctgggcggcgccgcgaagctcagcttcgtcgagggcgtcgactcctacgttccctacgccggctccctcaaggacggtgtgggcggcacgctctacaaggtcaagtccacgatgtgcaactgcggcgccctctcgatccccgagctccaggaaaaggcacgcctgaccctggtcagctccacctccatcgtcgaaggcggagcccacgacgttgtcgtaaaggattctcagcagtccgtgtcttatcgataggcctgcactcataatcgatctttcgccgattggtgccgcccacttggttgatttccgatcccagccgaacacattgagcgaataggccgttcccgcagctagccgaacgcccccgaggcccaattcaggtcccgggggcgtcgttttcccagttgaaggaacggtggagatgtgtttcgataggtccggtggccatgctccgcccgccgcccggcacctcttcccagactcagccggaggcatagaccttctggtcatgccttgccttttgaatgacaaattgtcgctctggacggcacgcagcgtcggctggtccgccgttcggtagaacggcggaacttagactgcctgtgccagcttctcggctcgctcggcggcggcgagcgcctcgatgacggtgccgagctggtcgcccaggaggacgccattgtaggtggagttgaaaccgatgcggtgatcggtcacgcggtcctggggctggttgtaggtacggatcttctcggaacggttgccgtggccgatctggctctggcgctcggcaccgagctctgcctgctgcttctcgagctccatctcgtacagacgggcgcgcagcatctgcatgcagacttcgcggttctggatctgggagcgctgttcctgcgactgcaccacggtgttggtgggcaggtgggtgatgcgcacggcggaataagtggtgttaacgcactgaccgccaggaccggaggcgcagtaggtgtcgatgcgcaggtcggactggttgatctggacgtcgatctcctcggcttcgggaagtacggcgacggtcgccgtggaggtctggatacggccctgggactcggtcttgggaacgcgctggacgcggtgcacgccggactcgaacttcatgacggagtagacgcggtcgccctcgaccttgaactcgatggacttaaagccgccggcctcgctggggctggagtcgagcacggtggtcttccagccgcgcgactcgcagaagcgctgatacatcttgtacagatcgccggcaaagatagccgcctcgtcgccaccggcggcggagcgaatctcgacgatggtgttcttgtcgtcgttggggtcgctcgggatgagcatgtacttaatgtcttcctcgagctggggaagcttggcctcgttttcggagatgtccatctggagcatctccttctcatcggcatcggtagtatcgtggagcatttccttggcagcctcgatgtcatcgagcgcgccgatgtactcgcgcgaggcggcgatgaggtcggactggtgcgcgtactccttgttgagacgcgtgaactccttgatgtcggaggcaacggccgggtcggaaagcttcttctcgagctcctcataggccttgatgatcttttcgagcttgtcgcgcatggcgggactcctttatatgcgtgaaggtgaaaatcggcagaattgatggggcgcatggcgccactgcgggggtaagcccagctagagcatgtcgatcttcagatacatgcgcatcccttcgcgtgtggggtacatagttgcgatctaacccatacatgatagcgtgcgcaggcaaacctgcatataacccgcacggaatgagtggacgtagccgttgggtacgttccttaacgactagtcgtttaagagcgtccccaacggctaacaaagggactgtcgctttgtcagattctagagcgtgtggagtagggcgatgaggaagcgtacgccctggaggtaggcgcggcgggtgatgcgctcgttggtgccgtggacgccgcggtcgcactcgtcatcgtcgaccacaaacgccgaaaaacgaatgcattcggagcaaatgtgctggtagttggcagcgtcggtcgcgccgatcacggtcgaggggacaatcgccaacggctcggatgatccgttttcctccgtcccctttggatcgcggaaatagcgggcggcgatggagcgaaccgcctcgaggccgggaccaccgatgcgcggggacggcgagggctcggagctgccggggcccagctccacttcgacacgaccggcaaggtccgccccggcaaccgcctcacggcagcgcgccacaacgtcggccacgctcgtgccctcgagcatgcggaagttaatgttggcccacatatcctgcggcattacgttggcgccggcgctgcctccctcgatctgcgtgggcgcgcaggtggtcgtcaccagcggatagagctttttgctggcgaggcactcgcgcacgatggcatccccgttggcggcaatctcatccgccgtggagagccccagctcgacaagctgcgcggcaagcagatcggtcacgcgcgtcggccactcgatatcgcagattgcggcgatggcacggctgagcacctcgagcgacgtgccgccgtaggggttagacgaatgcccgcccgcgctcttcgtcttgagcacaatatcggcgtagcccttctcggcaaggtcggcatgcataagccagccctcgcccgcgccgtactcggcagccgaaacgatacggtagtcaccctcgtcgatcaggtattcaagttcaataccgcgctcctcgagcacgcgaccgatcgcccccgcgccgtactgcgtggtttcctcgtcctggccaaaagccagcagcagggtgcgctcgtgcccccagccgtgcgccaacgcatactcaaccgcctcgagaatacctgcgacctggtctttcatgtcgatagcgccgcgaccccaaatgtaggtgtcgtccacctgtccgctaaagggagcatgcgtccagtcggcctcggtgcccggcaccacggggaccacgtccatgtggcccatgagcatgacgggtttgagggcggggtcggaaccgtcaagcgtcaccaacagcgaatggtcgacaagctcgacctcgcccgccgcgaacacgcgcggccaggcctgctgcatataggcgcgcaggtcgtcgaagggctgccaatccaccgcctcggcatccatgctcgaaatggtcggaaacgacagcacgcggcccaagcgctcgcacgcgccggcctcgtctatatcggcaaaatcgtcctcatgcgcaaagaagcgccaaacctcggccatgacatcctttcgattgtgacgacaaaggccgccccacgggagcggccctgcaacgtaagcgtttgcggtcggttatttgtcctcgagatagcgagagaggaactcacgagtgcgctggtgtttggggttgccgaagagctcggccggcgcggcatcctcgagcaccacgcccttgtccataaagaccacgcggtcggacacggttcgggcaaaggccatctcatgcgtgacgacgaccatggtcatgccgtcggcagcgagcttgcgcatgacctcgagcacctcgcccacgatctcggggtcgagcgctgaggtcggctcgtcaaacagcatgatctgcggattcatgcacagggcacgagcgatggccacgcgctgcttttgaccaccggacaggcgacccacggcggcgtgcgcgaacttttcgagtcccacgctggtcagatgctccatcgcgaccttctcggcctcgaccttgctcatctttttgagcgtgacgggcgcgagcgtgcagttgtcgagcacgtccatgttgttgaacaggttgaagccctggaacaccatgccgatgtcctcgcgcagtttattgatattgcagcgctcggcagtaaggtcctgaccgtggaaccagatatggccggcatccggagtctcgagcaggttaaggcagcgcagaaacgtcgacttgcccgagcccgaggcgccgatgatggtgacgacctcgccgggattgacggacaagtcgatgcccttgagcacctcgagtgagccaaagctcttgcgcaggccctcgacgcggataagcggctcttggttttgcacggctgccgcagtgccggtagtggcggtatctgccatgatgattctcctcgtcttaagcctagttagagctgggcagcgtggccggagcctcggcgccgagctttttgccaaaggcctcgagcaggcggctcgccacgagcgtcaggatcagatagaccacgagcgccacgcagtagacctccatctggcggtagtacacgccggcgacggtggtggtggcgtacatgaggtcgaacacgccgatgaccgagagcaccgacgagtccttgatgttgatgatgagctcgttggtgagcgccgggatcgcgtttttaataccctgagggaacacgaccttgcgcatagcctgccactgcgacaggcccagcgagcgcgctgcctcggcctggccgggatcgatggactcgatgccgccgcgcaggacctccatcatgtaggcggtggagttgagcgagatggtgacgaggccggcggtgaaggtactccagatctggttggcctgggcggtctcgaagcccatgccgcgcagaacggtaaagcccgcgtaatagatgagcaggccctggaccatcatgggcgtgccgcgcacgacggtggaatagacggtcgcaaagcctcggccaatgctcttaaagaagcgcaccaggtcgttgtcgacgcgatcgaaggtctgggtgcgcaagaacacaaagagcagcgccaagaagaaggcgatgaccgtgccgaaggtggcaagcgcgatggtgatctcgataccgcggataaagaagtcgccgctcttgtaggtcatgtagaccaagctcgacagaaagtcgctgggattggagtccgagacaatgctcacctgcaccaggtcgacaaacgacatgacgcagcggtcgataaagaagatcgccgcgatggcaaccacgacatagctgcccaggcgcgcgccgcgacggcaacgctcagatgcaaacggcgacgtttcgcgatagtcgttccagtgtatgagcttggtgacgagcgccgccgccgacacgacgagccaggcccaaaggattacccagaggcagtcttggaacacgcccgtgggcgccaagaagctcagcggcgttgggttgcgctggctaaacgccagaccgagcgccgcgatagcgctcgtgcccaggtacacataacggtggtcggccttgataaaggaggccagacgattgatgcctttcatgctgcctccctatgccggctgacggtcgaggcacgcgtcccacatttggtcgcgctcctcttggctaatgcccttgagtgtcttgtcgatgagcttaagcagtttgtccgagcccttgcggcaaccgacatttgccgtgacctcctgcttaaagccctcgccctcggcaaagcgaatgggcacgatgcccgggttttgggccatatagcccttctcgttttcggtgttgtaggtcacagcgtcacaagtgccctgcagcagattcgagaacaccgtggggaccgaatcgaccgggttcttgtgcacaacgcccggaatctcgtcgatgacggtatcgagcatggtgtccttttggccgagcaccgtggcaccgctgaagtcgccgagcttggtggcgttttggtagggcgagccctcttttacgaacaggccaaagtagccaatgaagtacgggtcggaaaagccgacggactcctcgcgctcgggcgtggcgctcatgccggcgatgatgaggtcaatctggccgttgttgagcgagtcgataaggcccgagaagctctgcttgacggcaacgggctcgccgccgagagccttgcagacgatcttggcgatctgcacgtcgtagccatcggcataggcgccctgcacgttgtcgatggggatcgtgaactcgctggcctcggaaacctgccagttgtacggggcgtaggccgcctccatgccgatgcggatcttatccttgccgataacggaatcggacaggtcatcgcgaccgccgcccgtcgtgggctgaactacttccagcgtggagggacgctggcagccggcaagtgcgccggcgacgacagaagcgctcgcagcgagagcgctacccaaaaagatgcgacggctgcataccggctgtggatgcgcgtcgcgctgttgtcgagattgcatctggtgccttcccaatttcgttttgctgacaataagacaggatatacgcccgcgaccagcagcgcggcatgtgcgcgaaaaattaatagacacacgaggacgattggcgcaaagcagcctgccccatgtaccacttggcatgaaaaaggcaaggcatagaccttctggtcatgccttgccttttgaatgaggcatagaccttctggtcatgccttgccttttgaatgacaaattgtcgctctgggtggcgcgcagcgtcgaccggtccgtcgttcgttagaacggcggaacctctagagcagggtgacgctaaaggaacggatgtcggtagcgcccggtgccaacgtgatggtgttgaccttgtgatcaaagacatcgtcctcggtgtccatggtggtgtggccggtccagggctcgagcgccacaaacggagcgtcgttggcggcagaccacacgccgatgtacttaaagccctcaaagtcgatcttgacgccgtggcccgacttgcggccgcgcagcgtgagcgtggagcccggagtatcggtgaacatgatggcatcgttatcgaagctgcggtgcgtgatgggcagcacgtccgagttatcgggagccttgtagctaccctcgaacgtcatgagaccgtcgggcgtgatgatgggagcctcgttcgtccaggcctcggtaaacgccagctcgtaatcctcgaatacctcgtcctcggcaccgggggcgggcacgttaaatgcggggtggccgcccaccgagaacggcaggtccacgtcgccggtgttcgtaacggcaaaggtctgggtaagcgtggcgtcgccggtcagggcataggtcatgttgagcttaaagtgaaacggaaaggccttgagcgactcgggcgtatcggtgatctcgtacgttaccgaggagccgtcctccgaaacctcgaccagcttgtgctcgacgatgcgcgcgagtccgtggcgcggcatctcgcaggtgccggccgcagacgttgccgtgttgttgcgcagcgagcccacaatggggaacaggatgggcgcatgcttgccccaaaaggtgggatcgccctgccacagatactcgttgccgttgagggcaaggctcgtgagctgggcacccatggaatcgatggccgcggtgaggccgccgcgcttgatggtagtgacggtggacatgctacttcctccaatagtaaacaacggtgtcgagggctattgtcccactcttggcggcggggttgagcgacaggtgcagttattgagcaatagcgtaaaggtcaaacccgccctgcggcgtgctatcgaccgtatcgggcgcctgtgaattaaaactcaccggaaccatgcgctttgaggcacggtaacgcgtgccgtcggtggcgacgggcggctcatcgaccgtgagctcgtagtcgccgggcttgagctcgatgccgtcaccttcggaattgacgtattggtactcgtcgatcgcttgccccttgagcgtgcgacccacgatatggacgagcatctggctgtcgccgcgcgcggtgtcccacgtcgcgccgtccttgacctcgaccgatacatgcaccgagcgcgtgcggctgagcgattgttcgacggacatctcgaccttggcggcgtcttttcgttgttgttcaacatggctccagacgtttccaattaccgagcatgcgataacgccggccatgaaggcgatgaggatggggccgagcggagagcgacggcccgcgtcctcctcgcgagccaggtcggggcgacgtgtgggcgcgggtgcttgggcaccctgcgagggcacgtcgagaatgctgaaggatgccgtactgccggggtcgatgttatggcgcggctgcgggatcttggccggcgagatggacatgtccgccggctcaccgagtgtggccgtggcatcggccttagcttcatcggcctcggcttgggcccaagcctgctcaaaggtcaggggctcggcggcatcggaggcggcgtcaggctcgacagcagcatcgttgccggcctcgtcctcgtcgctcgacacgtcacgcggcgcgggctcgtcccactcctcgtccggagcctcgccctcgctataccaccattcaaagttatcgatatccatacggggcgccccttaagcctcgcaaataaacacttgccagccttatacccccagatggcacgggagctcgccggcacagacaggaaaagcgtcacaacattcgacgcttttcctcgttttcgagattttcatcaaatgttgtgacggtttgggcagcagccacaccacgaatgtgacaaagggactgtccctttgtcacatctggagggtaacagggatttggatgcagcaaaagtcctcttggtgggactcgtcgtagctcgtggtatcgaggtagcaaaagtcgaaagcgttgccaacgggctggagcgcgtgctcgtccatgcaggcaacgatggcgcggatgccctcgggctcgtacggcataccccagcggctcatgcacaggtatgtgccctcgggcagcacttcgatgccgatctctgccagctcggcgggatcgctcggcagcagttcctcggcaccgcgcggcagcacggcaaaggagcccgcgccggcgatagggtcgtcggaatgcagcgcctcacgacgcagcatggcaccccagccgcgcatagggcgcgtgcccgtcaacgcacgcatgcgcaggatggcccgcatgagcgtggggtgaagcatcgagcggccgcgctcgatatcgcctggaaactcctcaaagaccacgtagcgacgctcaaactgcttgagctccggcctgccctcgcgctcgcgccagtaaaccgcctcgtcgtaaaagctcaggcgctcctgcacgctcgcgcgctcggctttgaggccggcgatctgttcatcgagcgcttgcacccgcgagcgcaggtgatcggtcatctcgccaatgtcgaacgtcgaggtcaggcggtcaatctcgtcgagttcgagccctaggtcgcgcagcatgcagatcagacgcatgagcgggatctgcgtgggcgaatagaaacggtagcccttttcgttcaccacggcgggcttaaacagaccgatcttgtcgtagtaaatgagcgtttggcgcgaaacattgaacaagctcgccatctcgctaatcgcatacatgcccgtctgcatagatcctcccgacacatcctttgacgcgaaaagcccgccgcccacaggggcagcgggctcaaacactcctcgtatcctaccctaaagacgcctatgaccagcgcttatagtttgcacatgacacgccgacggcctcgagcgccttggcggcgatgtgatgcaccgcgtcatcgagcgtggcggggccgttgtaaaacgtgagcatgggcggcatgagcatgacgcccggtacgcgcgccaggcgcgccatgttgtcgacatgaatggcgctgaagggcgtctcgcgcaccatgagcaccaggcggcgctgctctttcatctgcacgtcggccgcacgcagcaacagattgtcgctgtagccgctcgcgatgccggcgagcgtcttcatggagcacggggccacgatcatgccgtcgaccggataggtgccgcttgcgatggcggcgccgatgttcttgttgtcgtagaccacatcggcatgcgtggcaaactcgtcgagcgtcatgccgagctcctgctcgatggtaatctctcccccgcgcgtgacgacaagcgccgactcggcaccggcctgacgcaggcatttgaggcactcaaggcccagcgcggcaccgctggcgccagacacgccaacgacaatgcgacggggacggacagaagactcaggcatgacaactccttaactacttggtagggctacttactagaaagcgagctctgctgcccacttatctgtatcgatttccatgaactgcgagcggatgaaattcttcttgaggccgaatggaaccgtgcagtcgaagatggccttgcaggcaatgccgtgctcgcggatcgaaggatcgaacgcggggtcgttggacgggtcgagcacgtggcagtggcagccggggatggtgatgaggtccacgtcggcctggaagcgcgtggtcatggcccacatcacgtcgctcatatcgaagatgtcgacatcctcgtcaacaaggatgacgtgcttgagctcggagaacgccgagaaggcaagcatggcggcgttgcgctgacggccctcgtcatttttgctcgacttcttgaactgcatgatggcaacgaacttgccgccgccgcagggagcggcgtggacgttgagcagacggcccgggatggcggtctcgaccatcttgtagatggaggcctcggtggggataccggccatggacacgtgctcgtgcgaaggaccgatgcagctctccataatggggttgacgcgcgtggtaacggcggtgatcttgatcaccgggcagaccttggcgccaccggtgtaaccggggaactcgggcatggcgtagccgtggccgttgacgtcctcgttgatggtctcgtcgtgcatgaggtagccctcgagcacgtactcggcattggcaatgcacttctgcggaacggtgacgcagtcggcaagctcgacggcgtggccgcgcagggcaccggtgatctgcagctcgttgaagccgagcggcgtggtaggagcctcgaagccgcagcacatgtacacggcggggtccaggccgatggagatggagatgggcatgtcctcgccgcgctggcagtactcgtcaaagaacgcgcccaggtgacggctacccggagtgatccacatggcgagcttgtccttgtcgacgcaggagaagcggtggatggtcacgtcggactgggagccgtcggggctcgtgccgtaggcgaggcccatggtgatgtaggggccgccgtcgacgggcgtgttggtgggagcggggacgatcttgcgcaggtcaaagccctcgtcggtcgccttgtacacgacctcctggcagtcgacatgcttgccctcggcgatctgctcgggcgcgatcaggttctcgaagcgcttgccgatttcgaggcccaggtgctcctcgtccaggtcgagcagggcggcaacgcgcttgcggctggcaagcatgccgatgcagaccttggcatcgtcaaagcccttgacgttgttgaagaccatcgccgggccctctttggtcgggcgcataacggtgccgccggcaccgacgtgacgatagacacccgagacctcggcgtccgggtcgacctgagtgtcggtctcgagcagctggcccggcatctcgcgcaaaaagtcgagcgcggagcgcaggtcgtggatctgggaagcatcggtagtggacatagcatgctcctttcgggagagtgcccgacggcggtgtgccgccgggcggggtaacgtaatggggccgcggcgctcatagatgggacgctcggccactcgcagttcgagcactcggctgcttacagcccaagcgctcgaccgcttacatcaggccaaagaggtggaaccaggcggcctcgaccagcacgacgataaagacgaccacagtgaggggaatgcccatgcgcatagcctctttggaggtgtagccgccggcgtccttgccttcgccgataaggatcggcaggttatggaacggcaggatgtagtggatgttgatggacgtgaagacgatgagcgccacggcgagcgggctcacgctggagccggccgcgaagctgatgaacgccggcacgcacacgccgagcacggccatgaccgagcccatgaacatatggataaccatggagagcgcggcgacaagcagggcgaacaggaagatgttctcgggcacggagctggggagcacgacatcggcgatccaggcgttcataccggtggcaccgcccacggaacccacggccatggcggccgtcaggaacatgagggacttgatgtcgacggcgttccagctggcgggggtgaggacctcgccgatgatgggcatggcgaggcagacgccgatggccagggtgacccagccgatgtaatcgcccgagacggtgagccacagcgcgatggcgatgacaagccacacgatggtgcgaatctccttgacggagagcttgccgagcgcggcctgcttggccacgatctgctcgcgatcgtagacgagctccttgctgggcttaaagaggaagaggcccaggaacagggtgcacagcagcgcgaccagcataggcacgctcatgtacaggaaccagtcgacaaaggacgggctcatgccgccggcctcggcgctgtactgcgcaacgagcgggttgagcgtggagtcgcctgtcaggaagaacatggagccgggggcagcagcggcaaacacaaggaagccgagcttgccgcggtcgtcgtcaccgtagccggcggactcggcgatgaccgagacaacggcgaggatgaggaaggcacgggggaacggatgcggaatgagtagcgacagcacaaaggtgagcgcgaaaatcgagatgatgagcgacttggcatcgcgcacgaacttgagcatgaacgcataggcgatacgctcgcccaggcccgactccttgaccgcgctggcgatgaggtaggcgccgatgacgagccacatggtggctttggtccaggagctaaacgtggaggcgactgtcgccgagatgctcgcggcgcccgtgtcgtccacgcacaccttgaacagaacgagcagcgcgcagtagagcaggcccacaaagcccggctgcgccacgccacatgcccagaacaccaccgtggcgagcgtcagtgccagacaggtctgaccgccgaccgtaagctcgaccgtcgagctcaactccgccaaaggaagaaacttcaccagcaaaaagacaacgatacccagcacaaagccaatttcgcgcttggtgatcttaaacgccttcttttccgcttccatctccccacctttcttgttgggggcgctccggattcgcagccacgttgccacttaaaaaggggcgcccgttatcggacaccccttacgttgcgctgtgttgcggcaatacagtcaagcgggatttttggatgagaagcgatcctctgggcaaaaaccgtcacaacattcgacgcttttcctcgatttcgagattttcatcgaatgttgtgacggtttggatgtggcaaagggactgtcttttgtttcacatagcgagatccgtacggatggatgggtcgctgagggcctcgcggagccagggggccagctgctcgggatgaccttgcagatagccattgagctcggagggcgccacgcggcgtacttccgagatttcctcttggttgatatgtagctcgcccggctcgacgcgagccagatagacctcgcaccattcgcactcgcagcggccgtcgccgtgatcctcgcggtagaccacgtgacccaagtgcttaagctggtcgggctcgcgcgtgatgccgagctcttcgttgatgcggcgcgccgtcgcggcggcgacgtcctccccggggagcgggtggccggcacagctatcggctagcaccccaccccacaggcgtttgagcgggctgcggcgacagagcagcaggcgcgcgtcctcgccctggtcctcgaccagaagcgtcaggaatgcttgatgcagaatgccctcgccggtatgggctttgatgcgatcgacaggagtgagcacctcgccggtcgcggcatcgaccgccacgacctcggcgcccgcaccgccctcgtcccagccggcacgcaatatgcgggctgcggtttcttcgagcgcggcgatgagctccttggtggtgttgagcacgcgctgcagatcgtccttgctcgcctgctcaacatgaaaacccgtgcttgcggtcaccggcacgccaaaacgcgtggccagtgccgctgcaatgtcgtgcgccgggatctcgtcgcgatggcacggaacggccaagatgctcatggtcgccgtgcgtccgggctcgggtcgcggaatggcctgcgccgtggcgcccagatgtgcaaactcgggcgagcaggcgtacaccaccatgcctcgcggcgtcaccgtcaactgagcctcgagcgtaaacttgccctcgcccactgcaacctttgtcgtgtgcattcccatgggatctcctgtcgcccgcgatgtacctgagaccatcttcgcctgtattgcgactatacaggcaagcgcagaatgtgacaaaggcgctgcttcttgtcgtattctgctagagttgcagagactgaatccagctcatataacgcaactatgggagcaaccgccttgaccactgcaacctcgtccacaacagcatcaaccgctgccgcgctttcacccgcgcgcaccaacctttgcctggcgctgctcgtgctgttgggattctcgctcggctgctccgagttcgtggtcatcggcatcgaaagcgatttggcaacggaactcggcatctcgcttgccaccgcgggccagctcatcagcgtgttcgcgctcgtctacgctatcgccacgccggtacttgcgctcagcacggggcgattccgccgctaccagctgctcgtgtgctacagcatcgtctttgtgctcggcaatctggtcatggcgttggcgcccaacttccaggtgctgttcgcctcgcgcatcatcttgggctccgtctcgggcgcactgctcgccgtgggcgtgacgtatatccccgagctgctgtccccgcagcagacctcactcgctatctcggtggtgtacggcgcattctccgtggcgatggtctttgtgacctcgatcggcaagtttgtggccgacacgctcaactggcacgttgccatgtacggcacgctgaccttcgccgttctgatctgcgccgcgctcgtgacgtttatgccgcgcgccggacaaaccgacgagcctgccaccttccgcgagcaggcggggcttctgcgcgagccaagcatcatcaccggcatgctcatcttcttgtttggcgtgggctcggtctatgtgttctacggctacgtgacgccctatctggagcaggtgctgggcatgggcaccgttcaggcgagcaccacccttatggcctacggcgtgttctgcctgatctcgaacatcctgggcggatggatcgatgcgcgctttggcatgaaggcgctgctcgtgacgtttgtgctccaggccgcggctctgtttgggctgtttgccgttggcggcaccatgcccctcgcgcttgcctttgtctttagtctggcgatgctcatgtatctgttctcggtctcgtgcatcacgcactttatggacgtggcccgcagccgccaccccaaatcgatggtgctcgcgagctcggtggagcccatggcgtttaacgtcggcatctcgtttggcaccgcggtgggcggcgccgtggtaagcgggattggcattgcctacgtgggcgcggttggcgccgcattctcgctcgtagcctggatactcacgctagtgacgatcaagctggcacgctgggagcgcaagcgggcagcacaatcttcgatgcaggcataggggtgggatcgaggcaggcgcaagtacagctcagcgcggcgggcgtccgatgaaaaccacaccatacgagcagtgtttatccgcccgcaggctccagcggttcaatttcgtgtacttgaaatacacgaaatcgtactaaactatgtatttgaaatacacgaaattggaaaggcggccccatgcgcagatcaatcgaatccgtcatcgaatcatgggcgacagaggacgcctcgcgccccctcctcatccgaggtgcgcgacgcgtaggcaaaacgtacgctgccgaggaaatcggcagacgaatcgccggcgatgcgtttgtcaaactcgactttcagaccgatcttgagctgattgccccgctgttcgactgccccaccgacgacgttgacaccatcgtggcacgaatctcagactataagcgcacccctatccgcaaggaaaccgccttcatcctgttcgatgaagtgcagctttgcgaacgagcgctcaactctttgcgcttcttctcaggttcgggctggcgcatatgtgcgaccggcagccagctcggcgtcgccacgcgcaagcgcaggttaccttttcccagcggcgttcgccaagagaccatgcaccccatgtcgttcgaggagtttctctgggcgcttgacgaggagcagatggccgatgccattcgcgcccacgccggaacgctcgagacctatgccgcgcaccaagcggcgctcaacctgtttcatcgataccagatcgtgggcggcatgcctgcagccgtcagtgcataccgtaagacgttgtccatcgaagatgcgcgcatcgagcagcgcgaaattgacgagacctataccgccgatatgaccgaccccgagaacgggatcagtggcgtggcggcgcgcaaggtctggcgttccattccgtcccagctgctgcgatcctcaaccaagaaattcaagtactctgaagttgagcgcgggggccgacgcgccaagcttatcgaacctctcgattggctcgagggcgccggcatcatatcggtcaacaacctgaccgaaggcatcgaacctcccctcgctcccttcgacgacgaagacggaagcttctttaaggtctatcttctcgatacaggcctcatgttctacaaactcggtatcaacccgcgactctggctcgacctcaaagaggattccgccattgcgctgtcttccgactttcgaggtgccctggcggagaactcggtcatgcaggcattttcgggcaatggtttgcagacgtattactggatgccaccgtcgtcttggaagacgaacggcgagctcgattttctacttcagaccgaccgtatggagatcgttcccgtcgaggtaaaatccgcacgcaacgtgcgcgcgagaaccctcgggtcgtttatggaaaaagcccggtcgccgtatgcctacatattgtccgagaacaattttgcccgcagcgaaaccgaggacgggtgcgagctgcgccacctccccttgtacgcagcgggctttatcggagcaaactgcctcaaggccagtctgtaaaccccgcgcaaccgccccgaaaggaaccatcacatgcaacgcattctttttatctgctatggcaatatctgtcgctcgacgatggctgagtcggtgtttgccgagctggtgcgccgtgccgggcgcgaggcagagttcgtcattgattccgccgcgacctcgaccgaggagattggcaaccctccgcatcatggcaccgtcgccaagctgcgcgaggtcgggattcccgtcgttgcccaccgcgcgcgccaggtgcgtcgcgcggagtatggcgactgggaccacattgtctatatggatgccgagaacgcgcgcggcctgcgtcgcatcttcggcgacgatcccgacggcaagatttcgcgcctgctcgattggaccgatcgacccggcgatgtggccgacccctggtacaccggcaactttgatgccacgtaccgtgatgtgcttgccggctgcacggccatgctcgagcaactgtagacgttcggtcgtcgcaggcgcacgagccacaccatcggcataaaacgagcgtggatttcccccgcatacaaattgagcgtggataatctcccactttgagcgcgaaacggcgctctaaacgggagattatccacgctcattatcttggcgggagaaaatccacgctcgattactcgtcgacgatctcggcgagccaaacgttgagggtatcgacctcggggcagcagaactttgccgtgccgggctcgttgccaggcacggtgccgccgtagcgcaggatgtcgatatagggaaagcccacgtggcaggccatggagcacatcttgccgcgatcgcggtcgaagtcgaagacgtcgcccggcttgtgcccatggtggcagcgacacgtacccagctggtccacgcagctaatgcgaatacgcgggcgcttgccacgcggcgcgccgagcggcttaccttcgcccgcgggcttggcgccgccctcgccggcgctactcatggtcaatcacatccaggcaggcctcgatgggcaggccggcagacttgtcctcttggtcggcgttgcgctcgataagctcggccactacgcgcatggcgtcggccgttgcgcgctgcagactccacccggccatcacgcgaccgacgagcaccgccgagaacgtatcgcccgtacccgggaagtaaaccgggatcaggtcgaagggaatcgtgaagtactcccccgccacgtggtcgtaaccgataacggcgttcgtgccgtcgaccacagcgctcgtaatgaccaccgacttggcgcccagcgtgcgcatggcgtccacaaggacgcgggcctcgtcgggcgtgatttgctctgcaataggcgtatcggtgagcagacaggcctcggtgtagttgggaaccgcgtagtcggcacactcgagcaggtgcctcatgaggccgatcgtggactcgggcacaccggcataaagcttgccgttgtcgcccatgatggggtcgacgaacaccttggtgcccttttgcgcgcgacggtggcagaaatccgaaatgatacgcgtctcttcctcggtcacgataaagccagtcgagatggcgtcgaactcaaagccgagttcctcccagatggcgaggctctgacgcacgtactccgtagtgtcgtggatgtagaacttggggtagttgagcgtatcggacacaagcgccgtcggcaggttgtggatacggtagcccatgtgcgacagcaccggcagcatggcagaaagcgcgaccttgccgtagccgcacatatcgttgatcagcagcagctgagtgttcttcatgagtgtcccccttgggtcgggagcggcgcaaagtcgccacagtgcgactaagtgtagcgcagggaacacagcagacgggtgccggcgccgtggagggcgaattgttgcggaaaggtttcggaaaatgatcccttttcctccgtccccaagggatcattggcacgagagcaatgctgcagatagaggacggacagcgaaaacgttcctaagcgagcaaggtggcgtgaaagaggagggcataggccttgtggccatgcccgacgattgaacgccagattgccgcttagggacgtttgcagcgtcgagtggttacggcgtttggtaaaacgccgtaaccaaataagtttggtaccttgacaattatttcttacgctcctagattagttaggcacaaaacaatcccactacctaactaaagaaaggagagatacgaattcatgtgcgatgaaccccttaaccttcgtccgcacgagcccggcggcgacccgtcgcagccggcagacgtgcccgaagcagttaacggcgaagacaggctcgccaaacgcatcctgagcggcctgggcttttgtggccactacatgcactttcacggcggcggcgtatccggcaaggcacccatcgtctgcctgctcgccaagcaggaaaacggcgaaatgtcgcagcaggagctcggcatgcacttcgacctcaagccggggtcgctttccgaaatcttgtccaagctcgagtgcgccggcatcatcgagcgcagccgtaaccccaaagatcgccggcagctcaccattcgcctgaccgagatcggctgggagaaggcccgcatcgaccaagcctcgcgcatccgctttagggagcaggcctttagcgccctcacccacgacgagcgcgagcagctcgccgagatgctcgagaaaatccgcgtaacctgggaggaactggatgattaaaacccttatgggcagcatccgcgattacaagaaggtcacgatcgccacgccgctgctcgtgcttggcgaggtaatctgcgagatgctgatcccgtttatcaccgccgacatgatcgacgccatcaaagacggcgccgccgttgccgagatgctgcctaccgccggttttctggtgatcatcgcgctgacgtcgctcgcttttggcgccgcggccggcatcacctgcagccatgccagctgcggctttgccaagaacctgcgccgcgacctgttctacaagatccagacgttcagctttgccaacatcgacgagttctcgagctcctcgctcgtcacccgcctcaccaccgacatcaacaacgtgcagcaggcctttatgatgctcatccgcatcgccgtgcgctcgccgctggtgctggtctttgcctttaccatggcctacgccatgggcggcagcgtcgctatggtctacctggtcattattccgctgctgggctttggcctgttcttcatcatctataaggtgcgcccgatctttgcccgcgtgttccacaagtacgacgcgctcaacgagtccgtcgaggaaaacgtcaccggcatgcgcgtggtcaagagctatgtgcgcgaagactttgagaaggagaagttcgccaccgccgcgcgcgacgtccagatggacttcacccgcgccgagaagctgctcgccttcaacaaccccatgatgaatatctgcgtcaacggcgcgtttgtcgtcatcatctacctgggctccaagctcatcatcacgagccagggcacgctgttcgacgtgggccagctctcctcgatctttacctatggcttccagatcctcatgagcctgatgcagctgtcgatgatctttgtcatggtgaccatggccgacgaatcggcgcaccgcattaccgaggtgctggccgccgagcccacgatcgccaatcccgccgagcccgtgctcgaggttgtcgacggttccatcgactttgaccacgtgagctttaagtattccgcgcatgcgaagcgccaggcgctcgacgatatcgacctgcacattaagagcggcgagaccatcggcatcatcggcggtaccggctcggccaagtccacgcttgtaaacctcatcgcccgtctgtacgacgccaccgaaggcaccgtgcgcgtgggcggcatggacgtgcgcgactacgagctggacgccctgcgccaccaagtggccatggtgctacagaaaaacgtgctgtttagcggcaccattgccgagaacctgcgctggggcgacccgaacgccaccgacgaggaagtccgcgaggcggcacatctggcctgcgccgatgagtttgtcgatggcttccccaagggctatgacacctggatcgagcagggcggctccaatgtttccggcggtcagaagcagcgcctgtgcattgcgcgtgccctgctgcgtcgccccaagatcttgatcctggacgactccaccagcgctgtcgacaccaagaccgacgccaagatccgcgcagggttggcaagctatctgcccaacacgaccaagctcatcatcgcccagcgcattagctccgtgcaggacgcagaccgcatcatcgtcatggagggcggccgtatcgcgcagatcggcaaccatgacgagctgctcaagacaagcgagatctaccgcgagacctttacctcgcaaaacaagatgtctgccgagggcgaaggagccgtcgaggccgacaccgaggcatccgcaccgcaagcccagacccaggaaggaggcgaggcacatgagtaaggccgctaccgccgagcgagcgcgcaaccgcaagggcggcaccatgacgcgcctgatcaagatgctctttggcttctatccggtgcttttgcccctcgtcgtcgccggcgtggtgctctgcgccgtcatcaactccatcggtgcgacgttcctccagagcgcgctgcaggtcattagcgaatcgtggcagtcgggcgactggacggccgcgcagcccaagattctgaagcttgtgactaccctcggctgcatctatgccgtgggcgtcgcctcctcgctcttctggaaccgcgccatggccgtcatcacgcagggctcgctcgagaagctgcgcgagaagatgttcaaccgcatgcaggacctgccaatccgctacttcgacacgcaccagcgcggcgacatcatgagccactacaccaacgacatcgacacgctgcgccagatgatcagccagtcgctgcccaacttgctcatgacgatcatcgtcatcgtcacggtgttcttcatcatgctgtactacagcgtgtggatgtgcctggtcatcatcgccggcgtcgcctttatgacctttatgaccaagctgctcggctccaactccgcgcgattctttatcgcgcagcagaccgaactcggcgtggtcgagggtcatatcgaggaagtcatgaacggccagaaagtcgtcaaggcgttctgccacgaggccgccgccgaggccgattttgacgagcgcaacgagaagctcttcgaggtctcgcagaaggccaacatgtacgccaacatcctcatgccgatcctcatgaacctgggcaacctgctctacgtgctggtcgcgctggccggcggcatcttcctggcgctgggcgtgcccaacctgagcatctcgggcatggcgctctccatcgccgtcgtggtgccgttcctcaacatgaccaagcagttctgtggccagatcggccagatctcgcagcagatcaacgccgtggtcatgggccttgccggcgccgagcgcatctttgagctgctcgacgaggagcccgaggccgacgagggctacgtgacgctcgtcaacgcccaggtgaaccccgaaacttggcagctcgaggaggccgaccaccacaccggcatgtgggcttggaagcacccgcaccgcgcgaccggcgagatcgagtacgtgccgctgcgcggcgacctggtcatggacaacgtggactttggctatacgcccgaccacgaggtgctgcacggcgtgtccgtgtacgccaagccgggccagaaggtcgcgtttgtcggcgccaccggcgccggtaagacgaccatcaccaacctcatcaaccgcttctacgacatcgcagacggcaagattcgctacgacggcatcaacgtcaacaagattcgcaagtccgacctgcgtcgctcgctgggcgtggtgctgcaggacgtgaacctgttcaccggcaccgtgatggacaacatccgctacggcaacctgagcgcgaccgacgaggagtgcatcgcggcggccaagctcgcgggcgcggacgactttatcacccgcctgcccgacggctacgacaccatgctcaccggcaacggcgcgcagctgtcgcagggccagcgccagctgatctcgatcgcccgcgctgccgtcgccgatccgccggcaatgattctggacgaggcaacgagctccatcgacacccgcaccgaggctatcgtgcaggcgggcatggataaactcatggaaggccgcacgacgtttgtcatcgcacaccgcctgtccaccgtgcgcaactccgacgcaatcatctgtctggaccacggccgcatcatcgagcgcggcaaccatgatgagctgattgccaagcgcgggtattactaccagctctataccggagcgtttgagctggagtaggaccgattactgacggagggcgccccggggacgggcggggtgtttcctccgtgctcaaacattctcgctgcgctgcgaaactgcgcgcggaggaaacaccccgcccgtccccggggcgccctcctgcgcgcaatcaacccgtcattaaaacagaataaaagttggtgaggccctggccgtttggccagggcctcgttttgtaaggatgatttgggaagtggtggaggaccagtctttttgggacggggctaaattagctgattctccatcccaatatcgatgaatcaacaaatcgcaactgatccctaatccaaaaccagctaatttagccccgtcccaaaaagactggtcaagctaacggaacgccgtagctaaaaatccccgtcccagaaaaatcattgcgcaggtaggacggcaaaggtagctagaaaagccccatcctaaatgagctacaagatttcggctaggagcgctcggcgcccgtttgttttatcactgcaggtagaaagcgcgatgatgcgtgcatcggggccaacgtcatccatgttctcgtgcaccgccgtctgcgagacatgcgtgagcagcgtctgcatcgaggcctggtccaggtttcccggcccaaagataatgtcatcactcgcagcaaacgagcacacggcaacaatgcgcaggcggaacgccccgtcctttgtgtagagcgtgcccgtgcggtgcaggtcaaagaagcccctgtctaaaaaccggtcgacatcgccaaacatcgcaccgttatccatgtggtgcgcatagagcagattgtaggaatcggtcatcgcgcgactgttgcgcgtatccaaaaacaccgctcccgaaaccgcggactcccccaacgcgtttttgttgaggtattcctggttatcttttccctgaacaaagggatagtcgatgttggtgccatcgatggtgacccatccgaccacgtcggaatttttggtcatcagttcctgcaggcgtgcgcaatcgttggccccggtgggtttgtagtgcagcagctcatcgctgatgaacccgccgttcataacattgtttgtatcccacagcgaatagcccccgtacagcagcatgagcagcacgagaaagccggcaaaccacgtaagtacgcggtcgccggctctcgccagccgagctatgcgtttaagctccatcggctgtaatcctcgctgttttaacggcggttacgacgaggacggaagaagaccacgcccatcacggcagcaaacgcgacgattgccgcatagggaacgaccgtccgaataacatcggtcggaacggtaacatccttggtattggtaaagatcaccgtggtgtcgtaagcaccgatagcttcctcggcaatagagctaccttctgtcgaattggtgccatcaccaatcttgtacgacgtcttataaccgtcgccatgataatccgcctcagttacggcgaatttatcctccgatgagagaccgtaaacgatgacggattccccatgcttaagcgtctcggtaaacgtagctcccggcttggttgtagtttggttcatggtagtaacaccgtttttcacagtgccatacttataagtctccccgtcagcgcctttaatcgtgacggtaaactcaaagtccttatttttatcgccctggttaccggctacgacctttgtgatggtcagcttatgggtgacatatttgttctcaaagcctgaggtcttgctgcccgatcccgccgctgtgctaagagtgcagcccttagcaactaagcctgagttgccattttctacgtaaacatccaggaacagttccttgtacacaacgttgaggccatccagctctggcgacgtctgcgtaattttgtatcgatagatgcccggagccgcgaaccttgaggtaacaaggctgacgctcatttgggcggttattgtcttagtaacgccgtcggcattatcttcgctagaaagaccttcgtcagaataatttacggaagacggcgaaagcgtgacggcaccggtcactccagcagaaacgggcatgttgttactcgtgctcgtaagctcactcgtctccgccggcgcaatcgaatagccgaactccgcattcggctccacggcgttcttattcatggtaagcgtcgaggtgattgtgaccttgttgtcatttaccggcagatgcggagtagtagagccctcctccgcccacgccggcgcagcaactcccaccaaagccagcagcatcgttgcggccacaactgcaaatgctgccagtcgcctctttccagttttcatgttgtatccttcctctcgggcatatgcccttaataaaaccaagctccgtgcctacaagttcgacctgcgcagcacgctgatcacgttgcccttgatctgcgaacgggcaatcggtccatacaggcgactgtcatgcccgccctcgcgcaaatctgccagcacaaagagctcatccgttcccagatgcacgggatagtccacagcagactcatagcgcggcgtcggcgtggtgatatcgctttccaccacaacagccccgttaaccatgagctcgcccgactcggtaatcgtgacctcatcaccggggcgggcaaccacgcgacccaggcgctcttcgccatccgcggtgtataccaccacgtcaccctcgttaaagctctggctgagcctccagtagagcatgacgtcacccgaacagatgcggggggccatctcgccagtcgtgaccggacccacgcccaggaccacgccaaagagcagccagagcgtcacgacaaaaaatgccaggcgcgccagaaagcccacgatatcgcgccggtcgtccgcttctcccagatctggtgccgcatgggcgcccaacctcacgttcgacgcggccgaataccgcgagccccggggtcttccctgcggggccgctcgtgcggctggcccatcaccagcattgctggcgccatgtcttctcataggcgcccacccctcttggagccgcggtgtaaacgcagcgcaaccatgaccgtagccaacagcacgccggcggccaaaatcgccagggcatagatggggttgcgcgtaatacccgtaggcaccgcgacctgtcgggaattggtggccttagcttcaacggcaacggtcacacgcggaccgttgagcgtgccgctcgcacccgtaagcctagcctgataccccaacgaagaataatcgtcttcgctcacggtatagaccgcgttgtaatccagcgccttaatcgaaacggtcaggccgtccttaacggcaaacggcacggtcgccttgccctggccatcggccgtaaaggccgtcttgttttccacggtctcggcccgatcattcggtcgcgccacgagcgcatggctgccttgggcagacgcatccgaatactcgatggcgtaggtctgaccagccttgaggcccgtaaaggtcgccgtcatcttaaagtaggcacgcttgtcgcccatattgcccgtaacgctcttggaaaccttgagcgtgtaggtgcgtggggtgaaccgtgcgtatacgcatcccgtatggcgctcttttacgttgtacgtataggtgggtgaagacgacagcagctccggggcgtccggatttgacaggtcgtaccagccctcaaagtgatagccctccttgggagtggccaccgcctccacaaacgtgccgtcatccacaaagtaggcgatacccgaagttttgtacgcgtcggcgtccttgcccgagcgatccccggcatcgatggagccctttgcccccttaagcttggagctgactgtgccgcccgtcgttacgttgctccacgtgccatcggcatttttaagctgagcaacaaaggcctgacgatacttccattgcgccacaaatgtcgcgccctggctctcaggaatgttttcgaccgttaccgtatcgcccgcagcgccggtatccggattgaccttattgccattaatggtaagagtgccggtatctgtagttccctcgggagccgcatgggtcactgtgtgctcggcaccaaaacgaatagcttttcccgagcccgcatactcccagcccataaacatccagccgtcgttttgtccttcggcagcatgggaggtatagctcgctccagcaccagaaagctgcacgaaatcgcccgtggaatcatcggacggattatagtgatacgctttgccgccgttcacatcgtattgaacgcccgccttagaaaacacaaggtgcactttgtagtgctttgtgaccttgtcgaccttaaagtgataggtgcaatcgtccaatatggtccaatgctcagcatcgtccgcggaatagaactcgccgttgacaaaagcaccgataaagactgccccgtcatcgcgcttggcatcgaccataaagtaggagttcttttcctgtttacctacgtagtttttggcataggtaaagtcggcggtcttggtatcggaattataaaaatacgttccgcttccgttgggcgtcgtgtacgtctcgatgcgatagaactccctaaacgagatattgtcgaggaagttgccgatcgaattgctcccgttggccgtgttgtaggccacaaaagcaaagacgctctggttttggccatccggaatggtgtaggtatagtcgtagtcaacctttttgttctgctcgagcgcgttggaaccgtaggaagcccaagcgtcgttttcggacgccatgatccacacgcaccatttttcggtatgttccgcatcggccgtccacgagaacgcgcttccgctggacgcattggcaaatccgcccactttgtcaaacttagtcgaatacaggatgatctttttgctgcagcccgattgggaaaaattggccacatccaagccgacatagttatcgacgctcatttgaatccattgaacaatttgctggtactgatcgagtgccttttgattgtccttgtacggctcgttttcttgtcgcggaccgatgataagggccatggcgtctcgacccgagcggccgcggtggtcgagcccccactcgtactgttttcccggctcggtcgtcacatattggtagagcgaactcgcctcgtgtgcgttgagctcggctgcatagtcaccatcggagggcgtaaacgtaacagaatgcccagctgggtcgatatagtagtcgttctgggcaacgatctcgatacgatggtctgtctcggtcgtacgccaatggggcgagcacaacgtaaacttgctgggcctctggttccctagatgtatatcctcttcaaagccgccgttagcaatgttcgtattctcgttcttaagattcgaggtcgagaacgcatagcgcgtgagcgttgtcatggtctcggacgagttttcctgatacaccttggcaaagtcgctatagatgttgcgcgtgccctgcttttccacgtgaacgtcgttgaccagattgccaaaccactcccggtattgttcgtttgcccccgtaagatttgaatcgtagcaagttagtgcaagcatcgtgttttcggacgctgcggcatagactgcctgataggcaaactcatcgtcttgctcgggaagcgctcgataatagtgtgtactgttggtgccaaaggagaaccaaccctgtccgttagagcttacgagccacacagaaagcgcaatgcgaccgtcgctctgctcaaacgagaagtgagatccgtcggcgctgctaccagcaaagccgccatttgcagcaaagggatcgctgtaaacggtgtactgctcaacggtatttccctggggcatcttgccctgcgccttaagccaagtccgcagctgcatgagctggtcttggcctgcgctgttaaccgacagattctcctgttgaggacccatcgtgagcatcagcacgtcgtgttcggttgcggcgcgatggttgaggccccactcgtacgtggagccgctctgggtggaaaaggtggtgtaggttgatccgggttcaaaataagcattggtatcctgtggcttaagattccacgcaagcgcaaagtgattaccgttagcttgtttgaggtttctttgaccgttgaggagcttcgtggggaggtcgaggtacgacgcctcgccgattctctttctcggagaggtcgtcgaccaaccagaagcttggttggtaaaggttgggttcgctataaggttgccatcgtcaccgtacgcacgcgagggcaaccccccccccgaccataacgaacgcgcataagaccgctgccaacatcacaaaggtgcggcgcatcgacgcaatatgaccgaaaggaccctgcacgggcgcatccccccccagccgcagcccgagcattcgagcaagctgcacaagtagttcgtttaggccttgtcattctacaaccagctcatggcaaaagcaaaatcatacgtgaccgatttggagtcatttttcgcacctcatttttcgcattgcgcaggtaggacggcaaaagtagccaaaaaagccccgcgccaaatgagctacttgaggagttgggccatggcgttgacgaatttttggacttggagggtaggctcgagcgggtagtgcaaatagactggcacctcgcggccgcacaggaacggcacgcctacaaaggccgggtgtacgcctgaccaagctccgcaggtgagcaccgcgtcgcccttttcctccgcctcgttaaaaagcgcaaagtcaaagctatccacgtcgatcacgtccacgccgccgtcggccaaaaggtcgatgcgcaggctgtccatggcgtcgttgccgtgacggagcacgcgcaggcgcatgccctccaggtcggcaactgtgatgcgcgtcttgcgcgcaagcgggctcgtgcgcggcacgtcgatataaaacggcacggtaacgatgcggagcttttggcaggcgtcgccccagcgcggggtcgaaaaactcgactgcaccacatccacctcgcgccccagactgcgcatgacggtctcgcgctcatcgtaaaggtcccccaccggcacaatctcaaaacgcaagcgcggctccatgtcgtgcacctgcggccacagcgcgagcgtttggcgccccgggcacatcatcgacacgcccaggcgcaccgcaccgccatcgcccggcgcgcgtcgggcacggcgcagggcatcctcggactggcgcatgatcgagcgcgcatcgtccaccaacagcgcgcccgccggcgtcaccttgacgcccgaatgcgagcgctcgaacagcgtaatgccaaactcggcctcgaatcccgatacctgcttgacgagtgccggggtcgacacgcgcaattttgccgcggcgcgcgagaagcttcccagctccgcggcggccgaaatagcctcaagtcgtcgatcgtacacgtcttctctccgttttcgcacgtacggccacacggtgccgcagggggtcgttttcgcaggtcacatgctcaatcaggtacaaatcgcatcatgcggtgtaaacctacagttaacgccattctaacaaatatgcaattcacctgcgcaaacgcaaagcatacgataaccagcgaaaaccacgtgggtcggttaatgggagcgacccactgggaggcacaagaagggaagttcctatgagcaattggcttaagctcgagggcgatgtctgcgccgtgactggcgcactcggcggtatgggcgccgagatctgccgcgagttcgcccgcaatggcgccaacgtcgtcatgctcgacctggacgaggagaaggtcaaggccgctgccgccgatctcgctgccgagtttggcatccacgccgagggttacaagatgaacgccaccgacgaggccgaggttcaggccgccgtcgatgccaccatcgccaacttcggccgcgtcgacgtcctcgtcaacaccgccggcatcctgcgcttcgccgccatggaggacctgccgctgagcgactgggagcaggtgctcagcgtcaacctcaccggctgcttcatcacctcgcagcgctttggtcgcgagatgatcaaggccggccagggtcgcctggtgcacatctccaccgtcgccagccactcccccgagacgttctcgggcgtgtacagctccaccaaggccggcgtcaacatgatgtccaagatgctcgccgccgagtggggcccgtacggcgtgcgctccaactgcgtcgagccctgcttcgtcaagacccccatgtcggccaacttctatgccgaccccgaggtcgagaagagccgcagccgcctgatcgccacgcgccgcatcggcgaggtcagcgatatcgccaacgccgtcatgttcctggcgtccaagcgctcggactttaccaccggcgacgccatcaaggtcgacggcggcttctccaacatgatgggcgacctcaccgccaagcccggcggccgtcgcgcatacgccgacaactaccttaagaacaagggtgtcgagctctggtccgatgagtccggcgtcgccaagccgaccgaccagtaaacctgcccggtagagagggacgcgggcaaacccctcccctccccgtatcgattagaaagagtccaatggcttccaccaactccaacaagggtcgcgccgtcgtgctttccgccgcgtgcgtcaccatgttcttcatcagctccatcgcgctgtattccgtcgtgagcaaaaacctgctcgccgtttaccccgagtggtccagcgcccttacctgggccttccccgtcttccagaccatcatggccgtgacgggcatcttcgccggccgcatctccgataagatcggcccccgcaacgtcgtgatcgccgccgccgtgtgctacggcgtgggctggttcatgtccggcaccgtcaccgagccgtggcagttctacctgtggttctcgctcgtcgccgccgtcggcaacggcctgggctacaacccggcgctcaccacgggtcagaagtggttcatcgacaagaagggtctcgcctccggcatcaccctcgctgcttcgaccgccggccccgccgtgctgtccccggtgctcgcctcgctgctcatcccgagccttggcatctttggcgcccttaaggcgctcggcgtcatcttctttgtgatgatcgccgcctccgccctgttcctgaaggcccccgaggccggttggctgcccgagggcttcgaggcccccaagggcggcgcgcacgccggtaccttcggcgacctcaccccgggcgagatggtcaagaccccgcgcttctgggtcctcatcatcaccttcgcctttgccgccaccgccggcaccctgctcgtcggcaaggttgcctccatcgccgccgtccagctcttcgccgaccccacgagcgccgctgccgtcgctctcggcggcgtggtcgtctccgtcaacacctgcgccaacctggtcggccgcctgtcctttggtcagatcatcgacaagctcggtgcctacaagtcgctgctcatcagccttgtcgtcaccatcgtcgcgctcgtcatcatgtcgatgagctttacgcagagcatgttcttcgtggcgctcgccctgctcggctttagctttggcgccctgctcgtcatctacccgccgctcaccggtggcgccttcggcaccagcaacatcggcgtcaactacggcatcatgttcctgggctacgccgcttccacctggatcagccagcccatcaccgccgtgctgtatcacgccgaggccggcagcgccgcctaccagcagtccttctacggcgccatcgtgatcgccgccatcgccgtcgtgctcaccgtctacatgatggtctccgacagcaagaagaagtccgcttagttttgcttgacgcggcaagggccgtcctcttgccgcattccaccagccaccagcattaaggagtcgaaatgtctgagctcaaccccgtccgcattgccgtcatcggcgccggcgccatgggccgcaaccacatccgctttgtcaccgaggagcccgaggccgagctcgtcgccatcgccgacgcctttgagggcgcccgcgccacggccgaggctgccggcgtgccgttctttaccgatcccgcccagatgatggacgaggtcaagcccgaggccgtcatcatcgccacccccaacgacctgcacttgggcgttgcccgcgaggccatcaagcgcaacatcgtgccgctggtcgaaaagccgatctccaacgacctcgaggatgcccaggccttcgccgccgaggccgagaccgccggcgtgcccgtgctcgtgggtcagcaccgtcgccacaaccccttcgtcaacaaggccaaggagatcatcgagtccggcgagctgggcaagctcaccgtgtcgagcttccactacatgatctataagaatgacgagtacttcgatgtcgagtggcgccgcaagaagggtgccggaccgatcttggtcaacctggttcacgacgtggacctgctccgctacctgctgggcgagcccgtcgccgtccagggcatgcagtccagcgccgcccgcggttttgagaccgaggactccgccgtggtcaacgtccgttttgccgatggcgcgcttgcgagcatgaccatctccgacgccaccgccagcccctggaactgggaggccaccgctcgcgaggatccgcagtaccgccccttcgacgccgacgcctactttatcggcggaaccttgggtgccctttcgctgccccgcctgcatcagttctcctacgacggcgcctccaactggcacaagccgctgcagatggagattccggccgtcgacccggcgctgccgcacaagatgcagctcaagcactttgtgaaggtcgtccgccgcgaagttgagcccgtcgtaacccccgccgataacgtcaagacgctcacgcttctcaacgccatcaaggaggccgccgagaccggccagctcgtcgagctgtaatgccttgagagcggccgcggcagaaaccccatgccgagtccctcggtccgccacaaataagcccctcttctttgccccgcgagcagcctcctgcccgcggggcattttgctacttcgctgacgatttttctggggcgggggctattttgcacctcggcttgattcgttcgccacgaaatgggcctatctactacgtttaaccgaccgccctcaaccatgccgaatttcctaaaatcaaaagcgcaggtagacggcttgcgcattctcggaaaaccgggggatggtcgacccatacggttcaaacgtagtagataggtcgttttcgtggcgcgggcccaaaacagtcttttgaaacgggtggtatccttggtagccctgtgctgcaaacgcaccttaaacgcaaggagtcccatggatcttatcgcccagctcgcccacgagctcaaccttaaggccgccaacatcgaggcagccgtcaagctcatcgacgagggcaacaccatcccctttatctcgcgctaccgcaaggaagccacaggcggaatggacgacgtcgccctgcgcgcactcgacgagcgcctgtcctacctgcgcaatcttgaacagcgcaaagaggacgtcattctgctcatcgacgcccagggcaaacttacgcccgagctcgaacagcaaattcgcgaggccacgcagctccagcgtgtcgaggacctctacaagccctaccgcaaaaagcgcatgacccgcgcccagaaggcccgcgaggccggcctggagccgctcgccaatatgatcatcatgcaggcatccgccaaggacagcgcgctcgacgccgccgcggcctacgtcaacgaggacgccggcttcgacacgcccgagaaggcactcgccggcgccgccgacatcgtggccgagacggtggccgaagatcccgagaacgtcgccgacctgcgcgcctttacgcaaaacaccgccgacatcgtcgtcgaggccaccgaccccgccgagaagaccccctacgagccctactacaactttgacgagccgctgcgccgcatccccaaccaccgcgtgctggccatcgaccgcggcgagcgcgagggcaagctccgcgtgcgcgtgaacgttgacggcgctgccgccacggcgcgcctcggcagccgctggccccgccgtcagggcgtcttcgcgcccgtcttcgacgctgccatcgccgacggctacaaacgcctgatggctccctcgctggagcgcgaggcccgcgccaagctcaccgtccgcgcccagaccgaagccatcaacgtctttgccaagaatctcgagggtctgctctcggcccgccccgtccgcggcgcccgcgtgctcgcgcttgacccgggctaccgcaccggctgcaaggtcgccgtcatggacgagaccggcaagctgctcgaccacggcgtggtctaccctaccaagccgcgccacgacgtcgccggcaccaagcgcgagctcgcccgcctcgtcaaaaaggatggcgtcaacaccatcgtcatcggcaacggcaccgccagccgtgagaccgaggaagtcgtctcggagttcattgccgagcaggcgcccggcttgcgctatacgatcgtgaacgaggccggcgcgtcggtgtactccgcctccgagctcgcaagccaggagtatcccgacctggacgtcaccgtgcgcggcgccatgagcctgggccgccgcctgcaagacccgctggccgagctcgtcaagattccgccccagtccatcggcgtgggccagtaccagcacgatcttgaccaggccgagctttcgcgcacgctgggccacgtggtggaggacgtcgtcaaccgcgttggcgtcgacgtgaacaccgcaagcgcgagcctgctgggatacgtgtcgggcatcacgccgagcgtggccaagaacatcgtggcttaccgcgaggaaaacggcgcctttaccgatcgccgccagcttaagaaggtccccaagctgggccccaaggcatacctcaacgccgcgggctttcttcgcatcagcggcggcaagaatccactcgacgccacaagcgtccaccccgaaagctacgaggtggcgacgtcggtcctggagcgcgccggcgtggcggccagcgagctcagccgcggcggcgtgcccgatatcgagcgccgcctgggcagcatctcggcgctggcaagcgacctggactgtggcaccctgacgctcatcgacatcgtcaacgagctcaagaagcccggccgcgacccacgcgacgacgcgcccgaggtggtctttagccgctcggcgctttccatcgacgacctggagcccggcatggaactcaagggcaccgtgcgcaacgtcgtcgactttggcgccttcgtcgacgtgggcgtgcaccaggacggcctcgtgcacatctccaagctggccaaccgcttcgtcaagcacccgagcgacgtggtgcgcgtcggcgacacggtgaaggtatgggtcgaaaaggtcgaccgcgaccgcaaaaagatctccctcaccatggtgcaggggaagtaacagaagggcgagccgccgccatccatcgccgaacttgcaagtttttctcacctgatgggaaaaacttgcaaactttgcaagttcttctcacgcgatgacaaaaacttgcaagtctgacagtcccgctatagcaaaacgccccgaccctcacgattgagagccagggcgatattcagttcgtgtcggcagccccggcctttcctttgcctagcgcgaccctcgcgaagcgcgtgagcgatagggaaaggaaaggccggggcggacagcccacggcacagtcagtgttcgcgttacggcaggatatggaagccgagcgaggcgatgtccttggcaaagccgcgcacggtgtcgagcgaaacctcgtacgggtcgcggccgatgttcttgcgcttggccaggatgctgttgggcaccgtgatgatctggcaaccgcaggcctcggcctggtaaatgttgatgagctcgcgcgtggacgcccacaggacctcgcagttgggcttggcggcggccttcttgaccgactccgtcataaacggaatggggtcgacgccggtatcggcgatacggccggcaaagagcgagatgatggacggcgtctcggcgtcaacggcctcgaccatctcgtcaacctgcgtaggcgtaaagatggtggtgacgttgaccttgatgccgtcggccgaaagtttgcgcaccagctcggcggtggactcacccttagcggtcacgcacggaatcttgacgtagacgttctcggcccaggtagcgatctcgcgtgcctcgacctccatggtctcgacgtcgtcggcaaagacctcaaacgacacggacacatcggtgatgtgggctaggacctccttggcaaacgcgcggtaatccgtcacgccgcccttcttcataagggacgggttggtcgtgaaaccctgaacgttgccgttctcgtacatgtcgagcatgccctcgaggtttgcaccgtcagcgaacaccttgattgccatctgcctgattcctttcgttagcatacggccgataaactgctaaacactttacctacgtttatcaaggcgtgaactgcggttttttatcttctcggcgaacggtataaacacctcagtgtttggattgataaatcgattgagcatgcaaaagcaaagagtcgcagtttgggcaaacgtcagaacgcgggattcattagatgaggccgaaatgctgcatcgctgtgacggtgccgtcgtgtgcgacgtcgtcggtcacgtagtcggcgactgccttgacctcgggcatggcgttacccatggcaacagccgtctcgacggcgacgagcatgcccaggtcgttgcccgagtcgccaaagccaaaggtgcgcgcgttacggctgcatcccagatactccagtgctcgcgccacgcccacgcccttgtcaatgcccttggggctcagctcgcggtttgcttgctgggctcgcttggaagatcggcggtaaacgcgtcccccagtcaatccggcaccgccgaggcaaaccccacacgcgcccgccggcaagcggcacgcgcccgccaacgcaaaggtccggcgggacgcacctagcatcccgccggaccgtcactcgtccaggaggtcgccgcgacgagcccctagatcttcgcaagctcctcggagatgacgcgacagacatcctcagcctgaggcatcacgccgtacatctcgaagaagccgtggtcgcagccgcgataacgaatcgcagtgacgtcaacgcccgcatcctgcagcctcttcgcgaacagctcgtcctgatagcgcagatagtcatactcggaagagatgatgaccgtgcgggggaacgcgctcacgtcctccgcgaacagcgcggaaatcagcgggtcgagcatcttgtccgcatcgccgttgacgtacatgggcggaaggtcgttgttggcgaggcgaatgcgatcaaccctgctcagcgcctcgggcctctgctcatccacgacctcgtacaggtcataggaccactcatccggaacgggaccgccatcaacgagcggataaagctcgacaaccgccttgattctatccgcgtgagagccctcgagcacgacggcattcgacaggctgccacccgcagagtcaccagccacggcaatgcgagtcgcatcaacgcccagctcgtcagcgtgatcgacaagccagtcgagcgtcttcacgcagtcctcgacgccacccgggaacatcgtctcgggagacaggcggtactccggatagatcgcgacgcaacccgtgcgctccacgatgtcgcgcaggcagttctcgtactgaccgatgttgcccaccatgaacccgccgccatggatgaacacgagcgcggcagacccatcctcgtgcccctccggcgtgaagatgtgcagcggaatgcccttgtcgccgaagttcatgacgacggtcttcttggcaacgttcgcgcccctcacgacgtgggtctccttgctgggcgcggagcgccacgcgatcacgtccaccggtccggccggcgccgaccccgccgcaggagccgcagcgagcttcgcgtgcgcacgagcatagacgcgcggatcgagcacgtgctcgcggtcgtcacccggcacgggcttcagcatcagcctcaggccgttaggctcgacaacctccctcgcgccactctcaagcacctcaagctcggaagtggggtacttcctatcctcggcgctcatggctagccgatcttcagctcgtcgagcctggcgtcgagcttggccatctcgtcggcggaaagctcccactcgaacgtctcgcagttctgaatcgcgtgggcgtccgtgcgcacgcccacgagagcggtgcccacgtactccttctgggtgctccagttcacggcaacctgcgccacgggtttgtcgtgggcctcggcgatctcgtccatgaccttgagcagctcctggacgcgcgagaacttgggctcccggaagtagtcgtagaagccaccgcggacgtcgccttcctcgaacttcgtcagctcgcggaacttgcccgacaggatgcccgcgccaagggagccataggtgaaggagtcgatgccacgctcgtaaccccacttgatgaggtcctcggaggagcggtcgaccatggaatagggcggctgctggacgtcgatctgagcgaccttctcgcactcctcgatcatctcggtcgtgaagttggagacgccgatgtggcgaatcttgccctgctccttgaggagctggagggcgcacatcgtctcggagaacggggtcttagcgtcgggccagtgcacgaagtagaagtcgatgtagtcggtgcggaggttacgcagcgagctctcgacctccctcatgatgttcttgaacgaggagtcgcggtcatagccggcggcgctggtgatcaggccaaccttggtcgagagcaggtagctctctctgtcgacgcccctgagcgcgttaccgacgaccttctcggacgtgccgttgccatagcacggcgcggtgtcgatgaggttgacgccgtgatcgagcatggtgcggatggcggacatgctggcggcgtcatcgttctcaccaaaggagtcgccgccgatcgcccaggtgcccacagcgagctgggagacgtcgacatcggaattcttgaggtgcgtgtagcgcatgttctctccttctaatggggcggcacgcgtcgaatgtcctcgatcgcgtgccgccgggaattgccttaaacaagcttcgaatgatccggaagccgccctacacgatgcccacgaggccgaggacgagcgccagaatcatgatgccaaccaggatgatgttgacgttcacgttcttcttgcgcaggagccagaggacgacgagcgtaagccccaggggcacgatgcccttgaagatcgagtcgaggtaggtctggatcatgacggggtcagagtcctgaaccggaatggacaggatcgtgttgaattggacgttcgccgcagtcatggcaccgatcatcacgaggccaaccgtggaggtcgccttggtgatgagcttcatgagaccaccctcgtacatctcggagatgaagttggtgcccatgctgaagccgaggtaggtcatgaagtatcggcagaggatcgacgggatgttgtagatcagcaggaacatgatcgcgccgaggggcgagccgctcatggcgaggttgatgccaatgccggcagcgatgacacgcaggacgccccagaagattgcgtcaccgatgccggacatcgggcccatcagggaaaccttgatgccgtcgatggactcggtgtcgaagtcttcgtgctgcgagttctccctctccatggaggcgacgaggcccatggcgaacgtgccgacgttctgggtaatgttgtaccaagtcgtgtgacgcttcatggcttcggcacgggcctcggggtcatcggcgtagtagcggttaagcgcgggctggacggagtacagccagccgtcggcgccagccttgacggaaccgccggcgcaggaggcgaacacggagaaagagcgcaggaaaatgctgttgagcatcttcttgtcttcagggctcacattcttggtcaggttgctcatgcgaagaaatcctcctcgtcgctggttacagagtcgttggaaacggcctgggtggccaagcccttcttggtgagatcgaaaatctccttgtcgcggagggcggaggcaaccgcgatgatgacgccgagaaccgcgatggcgatcatcgggaggccgaggtactggtagagcgtgaagcccaggaagaagtagatgctgagctcggtgctccacagcatctggagcaggagcgccataccaacggcgggcaggagggcgcccacggcgttgaggccgctcatgacattggccggaatctggttgacgatggcggcaacgggctcagcgccaaggtaaacgccgaggaaggcgatgaggccaaaggcggcgtacttaacgaaccagagaacgaagtgctgaagcgcgaggcccttctcgttgccctcggcggccatcttgtcaaaggtggcggcgaagaaagcgaggaacacgttgttcatgaagatcgagaggaacgcggtgacgacgccaacgggaacggccagcgtgatggcggcgccttggtcgatgccggcgccaacggtgaaggcgacggcgagggcggtcgcggtaacgggctcggcggagatggcgccaccgatgttaaccgcgcccatgaagattgcctcgagagaggcaccgatgatgacaccggtcttgacgtcgcccatcagaaggcccgcaacgaggccgaccacgagaggacgctcgatcatacactgaccgagaacccagttgccgccgtagcaaatcagcacggtcaaccaggccattactgctaacccaatcatttgacttcctttctctcatttcatttgaccgcctggccaaatccccttatttctccgccgcctcgatcagactcttgagaggagtcttgggattggacgggataagctgatggaaaaccggaataccctgctcgcaaagctccttcgcggcctcgagctcatccgggttgagcatgatcgtggagttgagggcgaccttgctatccggatcggacttgtcgaagcggccgacattggcaacgttcacgccctcgatcttgcccggtgcgcctttaacgagctcaagcacgtcacgcacgcagttggtgagcgcgaagatgcgcatggagtccgcacgcggatcgttcgcgatgcggcaagcatccggaacatccttgacgaggagcttctggcccgccggcgtacccatggaaagcgtcatgcgaagggcatcgctctccacggcgtgcttgttggcgacgatgatcctggtggtgttgagctccttggtccacaccagggcgacctgcccgtgaatcagacggtcatcgactcgaacctgaacaatcattgtttcctctccttacttattagtgctctctaatcgaagaagtctccgtcggacccctcgttgtccgcggccttgctcggaggctcgacgacctgcatcgtcgccctcgccagctcgacgctctgcttgatcgaatctgccgtgaccggctcagcgccgaggagcgcctcgatcacgaggccgaggttcataccggtaacatggacgatcccgcgcttctccggctccatgaggacgaccttctggaagacggagccaccgtagatgtcggtgaagatgatggcctcgtcctcagggcccaccgagtcaataaacgcctggatgcgaggggtgaaatcggagtcgtccacgtagcagtcaactgcttccaccatgtccgccataccggtcaggatctcgatcgagctcctgattccgcttgcgaggtgaccgtgcgacgcgacaagaactttcttcatcgagtctctcctagagcgaatagtggttggggttcagaagctggatcttgcttgcgacgaacgcgcgcatgtcgggggcggcgtccatcaggaggccaatgccgttgccgtcgttcttgccggagctgatgtccttctcgaaggcgcggtacatggagcggaagtactccgtggcgatgttgaacttgctcatgccgaggttcacggcctcctggagctgctcgtcggggatgtcggagcatccgtgcatgacgagggggacgctgacggcctccctgcaggccttgatgcgctccatgtcgaggttcgggaccttgacgtaggggccgtgggcgttgccgacggcgatggcgagcgaaccacagccggtgccctcgacgaactcctcggcgaggttcgggtcggtatagtggtcgctgttcacgaagtcgttggcgtcggagccgttgccgacgtggccgagctcggcctcgatgtcaacgtcgaagatcttggcgacctggacgacgtccttcgtgagctggaagttctcctcatagggaagcgaggagccgtcgaccatgacggaggggaaaccggccttgacgcccttgacggcgatctcgtaaccagcggagtgatcctggtggacggcgacgggcacgctcgcgcgctcggcgtaatagcgggcggcgaaggcgatgatgtcgagggcacagtggtcctcgaagccgggccagtactggatgatgataggcatgtgctcatcctcggcggcctggatcgaataacggatggtctccgtgttgatgacgttgatcgcgggcacgccatagtggtgctcggtcgcatgttgaagaagctcgttgaccttgatgagagacatctttgtcttcctttcacttggataaccattggattggacagttctcagctcgtcagctggttgaacacgaagagaagcgcgaagcaggcaggcgcttgcaaaacgcggtggagcctatgcggccgactggccctcaggctgtggcgctgcgcttcgacgccactgtacgtacgccacaaaagcaacgaccgcagcaatcgttgaagcgagggcgaaggccagaaaacccgcgtgcgtgccgagcgcgtcgcacgcccaaccgccaaacaggttcgcaaccacgacggacagaccgctctgaaccatcgcgaaggcgctctgacctcgagcgcgacaatcctcgtaagtgtggttggcaatgtaggtaacgcaggagtagtagacggtcatgtaactcacgctctgcagcagctggccgcagatcatgaccgggacgatgccggtgcccacgagcacgagcctgagcgccgccatgaagcaggaaaagatcaggaggttcatctcgccgaagcgcctgaccagcttggaggaaacgagcaggatggggatctcgctcgcagcggagaccgcactcaggacgcccacgaggttctgaccctcgccaagctcgaccgcgtagcggcccaagaacgccccgatgaagccaatcgcggccgaactgatgaaggcgaagaccaagacgaaggcgatctcattgctggtaaacagacactatgacccaatccgagggcacggaaacgacaggagcccccgctcgtggctgcgaggtcggctcgcgcagcatgaagtcgatgtatcgcgcatagtatgcccatcgctgctcgaggctggggtagaggtggtagaagccgtcgaaaaggctcttgactactttcgattgatgctcagtgcccattgtattcgctacgattaaactcggcacaggggatactggttttccgtgcgaaaacgctcatgccgctaaattgagcgaccgcctgtactgcagcgggatcatccgcccgagcgatcccttaatccgtcgcccgttgcgccaatcggcagaagccacgcgtggacgctaatcgctcgagcgaatcgtcgtcggtttccgtttaacgatttctttttccgctattatccgaccctcggacttcctcgtgatagaagtagtccacgatcaccggatgcccctgggggactctgccataaggcatttcgttgtccacaaaggggcaatcgtacttcttggccatttcctcggcttttacttcaagcgcttcaaaatagctacggttgcgcttgttatagatctcatcgtaaagcggtacgagattgggatgtttctcggcgatataatccaggatcgcttttttgaaaccaccccgaagattgagattttcgagccaaaacaaatcgcaccgatcttttactcgctcaaaaatcatctcaaaatccgtgatgccgggaaataccggggacacgaagcagaccgtacggataccttcgtcatacacctgcttcatagcagcgatacgacgctcgatgctcgacgcggagtccatatcgttcttgaagttctcatccagcgtgttgatcgaccatgaaatggtcactcgtccaagcctcttcagcagatcgatatcccgtaccacaagatcggactttgtgcagatcagaatatctgcatcgctgccaatcagctgctccaggagtttcctggtattcccgaatcgctcctcctgtggattgtagccatccgtcacagaaccgataaccacccgctgtccagcgtatttcttcggattcttgatttccggccaatgcttcacatcaagaaaggtgccccattcctccttgtgtccggtaaagcgcttcataaaggaggcatagcaatacttgcaggcatgcgtgcagcctacatagggattgaccgagtagccgcctaccggcaggctggacttggtcatgatgttctttgcttccacctcattgatgaggattccatcgatcacttccgccatgttctctgcacctccagcactctttcgaattcttccggcaattcctgaatcatgttttcgtcccctatgacagagacgaggtcttccttcataaacattggaatgccaagcgcgtgcgcctggtccgtcaaagaccatgcccactccggttccgtatgaaccttcctgctctgcgccccggtcatggtaccgacgacgatccagttgattccggaaaggtcgaccgtaccgggatcgtcgaatagcggctcaaaagtaacgaagaagtgatttgctttgacgtttttccgaagggcgtcgatacgccacagctccgctttcctcgtcaccgtaacgccgaaccatgcgttttccaggtcggtatctaaatccagcaaatcgggtctcttggtcaggaacaggaactgatgctgtggattctcatggatctttgcaaatacctcgtctcgccattccagcttccacccggagagatcgctcatgccggtaaggagaaagttctgcgggcgtttcttttccatcatcttgagcttgctcgggaagaacgcaggatcagcgaagtcgtcaatcatatgccaacgtttcacattgttacgggcatagcaatatggacaccccaccgtgcagccgatgacgatattcatattctgaatctgatttttgatgcagatgctcataacgcctgcctacctgcctctcccgtaaacacgcaatcagccttccccaccttgcgggcaaaagcctcgatatcttgcttgcaagcagcaggctcgcaatcgctcaaatcgtatgacgtgccgccgtttcgatagacggcccgatgggaaaacgatcggctgacaagcccgatgccgagcttctcgcacagggtcatccgtgctccctttcagctataaaaaacaggtgtctataaacagtatccttgttgattttcgcaggggcaatgaacaaacgcgtgcacctgtcgataaacgaacagctactggacattgtcaaacgactcagattggagaggcgatgggagaaaccaagatcgaccgccggcggcgctacaccctctcggtcatacaggaggcgttcttcgcgctgctggccgaggtcggcttcgcgaagatgacggtggcggacatctgccgccgcgccgagatcaaccggggaacgttctatctgcattgcgaggataagtacgcgctgctcgatgcgcttatcgacgaggcattggcagcggctcccccgcttgagggggttgaatcggcaacgctttgccagcgtccgtcggcagacgacgattatcgcctgctttattcggacagcgactcatacgctcgcgtagcccagcgcgtcatagaacgcggagcggagcagatggttccctgggtcatggagaaaacagggctttcacgcgaagacgccttcctgctcttcgtccacaacgtccagggcgatctggccgtcaaccgcctgctcggctggagacgaggccccgagttcgcccatgcccaggagctgctcaacgcctatcccgaagggggcttactggcggtatccgctcttcgcgattccgataacccatcgtgacctgcgattcaggaataccagcctccgagccctctcgttcggaggctgcggctaaaacctcattgcgcgtctaccgctccgcgttactcgccacctgcccgcgccaccgagagcagggcgcccaaatcggcctggatcgcccctgccttgcttccaagctgcagcggagccgagccgttcgagatgttgacgctcaacaggtgcgcatccgaagcacttaatgtgctttccgtcttgcgcaggactgtagagcagcaaacttaacccgcgccagccggccccggagaccctcccggacaggcccaaaaattttttcaaaaaagttgttgcgcaccggacagacttctgtgtatactaatccccgcagcgcacgcgagcggaaacaaacgcgaacgactgcctggggagttagctcagtttggttagagcgccggcctgtcacgtcggaggtcgcgggttcgagccccgtacttcccgccaacgcaattaaagccacgtcttcggacgtggctttttgcgtttaataggccactgtgtcggaatgatcactctgacgcttctttgatcggaatccccacgccctcgagggcgcaagtaaaagcaaataagtatatctgtttaaacaagaggtttgttgcgcaacacccgttcaacgagacagggggttaggttatactaaactgcactgtaggccgtatctgatgcatttcgctccaagcgcggcattcagtggatatccgatttaccatttggatgtcatagcggtcattggtgtctcgacacaagctcggccccggagctcgttcgagctgttcgtattccttgaaaggggaaaatggacatatcgaggaagactgattatgccctgcgcatgttggcgatgcttgccgaggagccggagcgtttgctttctgttcgcaccgctgccgaagaggtcaatgtgccgtattcgtttgctcgctcgatccagcacggcttggtccaggccggtattgtggagagcctgcgtggagtccacggcggtatgcgccttaaggtcagcccggacgacgttactatccgtcaggtcgtagaagccgttcagggccccatggttatgaacgattgcacggcccccgacggagactgtgcgcgtatgggcacgtgctgctatcatcccctgtgggccggagctcaggcgttgatgcgcgattacctcgattccgtttcgttgggcgatatcgtcgctcgccgccagttcccggccgtcgatcccaaattcgccgatcgcgatgcgtttcccgagtacgccacctgtacgtgcgcttgccgggaggaatagcgccgcataaggagcatagctatgattcaggacccctttcgttcgatgattcgtgcggaaggggtcctgcgttatcgcgaccttccgtggcgccgcacgcgcgacccctacatcatttggctctccgaggttatgttgcagcaaacgcaggtgccgcgcgtggagacgcgcatgcccacatggctcgatcgttttccgaccgtgcaggcgctcgcacaggccgcgccctcggatgttttggatgcctggcagggtatgggctacaaccgacgcgctctggcgcttcacagggccgctcagtgtgttgtggaagactggggtggggagtttccgcgtgagacgcgcgacctggtcgccctgcccggtattggccccgcgacggcgcagggcatccgatcgtttgcgttcgatcttccgggcgtgtacctagagaccaacgtacgaacggtctttctgcaccacttcttccccgatgtgccggctgttcccgatcgcgagctggtaccgctcattcaggctgcctgcccggcggctcccggcacggctgtggacgagattgccccctttgccgcgccgctcgacgatgccgacacgccgcgcgcgtggtattacgcgctgctggattacggcgcgtatcttaagaagacacttcccaatccgtccaggcgctcggctggctatagccgtcagtccaagtttgagggctcgcgccgccaaaagcgcgcccacatcgtgcgcatgctgctggcggcgcgcggtggacagccggcggggataacacttgccgaggccgtggcgggcgtcaacgaaatggaggcggcggcgggacgtaaaccggttgaatgcgaacttgtcgcgggtatccttgccgatctggagcgcgagggattttgtcgggttgagggcgatcgctggctgagcgtgtagtctacgcaaatctgaagaacaggattgtaaggtttaaattcgcggcttgagggcatcctaaagacaaggtcgctcaaagcctatgggcggcacgtgttgaagggaagtacacctatggattttgagaattcccaaaccaagaagaacctcgagaccgcttttgccggtgagtcccaggcacacaccaagtatcgctactacgcatctaaggccaagaaggatggctacgttcagatctcgaatatctttgccgagacggcgggcaacgagtccgagcacgccaagctgtggtttaagtatctgcacgacggcgccgttccgggcactctggacaacctgcgcgacgccgccgcgggcgagaactacgagtggaccacgatgtacgacgagttcgccaagaccgccgaggaggagggctttgccgagatcgccgagaagttccgtggcgtcgccgccgtcgagaaggcccacgaggagcgctacaacaaactcgtcgagcgcatcgagtcgggcgaggtgtttgagcgtgagggcgtaaaggtgtggaagtgcctgaactgcgggcacctgcacgttggtgctgaggcgcccgaggtgtgcccggtgtgtaaccaccccaaggcgtactttgaggagcaggtggtgaactactagcgcttggtgctggcatgagctgggccgggagggcgggattaccttccctccccgctcacggctccgcagggtcgcgttgagggaaggtaatcccgccctcccggcccgctttgggtcgtcgcgtgctcgctacagaaaagctgattagaagtttgtgtgccgccccttttgggcggcacgttttgtatagggattgggttgcggccatttggttgacggggcttgctccgggttggggcggcgccgttgtttagggggtacactgggtagcgacttttagtttatctactacctgatggggtgtttttatgggcaagaagtctcgagctcgggttgctgcggcgggaactcgcaaggatcctggtcatcgggttgccgagggtaaaaaggccgatcgtgccgagaaggacaagaaagtcggcgcgcatgctcatcctgagtgggcgcctcatttgaattcggctagtgaggatttgactgccaagttgtttactctggtcgaggtaattttgggcgtggtgccccttgtggttatcggtttattcttggcttcgaaggacgccacgagtgtcgataaactcaccgaggtcttttcgcaggacccctcgatggtggtctcgtttatttctgcgtgcttgcagccgtttgtggcgtacatgctgtatatggtctaccgcaaatactgcgagggtgatgcgggctttgccgccggtaacctgatcggtcttttgtgctccgagatcctactgctcaatatcccgggcgtcatcggtatgggcatcttgctgtggcgtgtttggcgcaacgtcgccccgcactttgagagctggttgtttgaacgccgtgcaatgggcgtgctggcagacatcgcgggctcgctcgtgattctagccttggcgtttatgtgcgccaccgccgcccgaggtctcgcaggcatgtagtctgtcctcaccgaccacggagcgcagggcggggaaacctttccctctcgctcacggcttcgcagggtcgcgcgaggcaaaggtttcccgccctgcgctccggcgttgagtcgtcgcgtgctcgttacagaaaagctgataataagtttgtgtgccgccctttggggcggcactttttgtgtggggtcccggtctccacaattttcgtcaagcttttggttagattttggtcagttggcgtaagggtggaaggccaaaagattgctggcgaaaaaagctcagagaaagtgctggtaggggagttgttgagcttttcgacagcttttgagcaaaagaaactttgtggctattgccggcgattgcgttgtcgcggtcatggcggtgcgggatgctggtcgtaagcgtcgaacgctccgattttggaggccaacatggacctgtttcttgagaccccacagcaacaagccgagcgtatgctgcggcagcagcggcggcttatagagatgcaaatgcaaggggttgccaaccaggcgcccgtgcaaaacgtcgtgcccgctgctgtacctgcagccgtgcccgggtgcgaatcggcaccagaggcctattccgtacagcaagattcatatgcgcaggagctcgcgttcgacaagcgtcgtgcgcgtcgtcgccgcgtgggccagcgcctgcgcacattggcgatgatcgtgctcattccgctaggacttgcggcaatcttcttggcctcatatgccctcacgtgcattctcaacggtgcctcgcccaatgaggtgctccagcatctagcggccctgggccagcgcctaggcgatgtcgtagcaaccattcgcgccggctgggagagttagcgtttgtcacgttaggacttctggggtgtagggattatcgccatgagtagaatcctcgcatcctgggaatcctgtcatgcgactgaatagtattattgatgatgaataataatagaaaatgccatgttaaggtacttaacgacatccttggaggatctggcgtcgtcgccttcggagcggagttatcaagagatggtctgtgcatacaggcaatacaaaaaggaggtgctcggttgaatctgacctttgagggattcttaaaaggctattgccgagagctatccggacagcagtcgctcagttttagaaaactggttaagcaagcgacgacggttgcgccgcgcgtggcggagcccctgtttttgctcgctttggcacagggtaaagccgaatacgttctgggcttatccgagggttcgtggatggaagagggttaccgaggcgttttgtccttgtacgcccaaacgggtagcctggcatctctatgcgccgaggacaaacttcctaatcgttatgccaacgtttggcgtgcgtatagagcggtgaaggaaaagccagtggcggacagaagaatcaacgccctgatgcgaaaaagaacgttgggagcgctagaggaatcgggtgtaacgcgctacggtctctgccgcgatttgaatctgaataagggaaacgtgtacgcatatttagccggtgatgactcaaaggtgagcagggagacggcgcgccgcattatggaatatgcggaggagaggggcgcccaagaaggggccgggcgcccggtgcgtatggcggggtaagattgatcgcggttttgattggtgctcgattgggtttgttgggcggagtttatgtctgctattgatattgtgcttgttgtgatcgccttggtggcggtgggggttgctgtggcttgcgccctccagctcaagagcctgcgtgccgagttgcgggagcgtggcgacagtagcgcggaaacgctggcagcactcgagcaggccaacaacgcgctcgatgccctgaacgtcgcgctggccgaaactcgccgcacggccaatgccatcgcgcagcagcagacgacagatgcggccgtggagcagcaacgttacctgaccatcgcacgtgagttttcgcaagctggtgaccggatggatgacctgcgccgcgagacggcccaacagctcggtgccaaccgcgagggtatcgagcatcgcctggacaaggtgcgcgaaacggtcgatgctcagctgggcgccatccgcaaagacaacaacgtgcagctcgatcaaatgcgtgcgacggtggacgagaagctctcccgcacgctcaacgaccgactgtcggcatcgtttaagcaggtgagcgaccagctcgaggccgtgtacaagggcctgggcgacatgcagtccatcgccaccggcgtgggcgaccttaagcgcgtgctgggcaacgtgaaggcgcgtggcattttgggcgaggtgcagctgggtgcaattctggcggacatccttacgcccgaccagtatctggaaaacgtcgccaccaagcccggcgcctcggagcgcgttgagtttgccgtcaagctgccggtggacgagggcgatcccgtgctgctgccgatcgactccaaattcccgggcgacgcgtacgagcacttgctcgacgcgcaggagtcgggcgatgcggagaccgtggcggctgcgcgcaagacgctcgacaccatggtcaagcgcgaggcaaaggatatttgcgaaaagtacctgagtgtgccggcaacgaccaactttggcatcatgttcgtgccgtttgaagggctgtacgccgaggtcgtcagccgctccgggcttatcgagaccctgggccgcgactatcacgtcaacgttgccggccccagcaccatggcggccattctcaacagcctgcagatgagctaccagacgtttaggctgcaaaaacgcaccgacgatgtactgcgagtgctctccgccgtcaaggccgagctgccgcgctatcaaaaggcgctgcgccgcgcccagcagcagatcgagaccgcgggtaaaacggtcgagggcattatcaccacgcgcaccaacgtcatggagcgcaaactcaaggatatcgacgcgctggaagacgccgaccaagccgatgagatcttgggactcacgcccgcgggcctttccacagaccaagaagacgaggactaattgcaacaaggcagcggggcaccggcgcaaacgcgggcaccccgctgcctttcacatcgcgcttgcctgaagtgcgctttagtgtgcaacaatggcgtttcgccctatcagacgcgaaaggaagcccatgtctcagagaaacaccagtccgctgaaacgctccaccgtgcgccgcacgctgcagcggttttggggtgtcacgcgcacgcagccgctgattgtctttctctcggtgttctcgtcggcgggctacatctttttgctgacgtttgccaatacctatgtgatggccctcattgtcgaccgcgttcaagccggtcccgtggcgggtgatcaggtgtttgaggtcttcggcccctatatcctggcgctcgtactcgttaacctggtgggccaaatcctctccaagctgcaggactacaccgtctacaagctcgagattgcgggcaactatcacctggcgcgcctgtgcttcgacacgctctccaatcaatccatgacatttcacaccagccgctttggcggatcgctcgtgagccagacgagccgttttatgagcggctacacgggtctggtcgacgtgacggtgtattcgctcgtccccaccatcacctcggtcatctgcacggtggcggcgctcgccccggtggtgccgacgtttaccgtgatcctggtgtgcatcatggccgtctacatcgcgtttgtctggcttatgtacaagcgcatcatgccgctttcggccgcgacgtccgccgcgcagaacaagctctcgggcgtgctctccgacgcggtcacgaacatcttggccgtcaagacctgcgggcgcgaggactttgaacgtgatctgttcgacgccgctgatcgtgccgcgcgcgatgccgagacggtctcgatgcacgccatgatgcagcgcaactttacgacctcgggtcttatcgtcatcaccatggccgtggtgagcgtattcgtggcgggcggcaacgcgtggtttggcatctcggccggctcgctcgtcatgatctttacctacacctataacctcaccatgcgcctgaactacgtaagctccatgatgcagcgcatcaaccgcgcgctcggcgatgcggccgagatgacgcgcgtgctggacgagccacgtttggtggcagatgacccggacgcccccgagctcaaagtgaccgagggcgcgattgattttgagcagctgagctttgcgtaccgtgacgctgcggcgggcgagagcgtgttcgatgacctgacacttcatgtggcggcgggccagcgcgtgggcctggtgggcaaatcgggctcgggcaagacgacgctcaccaagctgttgttgcgcctggacgatgtacagggcggccgcgtgctcgtggacggccaggacgtctcgcgctgcacgcagcagagcctgcgccgccaggttgcctacgtgccgcaggaggcgctgctgttccaccgctccattcgcgaaaacattgcctacggtcgtcccgacgccactgatgagcagattcgcgaggccgcgcgcctggccaacgccctggagtttatcgaccgcttgcctcgtggctttgacaccatggtgggcgagcgcggcgtcaagctctcgggcggccagcgtcagcgcgtggccatcgcccgtgccatcctaaccgacgcgccgattctagtgctcgacgaggcgacctctgctctcgacagcgagtccgaggcgctggtgcaggaggcgctcgaaaacctgatgcgtggacgcacctccattgtggtggcgcaccgcctgtccaccgtggcggcgctcgaccgcattgtggtgctggccgatggcgagatcgtcgaggacggcacgcatgcgcagctcgtcgaggcgggtggcgagtatgcgagcctgtggagccgtcagaccggcgcattcttggaggcgtaagcgtctcggacgtgggacaattgtgtccataagtttattgtgccgttgagccgaggagtcgttatgccacgcgagaccaatgccgccaaacgagagcgcgccgttgaggtgtgtgagcgcctcaaccgtcgctatggcccggtcgagtgctttttggaccacgagaatcccttccgcctgctgattgcggtgctgctctcggcgcaaacgaccgacgcgcaggtcaacaaggtgacgccgaagctgtttgcccagtggcccacgcccgaggccatggccggggcgagcgtggctgacgtggcgggcaccatcaagtcactcggcttctacaagagcaaagccaagcatgccgtcgaggccgcgcagatgatcgtcgccgactatggcggcgaggtgccggccgacatgaaggaactcgtgaagctgccgggcgtgggacgcaagacggcgaacatcgtgctcaacgtggggtatggcatcgtggagggcattgcggtggacacgcacgtcaaccgcattgcgcaccgcctgatgctgagtcccaagacgcatgccaaggagccgctcaagaccgagcaggatttgctcaagattttgccgcacgagtattgggagtcggtcaaccatcagtggatcaccttcggtcgcgagatctgtgatgcccgcaaacccaagtgtgacgagtgtccgctggcagatttgtgccccagcgtgcgcgtagcggggtagggcggaacgcattttcgtctggcgttttttgcggggctgggtttgcccttgagccggagtcctctccatgcgctaccatgacagacaatgtatttgacgtacgacccgccgagcttgccccggcgggcttttggcgttgcgatgccggaggaacagcatgctcattcaccgtatagccgcgcagctctacactgccgaggcgctgcagaccgtcgaggccggactcgatgccggcgaggacgtgacgctggccgtgtcgcagtcgggccgcacgcttatggcggccgcccagtttgcgcgccgtccgcgcccgacggtctacattgtgagtggcgaggatgcggccgatcgcgccgcgcgcagccttgccgcctacgtggggctggcgcacgtgtgccgttttcccgagcgcaaggactatccgtggcgcgagcaggcgcccgacgatgccgtggtggcgcagcgctgcgaggctctggggcgcatcgtgcgcggggacaactgcatcatggttgcctcggcccgcgcgctgctgcgctgcgtgccgccggtcgagagccgctattgggagtccacgacctttgcggtgggcgaggagattccttttgatgaggtgccgcagcgcctagtgggcatgggctacaccaatgccggcgccgccgacgcgcccggtctgtttcgcgtgcacggcgacaccgtcgaggtgtttcccgcgcaggaaaaagcgcccgtgcgcattgagttctttggcgacgagatcgatcgcatacgccgcatggtgagctccacggggcagaccatcggtaacgaggacagtatcgagatcttcccctgccgtgagctggcgcttaccgacgaggccgtccacaacatgcatgtggcgctctatcgcgccagccaggacgacagcaagctggccgcattgctcgagatggtggatgcgcgcatcgttacacccgagctcgaccgctttttgccggtaatgtacggccagaccgtgagcccgctggcgcacgtgagcggcaaggcgctcgtggtgctgtccgagccgcgctcgctgttcgacgattgcctgcgtgcctacgaggatatcgaggcgcgtgctggcgaggcagggattgaccggctggatggcctgtatgtacgtgcccagcagctcgattttggtgcccagcagcgcctgaactacgtgagcctgatccgtgccggcggcgcggtgacggcggagctcaagattgagcagccggccattgcgggctcggacaatcgctttatgacgcgcattcaggaagtcgtgggcaagcgctacgcctgcgtgtttgccattcccgaccgcggtgcgcgcgagtcgatggagctcacctttggcgacgagggcattacctttgaggagtcgctgaccgcggcgcccgaaaatgtcggcgctatcggcgaccgcgtgcgcgtggcagcggcggattctgccgatcgcaccgcccgccaggaggcccacgcttccattcgcgagcgcaaggccgatgcgctcaacgcccgctcgctcgaggcaggtgccgcccaggcagccgccggcgccgccgtgcctactatctcgcgcggacgcgtgacctttgtcgatgccgctctgccgcagggcgtggtggtgcccgatgccaacctggccgtgttctcgatcgccgacctcaatgcccgcatggatgccaaccgcgcgcgcagccgccgcaaggttgacattacgcagatcacgttcccgtttaagccgggcgactacgtggtgcatgccacccacggcatcgcgctctttagcgagattgcgcgccaggaagtgggcggcaaggaacgcgactactttttgctggaatatgccgacggtgacaagctctacgtgccgttggagcaggtcgaccgcatcacgcgatacgtcggtcctgacggcgacaagccgcgcctgaccaggctcaacaccgccgactggacgcgtgccaccaacaaggcgcgcaagaacgccaaaaagctggcgtttgacttggtcgatctgtatacgcgccgctcgtcgattaccggtatcgcctgcccgcccgacacgcccgagcagatcgagatggagcagagcttcccttacgacgagacgcgcgaccagctggaggccatcgccgacatcaaggccgacatggaggcgcccaagcccatggatcgcctgctgtgcggcgacgtgggtttcggcaagaccgaggttgccctgcgcgcggcgtttaagtgcgtggactccggccgccaagtcatggtgctctgccccacgaccattctggcccagcagcactacgagacgttctttgagcgctttgccccgtttggcctcgaggtcgaagtgctcagccgcttccgcaccccggcgcagcagaagcgcgcgctcaaggcgtttgccgagggcacgattgatgtgctcatcggcacgcatcgtctgctttcggccgatgtgaaccccaagaacctgggcctggtgatcattgacgaggagcagcgctttggcgtgcagcacaaggagcagctcaagaacctgcgcgagcagattgacgtgctcacgctttcggcaacgccgattccgcgaaccatgcagatggccacgagcggcgtgcgcgacatgagcctgatcacgacgccgccgaccgggcgccgccccgtaatcgtgcacgtgggagagtacgaccccgacgtggtgagcgcggcgattcgcctggaggtgggtcgcggcggtcaggtgtactacgtgtccaaccgcgtcaagaccatcgacgacgccgtggcgcgcgtgcacgaggccgcgcccgaggcgcgcgtgggcgtagcgcacggcaagatgagcccgcgcgaggtcgaggatgtgatgatcgagttcgcgaccaaaaagatcgacgtgctcatcgccacgaccatcgtggagagcggcatcgacaacgcgaccgccaacacgctcatcatcgaggactcgcagcgcctgggtctggcacagctctaccagctcaagggccgtgtgggccgctctgccacgcaggcctacgcgtactttatgttcccgggcgagctgccgctcaccgaggaggcgacggcgcgcctgaccgcactttccgagttccaggacctgggcagcggcatgcgcatcgccatgcgcgacctggagattcgcggtgccggctcgcttatgggagccgagcagcacggcaacctgtcgagcgtgggctttgacctgtttacgcagatgctgggccaggccgtggctgaggcgcgcggcgatgacgacgccggcgtggaggcggcgagcgtgggtattaacctgccggccgactacttcttgtccgaggagtacctgccggcggtggatcagcgcgtgctcgtgtaccgtaagctcgcagcggccgaggacctagagagcatcgatgaggtgcaggaggagaccgaggctgcgcatggcgagctgccgctggcgggactcaacctgttcaatcgcgcacgaatccgcattcgcggcgagcgcctggggctcgagagcgtcacgctcagtggcggccgcatcacgtttttgggcgttgacgtgcccaagaaggtggcctttgagcttaagacccgctatggcgcggtgaacttccccaagagccgcaagctgtcggtaccctacaaggcaggcgccggtgcgggcagcggcctgggtcgcggtctcgacgccaacgacggcaccggccccgtggccgcggcactcatgctgctgcaacaactgggtgccagcgacgacgactaacgggtcgacgctgcaaacgctccatttgggcaatctgaccctcactcgtcggtcgcgtacgcaagtacgcttccctcctccttcgggccaccttgccacaaatggaacgttttcgctcacttatgctcaacctgtaagggtatttatgggacaaagctatctttgccccaccacgttgcgggtcgacccttcgcccgaccgaaaggaaagcatgttcggatacatctataagaaagatgtcgccattatcgcggttgtcctgtgcctttgtctgggcgtgggcagtttcttcgattatcagatctcgagcgcgctgttcaacgtcggcagcatgtacggccgctttatcgaggccgccggcgagctgccgttcgagctgacggcgagcgtcgcgggcgttatgctcgtacgcgcggtgcgtcccgactccagggggagcaaatggctcgccgtgctgggcgttctgatcaacgttggcctggccggctacgagatcgtttcgtccctgcgggttagcggtaagctcattgccgttcagctggtgctgacgtttgtgctggtcatcgctgccaaccttatcatctatcgcctcacgcgcacgaccgagcccgatgagctcacgcgctgggcgttgatggtgcttgccgtgtgggtcgctcaggccattatcctcaacgtgatcgtcaagccgctgtggtcgcgcccgcgcatgcgcgtgatcgaggtgacgcaggggctcgagtttcagccgtggtgggtgatcggcaatcccgacaagtggacctatatcgccgccggcgtgatcaaggacgggttcaagtcgtttgcgagcggacacacggcgcatgcggcgatcggccttatgctcgccgggcttcccgcggcggcttttaaggaaaaaccttcgcgtcgccgcgtgatcttttgggcggcagctgtggtcgcggcgctcgtcgcgtttggccgcatcgtgatcggcgcacactttttgagcgacgtgagctgcggctttgccctggtgctggcgcttgagtgtctcgccgcgcgcattgcctatcccaacggcgtacaatagctccgtttgaatcatctggccgatacccggtaagagaggattgccatgctcgcgttcaacaacgattattcccacggcgcacacccggcagtgctgcaggcgctcgtcgacaccaatatggagccgcagcccggctacggtaccgatgcgcataccgagcgtgccaagcaacttattcgcgaggcctgccaggcgcctgacgccgacgtgtttttcctggtgggcggcacgcaggctaacgcgacggtgatcgacatgctgcttgcgccgtacgagggcgtcgttgctgccgagactggccacgtcgcttgccacgaggcgggcgccatcgagtttggcggccacaaggtgctcaccatccccggctacgagggcaagatgcacgccgaggacctcgagaactatatccaggtgttctacgaaaacgagagctacgagcacacggtgtttccgggtgccgtgtacgtgagcctatcgaccgagtacggcacgctgtactccaaggccgagctcgcggcgattcacgcagtgtgccagaagcgcgagattccgctgtttgtggatggcgcccgcctggcctatgcgctggcggccgatgagtgcgacattaccctgcccgagctggcgcagctgtgtgacgtgttctacatcggcggcaccaagtgtggtgcgctttgcggcgaggctgtggtgttctgtggcatgcacgccccggcgcatcctattccgcgcattaagcagcacggcgcgctgttggccaagggccgcctgacgggcgtccagtttgaggcgctctttaccgatggcctgtattttgagattggtcgccaggcgattgagaccgctcgggcgctgcgtcgtgtgctgcacgagcgcggctaccagttcttcttggagacgcccacgaaccagcagttcgtgattctgcccaacgaggatatggcccgcattcgcgagcatgcggcgatcgagtactgggaaaagtacgacgatactcatacggtggtgcgcttttgcaccagctgggccacgacgcaggaggatatcgacgcgttggcggctgtcctgtagcctgatgtaatgacaaggggccgccctacgcctgagcttggcgcagggcggcctttgcttttgggggagaagggttgtatgaccgagatgtccgagccgacgattcgcctggcgacgcccgatgatgcgccggagttgcttgccatttacgagccgtatgtgcgcgagacggcgattacctgcgaatacgaggtgccgagcgttgaggagttcgccgggcgcatcgagcgtacgctcaagcgctatccgtatttggtgatggagttggacgggcgtccggtaggctatgcctatgtgagtcagctcaacagccgcgaggcatacgactggtcggtcgagacgtcgatctacctggcacgcgatgtgcgccatggcgggctgggtcgcaaactgcacgacgcgctcaagcaatgcctggtcgcgatgggcatcaccaacatgtgcgcgctcattgccgtgccgcacgataaggacgacgagtatctgacgcacaacagtcaggatttccatgcccatatgggatatcgcctggtgggcgccttcgaccgctgcgcccaaaagttcggccgctggtacgacatgtgctggatggagctggtcctggctgagcgcacacccaaccaacccaaaccaacctggttccccgacctccccaaacctaccatttagggacaggtttattttggcaggttagccgatgggctcggtgtatttggcgcggtcggtgcgctggatgcgcttggagacgtggagcgggcggccgtcggtgtcgtagacgtagtcggtgatcaggatcagcgcctgcccgcgctcaacgttgagcaaaaacgcctcgttttgcgaggcgtagcacacctcaaaggtcttatgtccctgtgccggcgcgcgatggaactcctgtcgcagcgtggcgtagagcgaaccgttaatatcgcgatcgatgagcgtctcgaagcttggcggcaggtaggtggtctccaggcacagcggcgcgtcgtccaggtagcgcaggcggacaagtttgacgagcttgctgcccacggcggcgtcaaagaacttagctatgctgccggccgccttggcaaagcccgagtccacggtgcgcgtggtgggcttcatgccctggccttcgacctgcttggtatagctcgaaaacaccaggttgttctcgtggagcgcgggcgtgtcggccacaaaggcgccacgcccgcgctcggtgcgcaccaggccctcatcaacgagcaccttaagggcgtggcgcacggtgctgcgcgacagccccgattcgtccatgagctccatctcggacggcagcttgtctccgcgtgcgtaggtgccggtggcgatgcggtcgcgcagcatgcccgccaagcgctcgtattgggccagtttctttttagatgagacgctcatattgccaacctatatctaacttgtatgcctaactaagcaagcatgtattcaatacaagaacaaaactgctggtaacgaacaatcgaaaaccttaccagcaaaatttctaagacaaatatagcatacaactagtcgacataaccaaaacatgtatgtaacttgtatgccatcgagagcatcaaacgagaagaaaggctgatgcacgatgactactcaggaacaggttaaggatgtcgtctcccaggttttggctgacaaggcagacaagggcggtatcaagcgcgtcgtgtggattggcgccggcggatccaatggcggcaactaccctgctcaatactttatggagcacgaggccacgcaggtcgtgagctccagctacaccagcaacgaattcgtgcacgcaaccccggcctacgtcaacgagaacaccctggccgtcgtcgtgtccatgcgcggcaccaaggagaccatcgtcgccgcccaggtcgccaaggaccacggcgccagcaccatcgccatctatgttgacgagtccggcctcaccgaggtctgcgactacaagatccagtacgacagcttggccgtcgacgagtcctgcatgggccgcaccaactccgccgtcgtgaccatgatcgccatggagcttacgcagcagaccgagggctatgccgagcacgagaccgctatggccgcgttcgacttggtcgaccccatctatcgcaaggccgtcgagtacacccgtccgcttgctgccaagtgggccgagcagaacgccgacaagccctgcatcaacgtcatggctcagggtccgctctttggtgccgcctacgtctttagcatctgcaacgtgcaggagatgctgcagattgactcctgcaccatcaacacctgcgacttcttccacggtcccttcgagatcctggacaagcgtacctcgctgttccagctcatcagcgtcggccgcagccgctgcaacgacgagcgcggcatccgcttcgtcaaccagtacggtggcgagcgcgtctatcagcttgacgccaaggagctcggcctcaacgacatcaaggacagcgtgagcgagtacttcaaccacctgatctttgccccgatcctcaacaacgtgtatatgcgtgcactctctgccgttactcacaaggactacatgacgcgccgctacatgtggaagctggattattagttacggcgttttaccaaacgccgtaacggctcgacgctgcaaacccacctgagcggcaatctgcctttcagcttcagcggcatgaccagaaggtcaatgccgctgaagctgaaaggcaccttgctcgctcaggtgggttttcgctggcgttgccaaagcatcggcgtcgccttggcccagatgcggcacttggagacgttcgacacttggggacagtcctagtcattggggacaggttactttacaccaagttggcgcatatgaacctgacccccttgcaccaatgggttgtagcggtagagcagatttttccgctcgccgatttgtgtcttgaaaaatgtatataacgactataacgtagtatgaaacatattggaaacaataccgaggaggctgcgttgaagaaaagcaatctgggctatgtgctggtgctgatcgccgcgcttatgtggggcagcatcggaatctttgtaaacggcatctcggccatgggcgtttcgtctcagagcatggcggcctttcgcctgttgtcgggtgccgtcttaatggctccggtcttggcgttcatgggttgccagggaggcgatcgtgagggaaaagcatcgggtcccctggcactgttcaaggcaagtcctaaagagcttgttccctgtgcgcttcttggcattatcggcctcgccaccgctaacacgctttattacgagtgcatgggcgaggtgggcatgtccacggcctcggtgctgctctacacctcgccggtgtttggcgtcatgctcggccgcgtgctttatcgcgaggatgtgactcccaacaagctcgttgccatcgcttttaatatcggtggctgtgtacttgcagtgaccaatggcgacctttccggtttccatttttcggtttggggcgtcacgtcgggcgtgatcgcgggcttttgtggcgcgtcgctcgcggtgtttagccggatagcaaccaagacggtccacccgctggctgtcacgttttggggccttgtttttggcggtgcggttatggcggctatcgcggctccgtggccagatgtcgccgcggcaatgtcgccacagctgctgctgctgttctttggttttggactcatccctacagccgtggcctatgtcttatatatgcagggtctgtccatggggctcgagacgtcgaaagttcccgtcgtaatgtcattcgagacggtcgtcaccgtactggtgggcattggtgtctacgccgagcccgccggcgcgattaaagtcctgggcatcgtgctggtgctcgcgtccatcctgattatgaacaccgacttctccaagctgcgcaacagtgtgtttgtcggtcatgtcattgagagcatgacctttaagcccaacgcgtggtggaccgaaaaatctcaggacatggatctgtttaaggaacgcaccggcattgcgctggaacccaccgtacaggaaagcccctggtacttcgtgcgataggggattgcgcgcagggtctgacctggggttatccagctagcgccggcctacctagccaaacgtttcgagtacgttaaacccgtcaacggtcgattttcacccgcgaacggtctttatactaattagcaatataagcaacgtttaagacgttataatgaccataatgaaaaggaagaggcaagatgaatcagatcattctcgcatctcatggcggcctggccgcaggcgccaaagacacgctcgagatggttctcggcgacgtgtcgaacgtccacgtcgtgtcgcttgctcgcgacgacaaggagcccatcaccaacaaggtggacgccatgatcgccacgttcaacgcggacgacaccgtctatgtgctgaccgatatgctcggcagctcggtcaacaacagcatggtcgagctttccaagaacggcacgaagttcacggttgtcagcggtttcaacattccgctggcactgacgctcgctatgagccccgtccccgtcaagggcgccgagctcgcggccctcatcaacgaggcccgcaccggtctgaccaaccccaacgcaccggtcgaggctgccgcggctcccgccaagaaggctaaggcgccccgtcacagctccggtcccgccaagatcgtcctcgcacgtcttgactaccgtctgctgcacggccaggtcgtctttacctggaccaccaaggttcaggccgagcgcatcatcgtcgtcgacaacgctgccgccaacgatgacatcaagaagggtgctcttaagctggccaagccccagggcgtgcgcctgaacgtcttcaccgtcgagcgtgccctcgccaagatggacaagctcaacaccctcggcgagcgcgttatgttcgtctttggcaacactgccgagatgctgcagttctgccagggctacaagctcgacgccatcaacctgggcgccaccgccaaccacgacggtgccgatcaggtcggcggcaaggacagctccgtcttcctcgatgccacccagaaggccgatatcaaccagctgctcgacatgggcatcaagctctacgtccagcagacccccacgtatcagagcgtcgacatcgacgccaagctgtaatcaaccaggcttttgcctgactgaaaggagaagggtatgaatacgttcatcagtgcggtgctcgtcggcctcgtcggcgtgttctgcatgtgggactcccgcctgctcggtcgtcttaacttcgagcagcccctcgttggcgctacgctcgtcggtctgctgctgggcgatgtgcccaccggccttgccgtcggtgccgccgtcgagctcgtgtccatgggcctggtgcaagtcggcgccgccgttccgcccgatatggtcctgggcggcatcgtggccgctgcctttgcgtgcctgaccgatgcttccgccgagaccgccatgacgatcgccatcccggtcgccgtcctgggtcagctcctcggcatcgtgttccgttccatcatcgccgccctcacccatgtggcagataacgcgatcgataacggaaagttcaagaccgcctaccgtatgcacatctgcgccggctccggtctgtacgctctcatgtacttcctgccgatcttcctcgccgtctttgtcggcaccgacctggtccagaccatcgtcaacatggttcccgagtggctgtccactggtcttaacgtttcgaccaagatcatgaccgcctacggcttggccctgctgctcaccatgatgatcaagaagggtatgactccgttcctgttcatcggtttcctgctcgccgcttacctcaacctgtccgtcatcgcggtcgctctgatcggtgtgtgcctggctgtcgtcttcatgggcttcaagttcaacggttcccatgcagccgccggtgtcgattccgactacgatccgctcgaagacgacgaagactaaggaggaacacactatggcaaccgcaaccaaggacgtgtccctgaacaagaaggtcagccagttcttctggcgctcctgggccatccaggcctcttggaactacgagcgtcagatgaacatgggcttcctctacggcatggttcccacgctcgaccgcctctatcccgacgagtctgaccccaagcagctcgaggccaagaaagaggcttaccaccgtcacatggcgttctacaactgcaccccgcagacgagcgctttcatcctgggcctcgccgcctccatggaggaggagtacgccaaggatcccgagaacttcgatcccgattcgatcaacgcggtcaagacctccctcatgggtccgctttccggcatcggtgactccttcttccagggcaccatccgcgttatcgcctttggtctgggcgttcagctggctcagcagggctccatcatgggcccgatcctggccatgctcatctccgtcgtccccgctgtgctgatcacttggttcgcagccaagatgggctatcagggcggccacgagtacctgagcaagcttcagggcggcgacctcatggagaagctcatgtatgtctgcggcatcgtgggtcttatgtccgtgggcggcatgatcgccacgctgatcggcgccaccaccccgctgcagttcgctgacggcaccgttgtgatccaggacatcctggacggcatgatgccccagatgatctcccttggcctcaccggccttatgtactggctcatcaagaagaacgtcaacaccggttggcttctcgtgatcgccatcgtgggcggcatcgccctctccgcggccggcatcctggcctagtcgcgaccaagcgtccaaccgctttcccccggggcctgcctggcatcccataccccaggcaggcttccatccctatacgtgacaaagggcagtccctttgtcacatcctcaacgggccggcgactcggtccaaatcacggtaaccctgcgtgcgcccggcaatgtggcgccgcaaaaatcgaaaggaatgtgtcagatgtacgagatcgaccttaacctccctaagcagatcgtcgctgacgtcctgtccaaccacgagatccacagcgtcgccttcgtcggctgcggcgcttccatgtccgacctgtaccccgccaagtacttcctggccaacaacacggacaagctgaacgttcagatcttcactgctaacgagttcaactacgacacgccctcctgggtcaacgagcacaccttcgtgatcacctgctccctcggtggctccacgcccgagaccgtcgaggccaacaagaccgccaagaagcacaactgcccggtcgtctccctcaccaacaaggctggctccgctctgaccgtcgacgccgaccacgtcatcgtccacggcttccacgccaactacgctgccaagtgcgagaagcccggctacgccatcgctcttgctctcgagatccttcagcagaccgagggttatgaccactacgaggacatgatcaccggcctcaccaacatcttcgatctctgcgagaacgccgctcagcactgcaagaagctcgccaagaagttcgccgaggacttcaaggacgacaagatgatctacttcatggcttccggtgcctccgagaagatggcttattctcacgccgccttcctgttcaccgagatgcagtggatcgacgccgccgcctacaacaccggcgagtacttccacggcccgttcgaggtttccaccgagggtaagccctacgtcttcttcatgtccgatggcgccacccgtccgatggacgcccgcgccctcaccttccttgagcgcatgggcgccaaggtcgctctgatcgactccaaggactacggcctggctgacgccgtgcccgcgagcgtcatcacctacttcaacccgctgctgcacctcgccgttatgcgcgagtacggcaaccagatcgccgaggcccgtcagcacccgctgaccatgcgtcgctacatgtggaagctttcctactaatcacaagtaagtagaccttacgggttgattgagaggggatggggtttgcgccccgtccccttttttgctctggggagggcgtatccgtcgcgccacaaaaccccagataaaacccaccaaaataaacctgtccctttttggcaggtgggaggagatgcgtatgatcaaagcagtgctgtttgacatggacggcgtgctggtcgataccgagtggttctacaaccgtcgtcgcgtggcgtttatggaggagaaggggttccactttgacgagatccccgatctttcggggtctaacgagccggccatttgggaggcgctggtgcccgacgatgttgagctgcgcgagcgtctgcgcgtggagtacaagcaggtctatagcccggaccatcccgttccgtatgccgagctgctcaacgagcagacggagccggtgatgcgcgtactgcacgagcgcggcgtgaagtgtgccatcgcgagctcgtcctatcgcgagttgatcgacgagctggtggagattgccggtatccccgacgtgctggactacaccatcagcggtcacgagtgcagtgcgtttaagcccgaccccgagatctacctgcgtgccatggaggcactgggggtggagcctgccgagtgcctggttatcgaggattcgcctttgggcatcgaggctggtaagcgctccggcgcccgcgtcctggcgctgcgtccgcacgagggtgtcaacctcgatcaatcgcgagccgatgccgttatcgataatctgaccgacattttggccgctttgtagcgtcaatccgccgcgagaagcactgattcacgcgtcttttgctgcggattggcttaatttgtcatctatttggatccgtttggcttcgattcggactaagtgagtagactttttggtgcaagacgagcacaaagcgcatctgctctagtaaaaccgcaggtcacaggggtggcggttttgggtgtgctctgcaggtcgcgtaaagtctactcacttgttatttgggcctttggtcgtggggttgctggtcccgctttggttgtcgagggagggtgaattgaagcgcccccgcatgctccgtgctacaatcgccgacatgcctcacaaccagatttgccttcgaaaggagcccgcgtggcgaacgccatcgatcagctcacggaccgcgtgctcgtgctcggccgccttaccatcgtccgccgcgccattactgccgtggcggtcacgatttccgccgttctccagacattcctgatccaggcgttcattcagcccgccgacctgcttccgagcggtcttaccggcgttgcggtcctgctcgatcgcgttacctcgctgggtggcgttcacatcgatatttcgctcggtatgctcgcgctcaacatccccgtggcgctcctatgctggagcggcattagcaagcgcttcgtcatcttctcgatgatgcaggtcgtgctctcgtcgctgttcctcaacgtctttcacttcgctccatttttgggcgacaagatcatgctcatcatttttggcggcgtggtctcgggtctgggcgctgccatcgcacttaaatccggcgcatccaccggcggcaccgactttatcgcgctgtgggtttccaaccacacgggcaagaccatctggggcgtcatctttggtttcaactgctttatcctggcgatctttggctttatgtttggctgggacaaggcggcgtattccatcgtgttccagtttatttcgaccaagaccatcgacagtttctatcgtcgctacgatcgcgtgacgctgcagatcacgacgcgtaaggcagacgaggtcatgactgcctacgtaaaccattttcagcacggcattagctgcgccgaggtcgtcggcggatatagccgcgaaaagatgtacctgctgaacaccgttgtctcgacctacgagagtcaggacattatcaagctggtgtgcgacgttgatcccggcgccgtgatcaatgtgttccacacgctcaactttgtgggcggctggtggggtggtcatgtcgacgagcccatgcccacggccgttcccgatcccgacaagcccgcacgcatggccagcaggcaggcgcgcctcagcgaacaggacagtctgcagcaggacgacggcaagtagggtattggcattttgccggtcctgcgcaacccatccgaacgagcccccccgaaagccccgttgctttcgagaggctctcgtttgcccagataaaacttaccaaaatgaagctgtcgctttttggtagggagggtgtatcgttttatcattatgaggtaatatgaaactagacgttatatacgtattagttatttcgatatttcgataagagtgattagatatgcctgcgcccaaaaatgcaccgctttaccagcagatttacgacgaaatcaaggatgcgatcgagaaaggtgtttatgcacccaaggagcgtattccgtccgagcttgagctagccgagcagtacgacgtgagccgcattacggtgcgccgcgccgtcgaggagctgtgctccgatggctacctggttaagcagcagggccgtggcacctttgtctccacgccgcacatcaaccgccagttccacgcttcgacgctgcagacgtttaccgcgctgtgtgccgataatggcatgaaggcgggcgcacatgtggtcgatcgccagattgtgccggcacgtcaaaacgagatggagttctttggcctgcagaaggacgcgctgctgctgcatattaagcgcgtgcgtacagccgacggcgagcccatctttgaggagaacatctttgtgccgtttgacgcctaccgtgagctgttgacggccgatcttgaggacaagtcgatttttgccgaggtcgagcgtgttggcggaacgccgattgtctcggttgactaccgcacggtcgaggccgttcgtgccaataccgagcaggcggccgagctgggcattgctccgcacgatccgctgctcaacctgcgtgccggcttcacgggccccaatggcgagccggtcctgatgggtaagcagtactacgtgggatcgcgctacgttatggtcatgtaagttacgcggttttaccaaaccgcgtaacggctcgacgctgcaagcccgccagagcggcaatctgcctttcaacttcggcggcatgacaagcacttaatgtgctttccgtcttgcgcaggactgtagagcagcaaacttaaccgccccgcccggcaggcgagcgcagggatacgacatctgtccaataattcgtccgaaacacaatgaaaaaccgtttgatgtgagttaatataaacaacgtcgtgaatctgactcctgccgcatgcatgacaggggttaaacacaaaaaaggagtcaattatggtttctgagaaggctaccctcgttaatcctcagggtctgcacatgcgtccggctggtctgtttgcctccaccatgggcaagtacgcctgtgacgtgacggtcgtcacccccgagaaggaggtcaacggtaagtccccgatggccctcatggctgctggtatcccctgtggtaccgaggtcgaggtcaagtgcgacggcgctgacgaggccgaggctctggctgctgccatcgagctcatcaagagcggtcttggcgagtagaactcaaacgggtcgcatgttgaacaattaagttcatatttgggggcgcagtgacctgttaagggtaactgcgctcttttgtcatggatatggcaaaacgctttatcacatgacacggagagaggaatgggaatgtatcagggagtcaacgcatccgagggcatcggtatcggcaccgtcatggtcgccgtcgatcccgacttgacgtttgaaccgcatgaggtcgctgattcggcagccgagaaggagcgctatcagaccgctctttcggtcttctgcgagaagacccaggctcaggctgaccatatgaaggagacggtgggcgaggccgaggccgagatcatgagcggacacattgtcctggctcaggacccgggcatgaccgatgccatcaacgccgccattgacggcggcacctgcgccgagcaggcgctcatggacacctcgaccatgttcgagaacatgttcctgtccatggacgacgagatgttccgtctgcgcgcggccgacatcgccgacatccgcaccggtattctggccgagctgctgggcaaggaggtcgtcgacctctccgtcctgcctgagaacaccgtcgttgtcgtgcacgacctcacgccgtccatgaccgccacgatcgataaggcccacgttgccggtatcgtcaccgagaccggtggccgcacgtcgcactccgcgattattgcgcgcgcccttgagattccggctgtcctttcggtttccaacagctgcaccgcgctgcgcaacggtatgaccgttgtcgtcgacggcggcaagggtatcgttgaggccgatcccgacgaggagacgctcgctgcctacaccgccaaggccgaggccttcgctgccgagaaggcagccctcgaggccttccgtggcaagccgtccgtgactgccgatggtatcaagaagatcatcgcctgcaacatcggtaaccccgatgacgtgcccaacgcgctcgatcacgacgccgaggccatcggtctgttccgctccgagttcctgttcatggactctgctgagcttccttccgaggaggagcagttcaacgcctaccgtaaggtcgccagcgcgctcaagggcgctccggtcatcatccgcacgctcgatgtgggtggcgacaaggagattccgtatctgcacatggtcaaggaagacaaccccttcatgggcttccgcgccgtgcgttactgcctggccaatcccgaccagtacaaggtccagctccgcgctctgctgcgcgccagcgccttcggtgacgtcaagatcatgatcccgctcgtcacctgcgtcgaggaggtcttggctgtcaaggagctcgtcgagcagtgcaaggccgagctgaccgaagagggtcgcaagttcaacgagaacatcgaggtcggcatcatggtcgagacgcctgccgcgtctctcctcgctgaccgcctggccgaggtcgccgacttcttctccatcggcaccaacgacctgatcggctacaccatgtgcgccgaccgtggtaacgacaccatctccaacctgtaccaggtttactatcccgccgtgctccgttcgctcaagaacatcatcgagagcggcgtgaaggccggcatcatggtcggtatgtgcggcgaggccgctgccgatccgctgctcgagccgctgctgatcagctggggcctggaggagttctcgatgagcgctccgtcgatcctgcgcgcccgcaagaccatcagccagtggaccaaggccgagtgcgacgagctcgccgagaaggcgctcgcctgcaacaccgccgccgaggtcaaggcactgctcgagtccgcagctcgctaatttggtatcagaggtaaccgcgtggttggaatgggccggccacgcggccctcacatatacagggggtactgtaaatgttctacacgctaaccgctaacccggctgtcgacatgacggtttcgagctctccgctcgagcccgacgagaacgtccgcaccggctcggccagctacacggctaacggcaagggcctcgacgtgtccttcgcctttaagaagatgggcgtcgacaccgtcgcgctcggcttcttcgctggcttcacgggcaagttcatcgtcgaggaggtcatgaacctgggttgcctctgccgcccggtctggaccgacggtatcacgcgcattaacacctacgtcaacgatggccagcacgagtacggcatcctgaaccctggtgctccgatcacgccgcagcaccaggaggagctctacaacatcctggacaccgcgggcgatctcgagtgcctgatcgtttccggctccgtgcctcccaaagctacgcccgacttcctggctcaggtcatggagcacgctcaggctcgtggcgccgacgtcgtcctggacctgtcctccgacaagctcaaggagctcgctcacaagaagccgctgctcatcaagccgaaccatcacgagatgaaggccatcttcggcgtgccggtcgacaccgacgacgaggtccgcgtcgccatgaagatggctcacgacgctggcgttcagaacgtgctgctcacccgtggtagccgcggcgacgcttacttctccaacggcgaggacatctggtacgccaagcgtgagttcaacatcaagctggtttcttccgtctgcgccggcgactgcaccctcgctgctttcctgcacaagtggtacagggatcgcgacaacgtcgaggaggccatgaagctcgctatggccaccggcgccaacgttgccgagtccgtcggcatcggcgactttggtcacgtcgacgagtacagcaagcgcgttgctgtccgcaagctcgatcgtcagtaatcgaaacgcgacatattcgtgcgcatgcggcgccccggtttcggccggggcgccttttttgttccgccatgggggagaggtgtcctgccgtacttcatcgcttccacaccgttcaccgagttgtcctagccttttaccgatgcgtggaatatactttcattaacacgttgcttcgtgaaaggaacattcatgatttacacgctcactgcaaatcccgctattgactacaacatcgcctgcgacggtcttgctgccaacaccgtcacgcgtacccgcaacgccgtctacacgcccaacggcaagggcctaaacgtctcgtttacgctcgatcactacggcgtcgacaccacgatcctgggctttttcgccggtttctcgggcgagtttatcgttaagggcgccgaggccctgggcgtgcccgtcaaacccgtgtggaccgacggcattacgcgcgtcaatgtgttcctcaacgccggccccgacaccgagtacaacatggtcaacgccggtgccgctatcaacgaggccaacgagcaggagatgtttgagctcatcgattcgctcgatgacatgacctgcctggtcatcagcggctcgctgcctcccaacacttccgagggcttcttggccgaggtcctgcgccgcgtcaaggccaagggggccgagttcgtcctcgacatctcgagccatcagctggcagacctcattgccatggagccgctgctgatcaagcccaatgacgacgagctgctcgacatctttggcattaaggtgagcggtggcgacgatgagtccgtcaagggcgctatggccgagctgcacgctaagggcgccaagaacgtgctgctgaccctcggtggcgccggtgcgtacttctccaacggcgagcacatctggtttgccaatcgcaccttcgacgtcaagctgctgtcgacggtgtgcgccggcgattcctcgctcgctgccttcctgtccgtatggcacgacgctcccaagcgcgtcgaggatgccctccgtctgtcgatggccaccggcgccaacgtggtcgagtgcccgggcctgggcgactttgccaaggtggacgaatacaagaagaacatcgaagttcgtcaggtctgctagccgcatcgaaaaatcgctgccgaacacccgctttggatctccgaggcgggtgttttttgtgcactgaacgcatatggcgtctgctgtctcgttttatggaattgacgacgcgattgcgtgtgcgcgctttcttgtttcttgctagacttcttgagaaccatcgatttacgctcacaagtgcaggaggccataggcatgtgcaatgtttcgctcaacggtactcaaccgtccgatgcgtccctgcgcgtcctgcgcgcgcttgaggcggctggtcttgaggcttggtacgtgggtggttgggtgcgcgacgccctgatggggtgccccagccacgatgttgatatgtgctgtagcggcctgtggcaggagtccaaagcggcgctcgaggccgccggcatcgcggttgtggagtcgggcattaaatttggcggaatcacggctatttccgatggcgagcgtatcgaggtcaccacgtaccgtctggatggcttttacaccgatggtcgccatccccagagtgtggaacgtgccgcctcgctcgaggacgatctggcgcgccgcgactttaccgtcaacgccatggcctggcatcccgagcgcgggcttgtcgaccgctacgacggccagggtgacttggagcgcaagctgattcgcgctgtcggcgatcccaagcgtcgctttaacgaggacgcccttcgcatgctgcgtgcggtacgctttgcctgccgcctggactttatgattgagcccgagacaaagcgcgcgcttgctgagtgtgcgccgttgctcgatgctgtggcgcgcgagcgtgtgggtattgagctcgagggcattctttcgaccggtcatgggggagacgcgatgcttcgctatcccgagctcatctgtgcctctgtgcccgagttggcagcgggtcgcggctttgatcagcgaagtgtctatcatgcgtttaacgtctacgagcatatcgcccgtgtgctgacggtggcaggggagcttgcgctgtgcgacggcgtcgcgccctcgtcgagccttatgtgggcggcgtttttgcacgatgtctccaagcccgagtgctttacggtcgatcacgccggcagcggacacttctacggtcatcccgagctcggcgccaagaaagcgcacgtcattatggatcgcctggctctctcgcacgacctggtgcgcgacgtgtgcctgctcatcaaatatcacgacaagccgctgcgccccgagcgctcctgcctgctcaatatgatgcgcgcgctttcgggtgagggcgtcgacacggcccgcctgattgacgagctcatggaccttaagcgtgccgacacacttggcaaggccccgtcgtgcttctattacgttgagacgattgaggagatgcgcgcgatggcgcacgagctgctgagggcgggggagccctatacgctcaagatgctcgccttcaacggcggcgacctgatccgtgctggagtcaagcccgggccggaactggggcagcttctcaactccgccctcgacgccgtgatcgaagacaacattcccaacgatcgcgaagctcttttggtccatctcaacttgaattagctacctagtttacctgcgtgttccataacctgccgacaatttttcggcaatttggaatttcttcttgcgctgacgttttttgtcccgtaatatatttcctcgcagcacggcagtgcagatgtcatgtggcccgttcgtctagcggtttaggacgccgccctctcaaggcggagatcaccaggcccgtgggttataccctaagagcaaaccaccctttttaagggtggttctgattgttcggcatccaaagcgaagagactgtccccttgccgtgtcccgttcgtttttgcccggttcgttacattcctcactggtgtcggtagaaaatgggaatagagtaggacaaacgcgtcgaatacgaacggcgggggagagcgggcgagggcgcccgcgcgggagaggttgccgtccatgctggagctcaaagatatttgcaaaaggtacgtcacgcagtcgtttacgcaggtggcgctcgacagcgtgagccttgcctttcgcgataatgagttcgtggccattctgggcccttcgggctcgggcaaaactacgatgctcaacgtcatcggcgggctggatcattttgactcgggcgatctgctcatcgacggtatttcgaccaaggacttccgcgaccgcgattgggatgcctaccgcaacaaccgcatcggttttgtgttccagagctataaccttattccgcatcagaccatcttggaaaacgtggagttggcgctcacgcttacgggcgtgggacatggcgagcgccgacagcgtgcgcgcgaggcgcttgaggcagtcggtctgggcgagcatgtgaacaagcgcccgagccagctttcgggcggacagatgcagcgcgtggccattgcccgtgccctgattaacgaccccgagatcgtgttggcggacgagccgaccggcgccctggactcgacgacgtccgtgcaggtcatggacttgctcaaggaggttgcgcgcgaccgtttggtcatcatggttacgcacaatcccgagttggcgtaccagtacgctacgcgtatcgtcaacctggcggacggtaagatcaccgacgattccgacccctttgatgttgcagaagccgcgcgtcgtgaggccaagcccacgcgtaaaacctcgatgagctttgtaacggcgctgggcctttctgcccgaaaccttatgaccaagaagggccgtacggctatgacggcctttgcgggctcgattggcattatcggcatcgcggcgattttggcgctctccaacggcgtgaacaactacatcaaaaaggtcgaggaggatacgctctcgagctatccgcttaccatctccaagcaggattatgacctgtcgcctatgatgggcggacagggggccgcggatgacgatgcgtccaaaaacgagggttcgtcagacggtggctccgacggcaaggctcaaggaaccgataagattcccgtggtcacggccgtaaaggatatgtttgcgagcgttaagtccaacgatatgacgagcttcaaggcatggctcgatgacgggggcgacggcatcgacaaagaggtcaacgctattcagtacggctatggcgtaacgccggttgtctatcgcgcgggcaagggcgatgagaagcccgtgcgtctggtgcccaatgccatgaccgaggccatgagcggcggcgcgagctcggcggcaacggtgagcgtggagtccatgggaacctcggtcttcaacgaaatgattgacgaccagagcctgctcgacagtcagtacgatgtcgttgccggtcattggcccacgtccgccaacgaggccgtgatggtgctttcgagccgtggcacggtgggcgactatacgctctacagcatcggtgcgctggatatcgatgagctcaacgacctggttaacagtgccatgacggccgacggcaaggtcaagacgcccaagaccggcagcgactttacctacgacgatgcactgtccacgacgtttaaggtgctgtcgccggccgatgcctatcgcaaaaacgaagagaccggcatgtggactgacatgtctggtgatgccgactttatggcggccaaggttgccgagggtatcgacgtgcgcattgtgggcgtggtgcgacccaacgaaacggccaacgcgagcgcattgtccccgggcattgcctacacgcatgcgctgactcgccagcttatggaacgcgccgccgattcgcagattgtgcaggagcagcttgcccgccccgagacagatgtttttacgggcaaaacctttgacgagctgcagggtgaggccaagcaaggcgtggatttgagcagcatgttcagtgtggacgaagcggcgctgaagagtgcgttctcgttcgatacgtcggcgctctcgggtgcggccggcggtatagacctttctggtatcgacttgtccgggctggaccttgacctttcgggcgttgggaagggcattgacttcaccgacatcatggccaaagcgccggccccggatttctcgggcatctttgatggcctggaactcacgcccgagcaaatgcagcaggtgggagcgcttgtcaaccagctgtttgagggctttttgcagtctgatcagtttagggcactgtcacccgaagatcttaaggacgcgtcaaagctcgctgccgcattctcggcgtatcttgagaatgatgacgcggcccagcaaatcctggcccagctcaaagcgctcggcggcgatgccctggccgagcgcctgcaacaggcgatgaccgactatgtgcaaaagcagctggctccgtatctgcagcaggctatggatcaggtgacaaaggcaatcagagagcagattgaggcgacggtatcaactcagctcaaggcgggcgcggcggggctcatgggccagatggcgacgcagatgtcttcgagttttgccaacctggcgagcgccatgcgcgtggatgcgaatgcctttgctcgcgccatccacttcaacatggacgccgaggacctgagttcgctcatgatgagctatgccaaggcgtcaaagctcacctacgacaacaatctgaccacgttgggctatgcggacgaggcggaccccatctcggtcaagattttcccgcgcgactttgaggccaaggagcgtgtgctcgatcacatcgatgcgtacaacaagcaggtcaaagctgctggccacgatgagcaggcaatctcgtacaccgactacatgggcatcatcatgggctcggtgaccgacatcgtgaacaccatcagcttggtgctcatcgcattcgtgagcatcagcctggtggtgagctccatcatgattggcatcatcacctacatcagcgtgctggagcgcaaaaaggagattggtatcctgcgcgcgatcggcgcgtccaagcgcaacgtggccaacgtgttcaacgccgagacctttatcgaaggcctcattgccggcgtctttgccattgtcgtcgtagcggccgtgagctttccggttaatgcctgggcgcttgctgccaagcaggttcctaacctgatgagtctgcccgtgcaggatgcgctgacgctcattgcgatttcggtgctgctgacggtcgttgccggcctgctgccggcccgcagcgcatccaagaaagaccccgtggaagccctgcgctccgaataatgtgacaaagggactgtccctttgtcacgttggatgaaaaggcgcgggaagggggtggcccctcccgcgccttctagtttgttttgcccatcagcgtgatacggatgcttggatgggtgtactcgtcaaactcgtcctcgggatccgtatcaaacgagtaatacgttttgactggctcgtcactcgtcctgatagagattctctcgtagagcgagccgttcaaaaatgcctgtctaaacttttcggggagcttatgcggtgccaggagctcggggctcaccgtcttgacgtttacggcttgaacggcagagaacagctcgtccaggtcgcgctcgatgcgggcgaggttgtcctcaaggctcgcactggggtcgacctctgccgcgtaactcacttccttgagtgtccccttgttgtcaaagtccaggtaggtataggccttttgggtatcggagtcgccttcgtgcagatggccgcggacgtgatagccgtaatcttgatatcgctcgtaggggtcatcggcagacacgtactcgcatgcgggctctaacgccttgcgggcgatggcgatctgctcggccgcggccgcggcgttctcctgcatctcgatgtttccctgcgccagctgcgggatataggcgccgcacacgattgcgaggggcagcgccacaagcgcgacgatccacttttttgcacgggggacaggcacgccacaggcctctgccatggcctttgcgttggcaaagctctcggcaagcacgtctgccgcggtggcgacggctcctacggcagcggcgacctctgccgcgccgcccaggttgcgtgcggtctcgttgtcgctgttcttgagcaggcgcgcggcggcctgcgtgccaacgacgcccgcaatctgtgccgagcgatctttttcgctctgctcgacggcaagtcggtgctgcatttctcgccactgcttaccgcgcatgccaaagcgcggcgcgagagtgcagtagcagaatatgatgagctcgacgacggcgagtgccagggcggccatcatgcccgtgtcttggaatccttcatgatggaagacgatgtcgtcgatcatctcgaaaggaatgatcaataagggcagcacgaatgccatggcaagcgctgcaccagcaaccttggggcagatgcagtatcgctggatacgtttgcgttcttgttcggaaagtgttgccatagctgatccttgatgtcgtggcggtcgttgcggcgcgcgggatgcgtcagtctgggctagcgttggataagagcatagagcaagatactcaccgcaatgagcagaaggccgatgtccccaaccaagatgagcgcgagcaaggatatctgcgacgtggtcacggcgtttttgagcggcaaccggagcgtagacctgctctgcagctccttcactgtttaccctgcatcccaagtgcggcgcaagtgagcaatagcaaaactttgtcacgcgtaaaagcaaggaagtcgcaaggtctggggcggggatgctggcatacgcctcggatacaatcgaagccatgctagaaagaggcttcgatgattaaaaaatcgttctttaatccgttttcgtcgctgctgcttgcgcttgccggcttggcctttttggttgacgtcgtaccgcaggcgcaaggccagacgggcgtgtttgcacctgccgtgctgtttttgatgtggctggttggcggcctggtgcgcctgttctacgaaaacgaagccaagcgcagcttcgaccggcacatgttcaaggcgaaccatgcggccgtttggaaacgtgtcgacgcttgctggatccaagtcgatgctgaccggcttgtgcccggcgatgtgattcgcctgtatgccggcatgctctgcccggtcgatgcggttcttgccaagggcgaccacatccttgtctccgaatcgtcgcttacgggcgagagcggtcagaccaccaagcgagaaggggaggccgtccgtgctggaacgaccatcgtcgacggaaaggcttcggcaaccgttctcgctcgcgttgccgaggagccgcccacatcgccgcagcgcgctcggctaggcacgcagtttggcgttggtgcaaggagcatctgtgccgccctggcaaggtgcatgctcatcgtgctgccgtttgtcattatgattcgaggttttgtgctgggcgactgggcgcaggccctgctgtttgccctgggcacggccgttggcctggtccccgagatgctgccggtcgtcacgagcgtgtgcctttcgggcagcgcgcatcgccttaagaacaaacaggtcatcgttaaaaacgttgacgccatggaatcgctgggttccatggacgtggtgtgcgtggacaagacgggcacactcaccgaggacaccgcggtgctcgagtactataccgatatcctgggcaacgaaagcgagcaaacgctcagcctggcgtatttggagagtaagagccagggggcggccgccaaccagctcaaccgggccattgccgacgcgtgcgccgcgcccgagttgcgtctcgccgccaaagacctcgcaggcgcatttaccctgcacgcatctgatcctttcgaccacgtcaccaaggcttcgggcgttaagctcgatgccacgcctggggcgcttggttgcctggggctgcaggctcgtcctggcaatcacttgaccatcgtaaagggcgaggtcgagagtgtttgcgctcgttgtgcctgggccaactttaaaggggaactcgtccccatggacgccgcgggccgccagagcgcctatgaggttgcggaggacatgcgtgccgacggcatcaaggtcctcgccgttgcctacagcacaacgtcttcggactggggtgacctggtgctctgcggctttttgggctttttcgatcgacccaaggcaagcgctcgcgccgccgtgcgcgcgctgtccgacctttccgttgaggtgcgcgtgcttaccggtgactcggcttcggttgcccggtcaacctgttcgcgcctgggcattcctgccgatagcgttatcactggcagcatgctcgatgccatggaggagtccgaggcgcttgttcgcgtggggcgtactcgtgtgtttgccgagctcacgcccgcgcaaaaggctcatgttgtcagtctcattcgactctctggccatacggtcggctatatcggcgatggtgtgaacgacgtgccggcgctttcgtcggcagatgtcggcatcgttgtggactcggcggcggccgaatccaagaaggttgccgacctggtgctgctcgagcgtgacctgggtgtggttgccgagggcgtcagcgaaggcagggcctcgtttgccaacgcctccaagtacattcgtatcgcatcaagttccaactttggcaacatctgctcggttgccgcttcgagcattttcctgccgtttttgccggcgaccgccgctcagctgctcctgctcaatctgtgctacgacgctacgtgcctcgcactttcgtgggacaacgtcgatgacgtggaaatcgctcgccccaaggcgtggtcgggcaagggcctcggcagctttatgctgcattttggctttgcaagctcggcattcgatatcatcacgtttgccattttgcttttgggcgtatgccccgccgtgtgtggggcgccctttgccgcgctggatgccgcggggcaggtgacatttatcgcgaccttccaggccggctggctgttggaatgcgcgtggaccgaatcactcgtgctcttgattttgcgaacgagaaacgtccgtaatggggaccgtccttgccgtccgctcgtgatgatggttgtcgcgatgctggctgcctcggcgctccttgcgcttacccctgcggcgcagctgttggggcttgccgcgctgcctgtatggtatttgggtatcgtggcgttgctgagcgtgctgtatcttgttgttgtttcgacgatcaagcgggtctacctgcccgctcggccagtctgttctagggcggttctatgcgtaccaacagaaccaacatagcgattacgccggcagaggccgccgagctcagcagcgcgctgctctcgtccggcagtgccgtcgccctcgaacttgcccccgtatttgccgatatcgcctcgggtaggctgacggctatcgagctggcgattgccggctcgcaaacgagcgctgccgctgggcccatcattataggtgagctttcgatcgacctggcttcgcgtgctgttaaggtgtcgggcgcgtccgtctcgcttacgcccaaggagttcgacatcctggcctttttggcgagcaaccggggcacggtctttagcaaagaggaaatctaccgggcggtgtggcaagacgagtatctgctcgacgacagcaacatcatggcctttgtccgcaagattcgaaaaaagattgagcccgagcccgacaacccccgttacctgctcactgtttggggcgtgggctacaagatggccgagtgacgctctgggttttcgctcccatcgacccaaatgattactctgacaatccttgccaaatcgcaagaaagccgcaagaaaccagccatgggctcggtcttgcggcttttctattctaaagacagtcgcagacacgaaggagaggtgaggaccgtgagcggcagtgacagtaccggcaacgcagggcgatgtctgtcggcgcgggtccaccttgatggaaggcgccgcagctaagtagctctgcatccgatcgatagaacggagcaaggcaattgaagaagctgactatgcgccatacgccgtctgtggttcaggcgcaaaacgaactgatcaggcatcgtgcggagggtcgcatccagcatgcggcgaccatcccgttgaccgaggccatgtcctgggtggattcgaacctgggcggccttaatcgcgatgaggtcgcgcacagcgaggcggacaacggccgcaacgtggtcacgcgcggcaagaagaagtcgctggcacgcaagcttgcagatgcgttcatcaatccctttacggcgatcctgtttttcctggccatcatttcggcgacaaccgatatggtgttcccggcgctgtcgatgatgggcagcacgccggaggatttcgacccgctgacggtaattatcatcaccacgatggtggtgctctcgggcacgctgcgctacatccaagaggcccgcagcggcaacgcggccgaaaagctgctcgatatgatcacgactaccgtgacggttacgcgtaaaggtgcccctaggaccgagattcccatcgacgacgtggtggtcggagatatcgtgcacctgtctgccggcgacatgatccccgccgacgtgaggatcatcgaggccaaggacctctttgtgagtcaggccagcctgacgggcgagagtgagccggtcgagaaggtgcctgcgacctgcaccgagtccgattcggcgacgtcgttcgagaacatcgccctcatgggcagcagcgtaatctcgggcagtgcgacggcactcgtctttagcgtgggcgagcagaccctgttcggctccatggcgtcgagcctgtccgaggatgccgtagagacgagcttttccaagggtgtcaacgacgtctcgtgggtgctcattcgctttatgatggtgatggttccgtttgtctttctgatcaacggtgtcaccaagggcgactggcttaatgctggcctgtttgccatcagcatcgccgtgggcctgacacccgagatgctgcccatgatcgttaccacgtgccttgccaagggcgccgtggccatgagcaaaaagcagaccatcgttaagaacctcaactcgattcaaaactttggcgcgatggacgtgctgtgcacggacaagactggcacgctgacgcaggaccaggtggtgctggagtatcactggaacatcgatggccaggaggattcgcgcgttctgcgccatgcctacctcaacagctatttccagacgggctacaagaatctgatggatctggcgatcatcaaatgcaccgaggaagaggagcaaaacgacccgagtctcaccgacctttccgaggcatatgagaaggtcgacgaggtgccgttcgactttgcgcgtcgtcgccttacgaccgtggtgcgcaaccgcagcggcaagacgcaaatggtcaccaagggcgccgtcgaggagatgctttcggtgtgctcgcatgccgagatcgacggtgcggtgcgggaactggacgatgaagtgcgcgagcgcattttggcgacggttgctgatcttaacgacgatggcttccgcgtgctggcgattgctcaaaagtctaatccttcgcctgctggtgcctttagcgccgaagacgagcgagacatggtactgatcggttacctggcatttttggatccgcctaaagagtcgacggccgatgccatcgaggcgctgcgcaatcacggtgtcgccaccaagatcctgaccggcgataacgagaaggttacgcgcaccatctgtaagcaggtgggactcgaggtcgacaacatgctgctcggcagcgatattgccgccatggacgacaccgagcttgctcgccgtgccgaggacgtgcaggtgttcgccaagctcacgcccgatcaaaaggcgcgtgtcgtctctgttttgcgcgacaacgggcatgttgtgggctacatgggcgacggcatcaacgacgcctcggccatgaagtcgtccgacatcggcatctcggtcgatactgccgtcgacgtggcaaaggagtcggccgacattatcttgctcgagaaggacctgatggtgctcgaggagggcatcatcgaggggcgtaagacctacgccaacatgatcaagtacatcaagatgaccgcaagctccaacttcggcaatatgttcagcgtgcttgccgcatctgccctgctgccgtttttgcccatgatgagcatccaactgatcctgctcaacctgatttatgactgcagctgcctggcgattccctgggataacgtggacgaggagttcctgcgcgtaccgcgtacctgggacgcctcgagcgttggcaggttcatgatctggatcgggcccaccagctccatcttcgactttatgacctacatctttatgtactttgtcttctgccccctgtttgtgagccacggcgtactgtttaacgacctggcgagcgtctactcgggcgccgcactggagcagatgcagctggcctacatcgcactgttccaggccggctggttcgttgagtccatgtggagccagacgctggtcatccacatgatccgcacgcccaagctgccgtttatccagagccgtgcctcggcgccggtgatgctgctcacgatgacgggcattgcgctgctcacgttgatcccgtttagcccacttggacccgtattggggctgggcgcactgcccgtcgagtacttcttgttcctgattccgtgcatcctgctgtacatggcgttggcgacgagcctcaagaaggcctacgtcaagcgctatggcgagctgctgtagcagggtattgacgctgaaaggagcgttcgcatgaactggacgcagatttggattgacctgtttggtgctacggagtggctgggcctcaacatgggcttttgggtggccaacggcgtggtactggtagtcgttgtgatcatgaacgtcgtcttttggaacatgaaaccgctgccgagggatgaataacgagcgagggggccgcccaccgggcggccccctcgctgtttataggcaccagtaaatcgaaggtgaatacttttcccgagaagtgaacgacctaatttggactccggtagcatccgcatttttcgatgccaaaaccgcaggatttgagcgacaaaaccgcaggaaatagctctccaaaagtgtcgatgcttcgggggtccgatttcactcgttcacttctcgggaaaagtattcaccttcgtttcgcggggtggcggttggaagggtcgctggtgccggtttgccatgtttttggcagaccgcgggcttagatctccagcgcgccgtactgctcgtcgtccacgggctcgagccactcgttgcacgtgtcctcaccggggaatccaaaggccaggtggctaaaccagctgttggcggtggcgccatgccagtgcttgacgttggcgggaatctcgacgacgtcgccggggtgcaggcgctgcgcgggcttgccctcttcctggtaccagccctcgccgtcgacgcagatcagcacctgtccgccgcctttgctcgcgtggtggatgtgccagttgttgcggcagcccggttcaaaggtgacgttgtggatgggcaggtaatcgtccggggtggtcagcgcattgagatagctctggccgataaaaaacggcgcataggcgtcgttgggctcgccgaggccaaagaacccgccgtggagttcggatgctgcgctatttgccccgtcgcccgcatagacttccttggcaagattgaacgcagcccaggctttgggccagccggcatagaaggccacgtgcgtgatggcgctcgccatctccttttgactcacgccgtgcttgcgtgcgttggcgatgtggtaggcgagcgagctgtctgtgatgccctgcgccacgagggccaccacggtgatgaggcttcgcgtcttaaggtcgaggtcggtgttgttccagttctcgccaaagagcacatcgtcgttaaaatgcgcgaaatcgggggcgaacttgcccaaggcatcgcggcctgcggtctgtttaatggtcatggaggttcctttctaaccagagataatcgagcggaatttgggcgttacgagcggttacgcgcgacaaattgcttgagttcggcatcgcttgctccattgagtatcgcgcccgggacaattgtggcgccgggtgtgctggcctcaagaacctttgcggttttgcccatgccgctgccaccggaggtcgcaaagaggacaatcttcttgccggcaaaactctgggattccaggaacgttttgataatcgccggtgcaacataccaccagatagggaagccaaggtagatggtgctgtattcatcgagctccaaaggcttcgaggcgatggcggggcggcaggtggggtcgttggtctcaagcgtgctgcggctgttcttatcgttccagttgagatcggcggctgtgtagggcttggcgggctcaatctcaaataggtcagcgccggctgttttcgcaaggcgctcggcgacgctttttgtcacaccgctggcactgaaataggctacaagggtctttgacatggttgctcctttatttgatgggtttcttgcagcgtatagatgaggtagtcgagggtttcgagtcttttttgttcggcgtggacacgttcgagcagctcgcggcggtacgtcttgaggcgacagatgcgggcgcacgcgcttggcagccccgagagctcgtcgataaacgcatcgcagcacccggcgtcgcgcaggttcgtgatagtcttttcgtccattgtgcggcttggcgtcctccttgttcttgaggggatgactatagcgtacgttgatgcgccgacgatgtatattgcttatatcgactagctggatatacgagaattgaatggctagtcggaggacggatctggcaggattgggggcaccgtggagctgcgaacgctgcgttactttttggcggtggcgcgcgaggaaaacatgaccgaggcggcaaacgtgctgcatgtgacacagcccacgctgtcgcgccagatcgccgacttggagcgcgagctgggcgtcgagctgtttgagcgcaccaatcggtcatgtgtgcttacgagcgacgggatgcgcctgcgccaacgtgccgaggagatcgtctcgctggtggaacagaccgagtcggagctggcggattgggagcttggcattgcgggcaatatccgcattggcgctggcgagacccagtcgatgcggctggtgctcgacacttttgcggagctgcgtcgagaccatcccggcgtgacggttgagctttacactggcaatgccgacgcggtggaggagcgcctggagcgcggtctgctcgactttgccctgctgttggagcccgttaacgtcgagaaatacgagtggatccgtatgtccgaggtggatcgagccggcgtggtcgttgcggtgagcggcccctggggcgacttggacgtgctgacgcctgcggatgttgcgcagatgccgttgctgctgagttcgcgcacgtcgaatcgagcgctggatttagcggcgtggtctagtggtgcccttactatcgatgatctcaacgttgtgggacatttcgacttgatcggcaacgcatcgcatttggtgcgctcgggtgctgcgtgcgctgttggcattggtagcctgctgcaggtggatgaaagcagcgacctgcgatttatcccatttgagccgccgcttgccatcgcgtcgtacctggtgtggaaaaaatatcgcctgcgctctcgcgcctgcgaagagttcctgaaccgtttgaatggagcgtgacaaagggcagctcccttggtcacgttcgttgatatgagagaagagtagatgatcctatcgctggcccccatggaggggattaccgggcatgtgttccgtcgcgtgcatgcggagtgctttgacgcgcttgactgctactacacgccgtttttgccgccgccgcgggtgggtaatcgctttggtggcaaggcgtttaaggaggtcgatccggccaacaaccagggactcaatgtcgtccctcagcttatgtccaagaatgcggacgagtttgtgtgggcggcgcaggtgctcgccgacatgggctatcgcgaggtcaacctcaatcttggctgcccttctgggacggttgttgccaagggcaagggctcgggtttcttgcgtaacttggatgagctcgaggtgttcttgagcgatgtgtgcgaacgctcgccattgccggtgtccgttaagaccaggctggggctcgaggacgacgcggaatacgagcgcgtgctcgacctttactgccgcatgccactggccgagctaatcgtgcatccgagagtgcaaaaggatcgttacacgggatcgccgcgcaaagagttttatggcgagacgctcgcgcgtgcgccgttcccggtggcctataacggcgacatctttgatcttgaggacatggacgcgctggtggaggcctatcccggcacgcgccatgtgatgttggggcgtggcttgctcgcgaaccctgcgctggcccgcatggtcaagggcggccctgcagccacgaccgccgagctccagcgcttccacgatacgctgttcgcggcctatgcagaggagattggcggcaacgcggtctttcgtatgaaggagtggtggttctacgccaagtgtgccttcgccgatcccgccaccgtccacaagcttgtgcgcaagaccaaaaaggtcgacgaataccgcgccgtcgtcgaccgcgtcttccgcgagcaaccgctcgcgcccacagcccgcttccacggttaaccagtcatcggggacgttctttaacgactagtcatttaagaacgtccccgatgactacccaaaagttgtacgtcagcatccaaagatgtcgaaaaatgtcgtttttggatgctgacgtacatgtttaaaggcggtatcgcctctgctatctgacggcttgaacggcgagtgcctctattacgcgctcggcgccggcgtcgatcagaatgctgcgattggcgatttctgccggagcgactgcctcgccaaggttgacgcacgcgtaggtggcgtgctcgtttttggccgtcatctgccaaaacgggtacttgatgatgacgggcgtgttgccgcctacgccaagctccaagaacagaacgcgcatattgctgtggcggcgcaggaaatcctggtagcgatcggcggcagcgtaccaacccttgtcctggacaaacgtatcgtcggcgcgcagattcatcgtaagcggggctccacagtgggggcaatggggcacaagcgcggacggaatgcgcaggtcctgctgggcggcaaccatatggcgtacgagttcttcgttgtcccaggtctcctgacagcagggcttgctgcactggaacaggccgtagtctccctgcgtgtaaaagagccgctgcttgtcaaagccggcgcgctggaagcaatggtccacattcgtagtcagcacaaagtagtcgcgcccgcgcactatgtccaagagttgttcgtagagcggcgtcggtacggggtcgtatcggttgcacataatgtagcggctccaaaacgcccagtactcctcgagtgaatcatagggatagaagccgccagaatacatgtcggcaaagccatagcgtgcggcaaagtcaccaaagagcttctcgaaacgctcacccgaataggcgtatccggcggcggtcgagagtcctgctccggcaccgattaccacggcgtcagatgcatcgagtgcggctcggagcttatcgatctgtttggagaaggctgcggtagattgcctcgtcagacgcgagaaaaacattgaagatcaccttaaggttggggtcgttatggtctagatgatgacgaacggcatcgatggccacgcgcgcggcggcatcttgcggatagccaaacacgccagtagagatgcagcagaatgcgagggtgccgagtcctcgacgcgtcgcttcttccaagcagctggtgtagcagcggcgtaatagcaattcctcacgagggccaggcttatggctgggcacgatagggccgacggtgtggaaaacgtagctgctgggcaggttgaacgccggcgtgactttgacgcgtgcggttggctcctcgtgcccctggtcgtccatgagattggcgcacgccaggcgtaactgcatgccggcgtaggtgtggatggcgttgtcgatgcaacgatgccccggcacaaagcacccgagcatctggctgttggcggcattgacgatggcgtcggccttaagcagcgtaatgtcgccgcgccagatggcaacgcgatcgcggtaggggagcgtgccagcgttggtcgccccgccgcgttcaagtaggcgttgctgcaagtaggcgtcttgtatgtcgagcgtctcggccgtaagcgcctcgggcgggcgtacgttcatgagggctcgaagcagattgcgctgctcgttggctccggcaggtgcagcaatgctgcgcccgtctggccgctcggcaagcaataccttgatgagccaaacgcggcgttcggcctgattcatgaccttcctcctgttcaattgagccggtttcattcgacagtagtgtgccgtctggcgcgcaacagtaaaagaaggcacaaaaaggtaagcgccgtggagcggtatgccccacggcgctcaatgtgcagaagcccgccgctgttaggagtttcgcacgagctgctgataatcggtgccccattccaccagggaatcgatgatgggcataaggctgtggcccagctcgctaagcgcatattcggtgcggatgggcgtctcggggatgacggtgcgcgtgatgaggcccgcggcatccatttccttaaggttggacgaaagtaccttttggctaatgccggggatagcgcgatgtagcgcgttgaagcccatgggttggttaatgagctgctgaatgatatagatcttccacttgttgccaaagagctgaaaacacgtggcaacagggcagggcggcagctcttctttggtaagcatagagactcctcaatcatgtggacgactttcattatcgcagctgctgtcgcttgtggatactacttaccttttggtgactggctaatagattggtgccttcttttggtcgttgcgcgctttttgcatgatgcatatagacgcaaggagcgtcaaaaaccgggtggcttcgaccggccatcctcgaccgaaaggaaatgccatgtccgagaatcttgagaacgtcgccgctttcgcctcctgcggtaccaccgatcctgcgcccgcttgcggctccgccgaccccaaggctgcccctgcctgcggcaccgcttgcggcgctgcggacgctcagtaagcaatcgctaggaagggactcgtaatggatgctcagacttgcctcaaaaagatgcagcttgccgggacgctctccctggcaaccgtggacgagaattgcgcgccgcaaattcgctgcgtaagcgccgtccattacgagccccgtgctatctactttctcacggcacgtggcaaggagatggcccgtcagcttatggccgacgggcgtgtccaaacgctcgtccacacgcgatttaacgagatgattcgcatgtccggcgttgccgcccccgtctcggattccgagcaagttcactggcgcgacgtgatttacgccgagcagccgtatcttgccaacgtgtatcccggtgatacgcgcgagatcaacatcatctttaaggtcgagaacatagtgctcgactactttaacctgggagttcatcccatcgagcgcgcggtctttactttagacgagggcatggcgcctgcgcccgccaagggtttccgcatcgatgctgatgcgtgtatcggttgcggcacctgccttgagcactgcccgcagaagtgcatcgagccgggagactcatatcgcatagagcccgagcactgcctgcattgcggtgcctgtgtcgagaattgccccgtcggcgccgttgcgcgcctgtagcccaaataccgtcatcagtttcaacatcgaccaagggagtcccacgatgcaaaagcccgcgtttgccttccaatggcacattacggatgaatgcgatcagcgttgcaaacattgctatatctttgccaacggtgcctgcgcgggtttcaagcgcatgccgtgggagcaaatgctccaggtcgtcgatcaggcccaggcgctctgcgagcgcatcggtcgtcagccgtacttttacgttacgggcggcgaccccattcttcatcccgatttttggcaccttgccgagctcctgcacgagcgcggtttcatgtggtgcgtaatgggcaatccgttccatctgaccgacgaggtctgcgctcgcatgaaagagctgggttgccgtaaatatcagctttcgctcgacggactcgagtcgacgcacgattacttccgtaagcccggctcgtttgctgagaccatgcgcgccatcggttgccttaagcgtgcaggtatctgggttgccgtcatgaacacggtatcgagcatgaacgctgccgagctgccgcagctcatcgaccttgtggcaagcctcgaggtcgacgtgttcgcctttgggcgctactgccccacgtcgggccaaaagcgtgacgagttccatttggagccgcttgagtatcgggatgtgttgctggccgcgcaggagcgcatggagttccatcaggcggccggctgcaaaacgttcttccagctcaaggaccatctgtggacgctgcttttgtgggagcagggtaagctcaccattcccgagggcgccaagcccggcatgatctatgacggctgccactgcggtacgggccatatgacggtgctgcctacgggtgatgtctatgcgtgtcgccgcatggagagcaaggtgggcaacgttgccgaaaactcgctggaggagctcttcttctctccgcaaatggaagccaagcgcgattttaagaagttcaagaaatgctctaagtgcgagctcttcggttggtgtcgtggctgtcctgcggtgacgtacggctatacgggcgacatgtacgaggccgacccccagtgctggaaagagattgaggagtaggattattgtcgtctagtcatcggggacgttctttaacggctagtcatttaagagcgtccccgatgactacccataaaaagctgtacgccagcatccaaagatgtcgaaaatggtcgactttggatgctggcgtacatgtttgggtcgtatgggttggggtgagccgatcgcaaggcgagtgttagagcagattctcctgcacccatgcgatgatgtcgctcgactcgtagagcggcttgccgtcgatgaacaggcagggaacctggcgctttccgccggcggcgatgagtgtctgctcggcatcggcgtcggtcgagatattgcgctcggggatggtcacgccattgtccgccaggaagcgcttgaccttaatgcaatacggacatctggtcataacgtacagcacgagctcgtgacgagtagccataggtctccaatcagttggggttttgattgagatacccaaagccgctgcaatctaagcgcaagtcagcgacgactcgatggcctggaccagaaacgtcgtggctccggtgccgcatggcttgtcgcagtagtctacgaagcgctggtcggcgaggtagccgcgggcgagtcccagatatgcctcgtcttggggctcgctgccccagttgagagcaatccagcggcgatgcatcgcgacgagcttgcgagcctcgctgccttccggttcgccatcgcccatggcaatcgagagctggcccaaaatggcgcgctcaagctccttcatgtcgttccacgtctgagggtccatgtccagcagcgcctcgtttgccgcgtcgatggcttcatcaccataacgcgcccgggcctcggctccgtagcgctcctcgttttcctgcacggtgtgccagcgctccagttgtggcagcacggctcccatgagcgagacggcttcgtcgagcgacatactggtgttttgtgccagccgcggggcacaatcctcgatcatcgcctccatggtggtgtcgtaggtgtacttgccgtggtcgtagcaccacttgcagtaatgatcggtcgtggcgcccgtggcgtcggtgccgcagtcttcgggcgtgagtatcatgccgcagctctgacaatagtgctcgggcatttcgagcagatgaggcagcggctcgccggtcacggcggcaatgagtttcatcatgtcgatgcccggtgtgacctcgccgcgttcccaacggctgatggcctggcgtgtgacgaagagcttggcggcgagctgctcttgggtaaggtgatgagcgcgacggacagcgatgagcttttctgcaaaggccatagcggctcctttctgctggttgatggcttaagcatacgcggcaacagacgcccttccaagcaaccgttggttgcacgacgggggaccgcggcgaagaattgcgcgcaacgccccacacctccatgccgtacaatgaccggcatggaacctattgcacacatacataccgacctgccgcagaagttcggcattccgcgcaacagctttttggcgcctcatctgcagggacgcatcgtttttgagccggaatttgcctccaatgcagcggtcgagggcctggactccttctctcacctatggctgttgtggcgcttcgaaaacggcacgctcggcggcacggctaaggacatagctaccgatgccaagacgcaggacaggtccggcaccaatgccaagtggtcgaaaaccgtgcgcccgccgcgtctgggtggagccgagcgcgtgggcgtgtttgccacgcgcagtccgtttcgccctaatcccatcgggcttacctgcgtcaggctcgatcgtgtcgagcttaccgacgacggccccatcatccatgtgctgggggccgacctgcgcgacggcacgcccatctacgacatcaagccctatattccgtttgcggactgccatccggatgcgacgggtggctggatcgaagacgccccgtggcaagagctcgacgtcgagtttccacaagcgctgcaagacgaggtcccgcccacaaagctgcccggtttgatcgagattcttcgccaagatccgcgccgtgctggaagcaagcacgagcccaatcgcgtctaccacttggcctactccgggctcgatatttcgtttacggtcgatgggacacagctgactgtaacggccgtcaccgaagctcaggactagctgtccgcccgcccacatcagtcaaattcaaccccaaaacccgtgccaaagccgcccgtcctgatggacaataacgcctaccgaaccaatccactttgcacgggagcccagcatgaaatacgacttcacctcgcttatcgaccgccacggtatggatgccatcgccgttgactcctggggcgagatccccggtatggcgccaaacgcacccgatgagggcttcgaccgcatccccatgtgggtggcggatatgaactttgccaccgtccctacggtccaggagcacatcattcagcgtgcccagcatcccatgtttggctactttgatccgcgcgccgagtacttcgacagcatcatcgaatggcagagccgtcgcaacggcgttgagggcctgcttcccgagcatatcggctacgagaacggcgtgctgggcggcgtcgtgtcgacgctgcgcgcgtacgttcagccgggcgacgcggtgctggtccatagtcccacctacatcggttttaccaagtccatcgaggccgcgggctaccgtattgtgcacagcccgcttaagctggacgaacagggcatatggcgcatggactttgaggacatggagcacaaactcgcacaaaaccacatccatgctgctgttttctgctcgccgcataatccctgcggtcgcgtgtgggaacgcgacgagatcgagcgcgccatggacatctaccgccagcacgattgcgtggtggtctcggacgagatctggtccgacatcatccgtcctgggcacaagcacatcccgacgcagtcggtgagcgaggacgcccgcatgcgcacggtcgccctttatgcgcccagcaagaccttcaacctcgcgggcctagtcggcagctaccacatcatctacaacgagacgctgcgcgaccgcgtgtgcgccgtgtccaacaagacccattacaacgagatgaacgtcctctccatgcacgcgctcattggcgcctaccagccgcagggctacgagtgggtggacgagctcaacgaggtcatcaagggcaacgtcgactacttctgcgattacgtggacgagcatttcgaaggtgtggcctattcgcgtccgcagggcacgtacatggtgttcctggactgcacggagtggtgccgcgcacacggtcgcgacattcagtggctgctcgacgagggtgcgcgcgtgggcgtgggctaccaggacggccgtccgttccatggaccctgccacattcgcgtgaacctggcactgccgctttcgcgcgtgcaggaggcgtgcgaccgcctggatcgttacgtttttaatgcatagcaagccgtaacgaacggacgacatgcgcggggtcttctggcttgattgttatgcgggggtctgatcccagccccctacttttcgtgaatctgcttgccgcagagatgctcaatcgtaatttcgtacagctgaacgcccttgatgtctttggcgatttcttcctcgacctcttcggcggtggggtagtacttgagcgcgagctcacggaccttgtcctcgataaatgcgggggtgtcattcgctaggcggcaacggccaaagacaacggtgctctgcacgtagggcgcccaatcgtcgtccttgtaccagtcgttgccgtagacggtaaaacagaccttgtcgtcacgcttgagagcgtcgaccttgtggcccgccttggcgccgtggaagtaaatcttgtcgtgctcagcgtcaaagaagtagttgacgggaatggcgtacgggtagccgtcatcgccgttgacggcaaagacgccgcgcttgcaggtggcgagcagctcacgcgccgcctcgtcggtgatggcacgtttctttcggcgtagaggcctaaacatcgcgggattcctttccaatcgggcacatttcttggggagagactatagcgaaccggcgccgtactgtttgatgcgggcgagaatgtttttgagcttttcaaaatcgatcggcttgggcagatgggcgttcatgccggcgtcacgtgcggccttggcgtcctcggcaaaggcattggcggtcagcgcgatgatggggatgtcggcggcgtcgggcttgccgctcagacgaatcacgcgcgttgcctcataaccgtccataccgggcatcatgatgtccatgaggatggcgtcgaagctgccagcgggacgaccgacgtatagattgactgcttcgctgccgtcgttggcgcgagtcacgatgactccttcgctctcgagcagggtctgagcgatctcggcattgaggtcgttgtcttcggccaaaaggacgttcatatcgacaagtgaacagctgcctgcctgtttgtccaggtgctctcttgcttgagggttcttatcgacgtcgagtggaatttggacgttgaacgtgctgcccacgccgagttcgcttgagatctcgatggcgccgcccatcatgtcgatgagcgatttgacgatgggcatgcccatgccggttccctggaatttgctgcgggcgtcgttgccctcttgagcaaacggctcgtaaatatgcttcaaaaactcgggcgtcatgccgatgccggtgtcttcgatggtgaaacaaaagagcgcgtgtgcgtcgttgagcggcttgacggtggaagagaaggtgacggtgccgccgtgcttgttgtatttgatgctgttgtcgagcaggttgatgatgattcggcggatatgggtggggctgccgatcatactctggtcgacggcatagggctcgctggtgttgataagcacgatgccgcggtccgatgcacggagtttgcacagcaccaatgcatcgtcacagagctccttgaggttgaacgactcgtgctcgagggtcatcttgtgctcttcgatcctgcccatctcgaggatgtcgttgattagagagagcagatggttggcggcaacgcgcgccttggcacggctctcgcggacgacctgcatatcgccctctttgagctcttcaatttcgataaggcccaagatgccgttgagcggtgtgcggatgtcgtggctcatgcgcgtgaggaatgcggttttagcggcgttggcggtgtcggctttctgccgctctttccgcgcgcgttgaagcgaccagacaaggataacgatgccggagagcaaaatgcagatgataacggcggcagcggcggtgcggttgcggtagagaaaccggagtgtgtccgattcttgcgccgaatacgatgtgggggaataactgttcgcggagagcgattcgccggcattgacgatacccttattgatgattcctaaaagctggggattgccgcgcgaaatcaagcacgatagctctgctgtgttggtgagttcctgcgtttcgaaatcctcgatgtcgtaggtttcacggatggtttccaggcgcgtgctggggacaattatgcaactggcctctcctttattgagggctctgagcgcttcgctggcggttgggtattcggttaccgttgcgtcggggaacaggctctcgagctcagggcggctgacgatcgcgctctctgagcagacgatgctcttgaggtccttgcttaggtcgctgctgctgtgaatggcggtcagggaaaccgttcccatcgagtttgactggatgactccttcctgttcagcgagccagtagtcgcggaaaaaaggcagggcgacatcgatggcgccttccgaaagggcttttgccagctgcttgttgtttgagatggcgaccgttttaacgttaatgccaaatttgtcgcgcagcgtcgtcgcgagtgtggcgagcgatccttccatttcgccgtcgtcattttgcgtgcagtaggggagctggtttttaagatagcccagcgtgatggtgtttccgttcgctttgagccaggaggtctctgcaccgtcaagtgatgatgacccgctgttttgggccgagtaatttgccttgacctcgtcgttatagcgcgggttgtcgcggttgatcgctgccatcgcggagttgatatcgtccatgaggtcgggacggcttttgggaacggcgaaatagtagtcacttgacccaacgtagaacatgggggaggcgctgggcgacgagatggtgtcgttcatgatgatagcgtcgacctcgtcgtttgccagcgccgcaaagaggtcgccactaccaggcatttctttataggtgcaggtgatgccctcgctggtaagccactgctggccgacgaaggtttgcatgacgccgggattgcaaccgatggtgagaccctggagtgcctggggatcaccctttgcgaggtcgtcgcgatcgggtttggcatagatgtagtagcgctcggtgccttcggggttcgaggaatagagcagcttttgtgcgcgctcctcggagtacgagatattgggtataaggtcgatctcgcccgcctcgagcatgtccatgagctcggtgaacgtgccggagacatattcgtatttccatccgggggtgtagtacgagagggtttggaggtattcgtaaccccagcccgaaaggcgttcgcccggcgtgccttcctggaaaccctcgctgctgacgagccagccaacgcgtaccgttttgacctgctgatcagagtcatcggcaaaagccggagtaggcgcaatggcgctcagtgcggtaagcgcggcaaacacgatgaccagagcgcgatatatggataaacgaaggacggcgaaaggcttcacaagcaatcctaacgaatcgaggcaataccacgtaaggataccagctcaggtgccccgtttgggccgcacgccgttaaacgggtcgccgtttggcgcttggcaggtggggacgttcctttcctgccggcagttggggacagtccctttctgccggcaggaaaggaacgttcctaactgccggatgtgggacaataccgtgcggatgtgattgattatctgcggaaggggtcgcgatgaaaaagctcaggacgcttgccgatgtgttgcatcaggctgggttcgcccacataacaggcgtgtttcttgtctttttcctgctctgctcgacggccgtctggctgtccgagcccacgacccttacctttggcgatgggctctggtttagctttgagacggtatcgaccatcggctttggcgatattccggccgagacaccggtcgcccgcgtcatcacggtcgtcttgagcgtcattagcatcttctatatcgctatgctcacgggcgttgcagtgaactactgcaacacgctcatcaagatgcgccaaaaggacaccatggcgcgctttatggacgacttggagcatttggaagagctcgaccgcgatgagctcgccgacctatcgcgtcgcgtacgtgagtaccgccgtcggcagcgctagggcaagcgtatcgcgcagcaagggggattgcatatgaacatcacggtgtacctgggcgcgagcgtcggtagcgacccggcgtttttgcctgcggtgcaagagctcggcacatggattggcgccaacggtcacgcgctggtgtacggtgggtccaagtcgggcttgatgggcgcgcttgccgatagcgtcctcgatgccggcggccacgtgacgggcgtggagccgagcttttttatcgaggcggagtttcagcacgatggcatcgacgacctcatcgtgacgagcgatatggccgagcgcaaggcgaagatgatcgagctcggcgacgcgtttatcgctttcccgggtggcacgggcacgctcgaggagattgccgaggttatgtccgcggtgtcgctgggacgcctcaacgcgccgtgcatcctgtataacctggacggttattacaacgacctgaaggcgctgctcggccacatgattgaaaagggattatcgagtccgggtcgccaacagggcatttactttgccgaagatttgcacgagattgcttcgatcatcaatggttaagttctagattgggcgcgcattgcgcccaatggtgccgtttggggtgcagatggttggctcgtctgggcagcgctcgctctacaataaagcgtacttttgtcgactttgaccacgggagggcccgatggataagcttgcaaaacctaaaaaccgcgcgctgtttttgatcagcgtagccgtgactggcgcgctcgccggcgctgcggtctggctgttcttttttgcgatggaacacggcatcgatttcttttggaccgagattccgcacatgctgggtgctgcttcgcccgagcttgccagcggtcccttcggttgtctgccgtacccgtttttcgtctgcctgctgggcggtctgctcattggcctgtacgaaaaggtgaccggcaccaagaccgacgacctcaaccaggtgatggccaaggtcaagcaagacggacgctatccgtatgacaatctgggcaagctttcgctcgcggcattgatgccgctgctgtttggcggaagtattggaccggaggccggactgaccggcgttatcgcgggcctgtgcagctgggtcggcgaccgcatgcgtcgctttggtgtcgagtttagggaactcacgctgctgggcacccaggccgcgctgacggcgctctttaccgcgcccgtctttggctttgtggcgccgcttgccggcagcgccgatggcgatgaggattccgcatctgatgagatcaccattaagcttcccaaggcgcaaaagaccgtggtctacggcatcgcgattgccggtggtctgggcacctacctgctgctcggccagtttatgggcggtggcatgggcatgcccaggttcgaggctgccgaggtgggcaacctcgagctcacctggctcattcctctggcgctgatcggcaccgtctgcggttggctgtactttgtctccgagcacgcgagcgaggcgctgtcccacgctataggggggcgccccgtcgttaaggccatgctcgcgggcttggcgcttgcggcttgcggaacggtcctgccctacaccatgtttgccggcgagacgcaggccgacgtgcttatggaaacctacttcaccatccccgccggtgtgctcatcgcaaccggtctggtcaaggctatgctgacccctgctctcatcaacatgggctggcgcggtggccatttcttccccgtaatcttttcgggcgtgagcctcggctacggtttcgcactgctcacgggtgccgatccggtcttttgcgttgccgtctgcacggcctcgacgatgggtgccgtcatgcgccagcccgtcatggtcgtgggcctgctgctcatgtgcttcccgctcaagggcatcgtctgcatgattatcgccgccgtcatcgccgccggaattccgctgcccaagccgctgcgcaagtagtgggcggcccgttttgggctgattcataatccgttttgaaagaagccgtgcggggccgtatgtctacggtctcgcacggctgttgtttagagcttcttcagcacgatggcgatggtgttgagatactcgagcgcgccggcttcaacggcggcgcggtcgctcgctgcgtattcgttgtcgcaagcgagccagtctgctcatgcctcgtcggtgcagagcatgggctgcatcgagacaatctcgacgccggcggtcggctcgatcatggcgcgccaccaggctatgtcgtgcatgtaatcgagctgctcgggcgtccaggatttgagcaggcaggcgggtaggttgttgtgacagtcgcaggccatgccggggatgctcaggtaaagcacgccgccttgctttacgtaggggagcagacgctcgcccagataatgcgggtcgcgcccgtaatagttgtacgagtcgatgctcacgaccgcatcaaaaaagtcgtgctcaaacggcaagcctttcgaggcgtccgcctgtacggggtgaatcgtgtcgcgcgaaatgccgagtgaatcaaagaacgcgcggttctcctcggggtcgctccacagatcgacggcgtaggtgtcaaacccatattcgcgggcgagcagggcactggtgataccggtgcccgatccaaggtcgcagacgcgagcgccgcggggaatacttgcatcgcaaaggagctcctcgcagagcttgaggggattgggccccataatcttagagcgcacgagtgccgtatcgaagctgttggcttttgggaaggattgagattcctgggatttcactgttctttcctatcaggtgcaaattggcagatgacgggggcggaacggcgcaacaaaccacggccgttggacggccgttttcatggttctatgcgattgaccgttccctaaagaacaatgaccaaaaagacatccccttggatgatcgagattgggccaaggcccgtgacgtctctattgtaagacgtcacgggcgtgccggggacatgtcgtttgtcatgtattcgtattcgctgacgaccgattgtgcccttgcgcgcccgaggcgcgtctggctacaggtcgcgtgttcgatagatcttggtgctgacggtgcagctgatcatgaatagcacgaacgccgcgacggcaattccggcgcacagaaagctgatgacggcggggtcggggttcgctccggcaaatgacatgagccagttgctgatgggattggaggagctcagcattgccatggtgccgcagccaaacagggcaaacaggccgacggacaggcgcagcgcctccatgtgtccaaatcggaagaatatcggctgtgccaaaaacaccatcatgagggagataagcatcgacgccgccgaggctgttgcgatttcaaagaccgtctggcctgtcgaagggatgcccatgtggtcgaagaacggaagggcgaggatgttcagaagcgtagccgcgcatgccataacggccgagaaggcaataatgcacaggtagcgtgcgcagacgatgtctttgcgcgaaaacggcagcgttgcccgatagcgctcccagccgttttggttatcgtagccagctagcgagttcatgattatgatgggcgacatggcgctgaccgcacaggtgccggcgctcatgccggagtcgccgtccgtcgcgttggcaagggtcagcacgacgaagatgaacaggccgacgcccgcgatgctcgggagaaacgagcgcatgatggcggtctcggatataaaggcgcgtttcatttggaggctcctttcagcgtaaggcgcaggtagtcatcgatggaaatccggtcacagggaatctcgggaaaggcctcgagcgcttcgcggcgattggggacgagtacgtccacgctgtaggcatgacgggtggcgcgggcgccttcgacgcaatccatgagctcggcggcttgtgcctgggtacagtgagcgatgccggcgcggtcggtaatgtcctcgcgcggcaaatcgaacacaatcgagccgttgtcgatgcagacgacacggtctgccgcgcgttcaaggtcggatgtaatgtggctcgagaacaatacgctgcgctgtccgtcggcgacaaaggcgagcagctcgtcgagcagctcctcgcgtgccataggatcgaggccagccgtggcttcgtccaagatgagcagctcggccttgtggctgagcgcacacgcgagctgcagcttcatgcccatgccgcgggagaggtctttgaccttcgccttggggtccagaccaaaccggtcgatgaggccagcaaacgtttcatgactccacgtggggtacgccgggcttacgagtgtctcgacctcggccaccttgagcgtggaagggaaggggcacgtgtccagaacgagaccgatgcgagagcgcacgcgacgttggagttcatcgggcgcattggcatcgcagcgctgtccaaacagatgcacctcgccggcgtcgagctttatgagaccgagcgcggcacggatggtcgttgtcttgccggcaccgtttgcgcccacaaagccaacgatctgaccgggctccacggtgagtgtgacatcgcgcagcgaaaagcggtcacttacgcggcgtgagacatctttgagttctagcaggttttgcatggtatagcctttcttgcagatggctactgcatggtttcgggggctaccaggtcgagcatctcgtgcaacttatcgcgcgtgacgcccagggcttctgcctgtgtcgctgcctgtgcaagcagatcttcgacatggcagagctggttttcgcgcaagagcttttggttgccctcggcgacaaagcagcctttgccttgcacggtacagataaacccgagttgctccagatctgcataggcacgcttggtcgtgatgacgctcacgccgaggtcgctggcgagcgcacggatgctcgggagtttggctcccgcggcgagtgcacccgatagaatctgggccttgacctgcgaggatatctgctcgtagatgggcttgtcactcgaattggataggataatgtccacagcggctccttagctgatgggctacacgtgtatataaccggtaagcacagtatatatacactatgcacagttatgcaagaggacaatcaggatgaccggtgaccttttgtctcgatctgtaacagtaagagggtcaaatcgggtctaactgttacagattgagattttgacggcaggccatccgtttgtctcggtctgtaacaggtagaggttcaaaacccgtctagatgttacagaccgagacaaactgctgcggagtgccgccgccgaccggtatccaagctccgactgatgaatttgtcctgataggtgctctgccgcagcatttcgcggctacaatagacgggttacatcgacgtaatgcatatagaacgcaagaaaggatccgcatggcaagcctgtcggatgaaatctcgtcgcgccgcacattcgcgatcatcagtcacccggacgccggtaagaccacgcttaccgagaagctgctgctctacaccggcagtatccagaccgccggctcggtcaagggcaagagctcggccaagcacgccgtttcggactggatggacatcgagaaggagcgcggcatctccgttacctcctcggtgttgcagttcacctacaacggcgcctgcgtcaacatcctcgatacccccggccaccaggacttctcggaggatacctaccgtaccctcatggccgccgacgccgcggtcatggttatcgacggcgctaagggcgtcgaggctcagaccaagaagctctttaaggtctgtacgctgcgccacattcccatcttcacctttgtgaacaagctcgaccacgaggcccgcgatccgtttgagctcatggaagagatcgagaacgtcctgggtatcaacacgtatcccatgaactggccgatcggcagcggtcgcaacttccgcggcgtgttcgatcgccagacgcgtcgcgtcatcgcctttgagggcgacggtcacgccaacgccaccaagaaggtcgccgaggtcgaggcggagctgggcgatccttccatggatgagctcatcggcgaggaaaaccacaagaacctgatggacgacatcgagctgctcgatggcgctggtgacgagctcgatctggatgccgtggcctgcggcaagctgagcccggcgttctttggctcggcgctcaccaactttggcgttgagcccttccttaaggagttcctgcgcctggccccgacgccgcgcgcctataccgacacgctcaccagcgagccggtcgacccctgccgcgacgactttagcggcttcgtctttaagatccaggccaacatggacaagaaccaccgcgatcgcatcgccttcgtgcgcatctgctcgggcaagttcgagcgcggcatggacgccttccacatgcagggtaaccgcaaactcaagctggccacgggcacctcgatgatggccgacgaccgcgccatcgtggacgaggcatatgcaggcgatatcgtgggtctgttcgacccgggcatctttagcattggcgataccgtgtgctccggtaagcatcacgtgcagtacccgcagattccgacgttcgcgcccgagatgttcgcccgcatcacgcaggtcgatacgctcaagcgcaagcagttcgtgaagggtatggaggagcttgcccaggagggtgccatccagattttccgcgagctgggcgccggtatggaaagcgttatcgtcggcgtggtcggcgtactgcagtttgaggtgctcgagcgccgtctgaaggccgagtatcgcgttgaggtgcgtcgccagccgctgccctacaccgacatccgctggattcagaacgaccccgataccatcgatatcccgggcctctcgcttacgcgcgacaccctgcgcgtcgaggacatgcgcggcggcaagctgctgctgttcacgagtccgtggaacgtggactgggcgaccgaccacaaccccgacctgatcctgtcggagtttggcaacgtaacgttttaacacatcggcgcggtgaccttgcggggctgccgcgctctttgcttgcctgccgccggcggagcggctatcatacccaccgtcgtctcaagaccggggcggccgagcagttcgggtccgatatcctgctcgttaaacccaaaaccaaaggagtacataatgatcaagaaggtcatggaggactacaaagtcctgttgcggagcattcccgcggcaacggtttcgctgtttatcgtgagcgttatcatgatgaacttgctggccaacaaagagctcatcagcctgccgtatctggcactcgactgcggctttgtggtgagctgggtctcgtttttgtgccaggacatgatttgcaagcgctttggcgccaaggcatccatcaaaatctctatcctcgcactgctggttaatctggccgtgagcctgtgcttttggctgtgctcgctcacgcccggcatgtggggcgcctactacgacacgggcatgatcgaggtcaacactgccctcaacgccacgatcggcggcacctggtacgtggtgtttggctcgtcgctggccatgcttacctctgccgtggtcaactccacgctcaaccagtcgctcggccgcatgctcaaaaagaataactttgcgagctttgccttccgttcctatgtatccacgggcattggccagtttatcgacaacctggtcttcgccattgtggtgagccacacgttctttggttggacctgggtgcaggtgtttatgtgctcgctgaccggcgctgttgccgagctgctgtgcgaggtcttcctgagccccgtgggctacaaggtcgtgcgtggctgggagcgtgagaatgtgggcgccgagtacctcgagcgccacgcaaccgcctaaggagcaagtatgcgggttttgatcacgggcgcttcgggcggtatcggagccgcgtgcgtgcagcgctttttggacgagggccacgaggtcgtgggctttgacctgctgccgacggcggtcgagcacgagcgctaccgccatctgatcgttgatgtccgcgaaccggactcgtttccagacgaccttgaaccccaggtaatcgtaaacgttgccggtacgcaggattcggccgacgatatcgccgctaacctgtgtggcaccatcaacgtgaccgagcgctacgcctttgtgggggaggggcttgccgccaagccgacgccggctatcaaatccgtggtcaatgtggggtcggcgagtgggcatacgggatcggagtttcccgcctatgctgccagcaagggcggtgttatcgcctacaccaagaaccttgcaaaccgcctggcgccgcaggccatcgccaacagtgtggacccgggcggcgttatcacgccgctcaaccgttgcgtgatggaagacgagcacctgtggaaccagattatggagctcacgccgcttaaacgctgggccaccgcccaagagatcgccgagtggatctactttgtgggcgtgaccaaccggtttatgaccgggcagagcctgctgatcgatggcggcgaggccggccgcacccagtttatctggcccgagtagaaaacgcgcccgatggcaagattgccgtcgggcgcgtttttgatgtattgatttttagccgaggcaagtccagttgacgggggtcgagccgtgctgttcgagtagccgattggcagcggagaaggggcgcgaccctataaaggcggggagttctgccgtggcgcggttggccgaaagcggcgaggggtgcgtagaagccaggcagaacttgccggttgccttgcccgtgccgatcgcgtcgagcttaccctcaaccatttgctgagcaaagcggccccatgccaaaaagacgaccggctggggcagctgacagcagcgttcgataatatagtcggtgagcgtgctccagtccagcttggcgtgcgaattggcggcatgctcgcgcacggtgagcgtggtgttaaggagcaggacgccctgttgtgcccatggggttaggtctcccgtggcaggaatggggcagtccagatcggctttgagttccttatagatgttgcgcaggctcggcggcaacttggtttgcgtcgcggggaccgagaacgataaccccatggcctggttgggtccgtgatagggatcttgacccaagatgacaactttgacctggtcggccggcgtataggcgagggcattgaggatgtcgtcttgtgccgggtagatggtttgctcggcacgtaaaagggcgatgcgctcgagcagctggttcgtcgtgtcacgtaccggctgcggcgcatcgcccaaccaagttgctatgttgcggtcgcgagttgcggtgtccatggggctcctttatggcagatgctctgttggcatctattgtaaaggcgcaccggttgcctttatgccgcggctgcatgaagagtggggtctacgagacgcgctcgggcgctcctgccatgtgagcgtgtccttgcgagcgaaggcgcgggagctcgacggttgccaccatcacgccggtgaggatgagggcggcgccaaagaaggcgatggggctcaggacctcgccgaccaggaagaacgagaagacggcggagcagaccggctccagcgagaaggcaaagccggtggtctcggcgggcacgtggggctgcacgagcgtctgggtgataaagccgtaggcagagcagatgagtgcgagcgcgacgaccacgacgatctcgttgggcgtgctgggaagcgtgaagccgccaaaggtgcacgcggcgatgcccgagaacaggccgccaaagcccagctgccaaacacccaaggccagtgggtcgacttcttcgacaaagcgcttggctacgataatgtggctggcatagataaaggctgagagcaacatgatgatcgcgccgggattcaggctggtaaagtcggcgcccgagagcagcagcataccgcaggtgacgatggcggtgccgataagcaccttgcgctcgggggcgcaacgcagcagggcggcgttggcaaacggcacgatcacgaccgtcaggctctgtaaaaagccggcggtggaggcggaggtaaggctagagcccaaacacatgcaggtgagctcggttgccatgatggcgccgatgatggcggcgcgaaccatgaggtcgcggttgatgcgcagcgcgtgcttgtggaagagcagcaggcaggccacaaaggcgatgatgcagcgcagcgcaacgatgctcgtggcgttcatgctgtccatgccgatcttcatgagggggtacgaaaagccccatgcgacgggaacggaaaacgagagcgcgattgcttttttgcgatccatgggactccttttgttacagaacggtttcgcaaaaaggattctgctcctagattttgatgtagtaaagcgaatgtatcttcagtatgattaagcaatactaatgtaggtagaaaaagccctggcaaaacgttttacggctacaccgatgtggaggcacgatggcatcgcgatatcagattgtatgtatggtggtcgattgcggcagtcttaagggcgcggccgacgagctaggctatacgcaaagtgcggtgagccaggccgtcaaggcgctcgagcgcgagctgggcaccacgcttatcgagcgcggcaagcagggcgtttcgcttacgcgcgacggcaagcagtacctgccgtatctgcgccagattgtaactgccgaggccgagcttgagggcaagcgccaggaattgctgggactctcctcgactgatattcgtatcgcaacgtttaccaacgtgagccgcaccgtgttgccgcgcgtgatccgcgactttggtgccctgcatccgggtgtacgctttacgctcaaacagggcgattacacgcgcaatgcccagtgggtgcacgatggcgtggttgatttttgctttacggcacgcggatttactgctgggctcgagaagcgcgtggtctatcacgatgagttggtggcactgttgccggccgcgcatccgctgacggcaaaggaaaaggtgacgctcgccgacctggcgtccgagccgtttgtgctgctggatgagggcgaacagagcctggtgctcgatgcattcgcggcgcatgggctgtcgccgcacgtgacgagcgaggtgaccgacgactacaccatcatggcgatggtggaggagggcctaggcgtgagtatgctgtatcgccgtaccgtcgagggcatgagggccgatattcgcgtgcgtcccatcgtgcacgctccctcgcgtgacgtggtggcagcctggcgcagctgggacaccatgcctatcgccacgaggcactttatcgactatatgagctcgcatattgtcaattaatgactggcatggcgttgagtgcggtgtttagcgggctgtcgctttggcttgggcggcgcgataggtgcgtgccgggtggcagagtagtaccgccacgaccataaagaacgccgtggtgcccaggctgatggggtagaccatcatgatgttcgcaaaggtgcggaaatgcgggaacacgcagaatacccaatagaagcgaataccgcagacgcagatcatggtgatgagggcgggcatgagcgagatgccaaagccgcgcaggtagccggacatgttttcgtagaacatgctaaaggcgtaggcagggaagatcgaacacacgcggatgtagccgatcgagacgatgttggggtcgctgttaaagagcgataggatctcgcgccccagaccgacgataacgataatcgtggtgagtgcaacgataccgccttcgatcaggcagaccttgagcgtcttggtgcagcggtcgatttggcgggcaccgtggttttgtcccacaaaggtggtgcaagcctggctaaagctgttgagcaggttgtagcacacgtactccaagctcatggcggcgcttgatgccgccatgacctcggtgcccaagctgttgatggcggactggatgatgatgttggcgacggcaaagacagcgctttggatgccggcgggcaggccgatcttgacgatgcgcttgagggcgacggggtctaagcctaagtcgcgtggggtgacgcggacgacggagtcggtcttgagcaggtggacaaagagtgtggcggcgctgacggtgtaggcgatggcggtggcgatggcgacgcccgcgacgccccagtggagcacggggacaaagatgaggtccaggccaatgttgaggacggtggacacggcgagcgcctgcagcggcatgcgggtgatgccgacggagcggaagatcgcggcctcaaagttgtagagcaagatcgagggcatgctgagcaaaaagacgcgcaggtagagcgaagcgagcggcatggtctcggcaggcacgttgagcgcagcgagcatgggctcggcaaagatctcgcccagtgcgatgacgacaaagcccacgagcgccattaaaatcgaggtatggacggcgcgtttgaccatgttctgatcgttgcggccgatagcgttggcgatgaccacgttggagccaagcgacatgccaataaaaaggttgagcataagactggtaagcggaacattggagccgaccgccgccatggcgagggttccctggtcgcccgagaagttaccgatgatgaccgtggcgatgaggttcgacagctgctccaagatgctcgtggcggctacggggaaggcgaacaggggaatattgcgccacagcgagccggtagtcatgtcaatgtgcttagatgcggtgtctgccatacgctctcaatctctaatatgctctttcgtgcttatttgcgcagacgatgatactcctaatgcagccagccggcacttagggacgttccttttaatatgagcaggacattgtcaagaggcaaaatcgggcccggcatagaccttctggtcatgccgtcctctttgaatgacaagttgtcgctctggcgggcgcgcagcgtcaactagttacgcggttcgtagaaccgcgtaacccctaaaaacggttgccgcggaagccgccgccgttgcggccgccacgatcgccaccgcgaccgccacggtcgttgccacggttgccgccgaagccaccacggttgccaccgcggtcgccatagccaccacggttgccgccgaagccgccacgaccgccacggtcgccgccacggtcaccaaagccaccacggccgccgcgatcgccaccgcgaccgccacggtcgccgccacggccaccgcgatcgccaaagccgccacgaccgccacggtcgccgccacggccaccgcgatcgtcgcgaccgccgcgaggaccgcggtcctcgtccaggcccatggcgacgagcggggcgataaccttatcgagggcagccatgagctcggtggcctcctcgtaagaaagctcgggcagcagcttctccttcttgttggcaagctcggtcaggccctcggcagcatcctcggcagcgaagacgacgatcttgcgcatgtcgccctcggcgtcgtcgatgcgaccgaccaagtcggcagcctcggcctcggccatcaggccatcgagctcacggaggcgcatgcccagcaggtcggacatctccttctgctccatcttgggcttgaggtcaaggagcttaatggcacgctcgatgttcgccatgcgctcggccttggcctcctcctccttggaaatagcaaagcgacggctgcgcagcaggcgggcggccttctgcatcttgtccatcagctcttcgtcatcgtaatcaacggcggcctcgacaacctcggcctcctcctcggcggaaacctcgtcagcagcctcaacctcggcagcttcggtctccacggtctcgactgcctcaacctcggcagccatggtctcgttctcggtctcgttcatgatctcttcgttctcagacatgagactccttcttggccctctcgggcatcatcgccccattcgcggggcccgtcgcgcactcttttgcgcttataaatcatgcctctcggcaaaacgtccattagtttatggtgtcgtccgtcaatctagctgcagaatctatgtgcacacattaatgcgacatgtcgcggtatcatggcttaaatcaaacgcccaccataaggagcccgccatgatcaaacccatcatgaagtccgagttctttttacgcctgccctccgaggacgccggccccgaagatgccgcgaccgggcaggatcttctggacacgctgcacgaacacgagcatgagtgcgtgggacttgccgccaacatgatcggcgtacgcaaacgcatcatctgcgtaaaggacggcagcaagtcgatgctcatgtacaacccgcagattcttgagcaggtcaacgcctaccagacgagcgaaggatgcctttcgctcgtcggtgagcgcccttgcacccgctatcgccgcattaaggtggagtatctggacgagaacttcgtccgccgcatcaagaacttctcgggctacaccgccgagatcatccaacacgaaatcgaccactgttatggaatagtaatttagcgccgattcgaaaaagctccctgcagccaagcaactgcagggagcttttcatagtgcggagcttctatcccattagctctgacgataatggtcgaagaagtcggcgaggtcttcgagagactctttgagcacttccatgcgcggcaggtacacgatgcggaagtggtcgggctcggcccagttaaagccgccgccgcgcgtgatcaggatcttcttctcgtgcagcaggtcaagggcaaactgctcgtcgtcggtgatgttgaacttcttcacatccatcttggggaagatgtagaacgccgcgcgcggtttgaccaccgagatgccatcgatcttgctgagtgcctcgtacacaaagttacgctgctcgtagacacgaccacccgggcggatgtagtcgttaaccgactgatggccgccaagcgccgtctgaacgatcgactgagccgggacgttggagcacaggcgcatgttcgaaagcatgttgatgcccataataaagtcgctcatgcaacgctggttgcccgaaagcaccatccagccaatacgatagcccgcgatcatgtgcgacttggacaggccgctaaaggtgacacagggcaggtcgggagcgagcgaagcaatcgagacgtgctcgtagccgtccatgcacagacggtcgtagatctcgtcggcaaaaatcatcagctgatgcctgcgcgcgatctcgacgatgccttcgagcacctcgcgcggatagaccgagcccgtggggttgttggggttgatgatgacgagtgccttggtcgcgctcgtgatcttggactccatatcctccaggtcgggataccaatccgcctgctcatcgcacagatagtgcacgggatgaccgccggcaagggttgcgcacgccgtccacagcggatagtcggggctggggatcaaaatctcgtcgccattgtcgagcagcgcgtgcatcgaaagctgaatgagctcggacacgccgttgcccgtgtagatgtgctccatctgaacgttgggcaggcccttgatctgcgagtactgcataatcgccttgcgcgcagagaacaggccgcgcgagttggaatagccttcgcagtcgggcagttgctggcgcatgtccttaatgacctcatcgggcgtgcggaaaccaaaaggcgccgggttgccgatattaagcttgaggatgcgctcgccctcgtcctccatgcgggcagcctcgtcgacgacggggccgcgcacgtcatacaggacgttatcgagcttggtggatttagagaaagtgcgcatggtagtgctccttgcaatttgagccgtgggactaggttcggatttggcaacgttatgggacgagggcgtctcgccttggtcggcgtcaccggcgagcagccaggtaacatcgacctccaaaatacgggcgagcagctctgccacatcgcgccgcgggatcgtcttgccgctcacatattggctcatctgactcttgccgagttttttgccgagcatctccgatgcgcggatcacgtccgactggcgaacgtcgcgatcggacatagcctgtcgcaggcgatcgctaaacgtttcttgggccactagaacctccttgctggcaaagttcaatttatagaacacgaattgaacctgagttcaatttaggcagcagtatagcgcggcacatagtacgaaagttcaatttcacaaagaaatgctccaagttccaagatttgctccagagcagataacagtgtgcaccattagaggtatttgagaaaacgagccgccgcaagcgaaacgtcggccgtgcgatatatggcattgatttgccgatgaggatgcccctccagcggccggatagcgacatcaaactgacagcggcgcaagatgagtgccggaagaacactcacgcccaatccgtcctcgaccatggccatgatcgcatagtcatcccaggtcgacagcttagagtgcaccgttaggcccgcacggcgaaacagcggcgtaatctcgtcgtcactaccgcgttccagcaggataaactgctcgttgaccaaatcggcaagagaaagggcctccgcggcggcaagcggagagctcactggcaccacagccatcagctcgtcttgcaccaacggccgcgacgtcatacctacgccgcgtggctcgcgcggaataaagcccaggtcgcatcggccttccgccacccattgctcaatttcggagtagtcacccatcagcagttcgtaatcgacatccgggtgatcggcgcgaaaccgtgcgatgaccggtggcagcacatgggtcgccacactcgaaaacgtaccgatacagattttgccgcgcataagcccgcgcatctcgtccacacgtcgctgcagacggccaaactcttcgcacaacgcctcgaccgccggcatgacctgccgcccgtcggcagaaagcaccacaccctcgcggctgcgatcgagcaccttaaaaccccagtcggcctcaagatcgcccaccatacggctcacgcccgactgcgaatagctcaggcgctcagcggcgcgcgtaaagctgccggcacgcacggtctcgagcagtacttgcatcttttggatattggtctccacggcacgccccgtccttgcatgagtatttgtcatgtctcctatgcattatattcgcttttcttctattgcccgctactccatagtggacttgcacggatatagaggggatgacagtgtatgaacaacggattgcttacatacttagcagcattgctgctgtttggctccaacggcatcatcgccgctgcgatcgcgctgccgagctccgatatcgtgctcctgcgaacgtttttgggtgcgctctcactcgttatcatcctcgtcgctacgcaacgccataagttgcaggcaccgtctcgtccccgcgaagccgcagcccttatcctctcgggcgccgcgctgggtgccagctggatattcctgttccgcgcctaccagacgatcggcgttggcatctcttcgctgctgtattactgcggccccatcatcgttatggccctctccccgctcatttttggtgagaagctgaccggcagtaaaatcaccggcttcatagccgtcgcctgcggtgccttcctcatcgcggcccaaggcctcggcggcaatatgcccatcgcaggtatcgcgtgcggcatcgcctcggccttctgctatgcgctgatggtcatcgccagcaagggggcaccgcacatcgagggcctcgagaactccaccctccaggtgagcgccgcctttgcgaccgcgctggttctcacgctcatcacgcaaggcgtcccctcgtttttctcccccagcattgccaccggcatcgattggcgcgccgtcgccatgctcggtatcatcaacaccgggctcggttgcctgctctactttagcgccgtcgccaaactgcccgtacagaccgtcgccgtcgtcggctacctcgagccgctttcggccgtcgtcttctccgtcgcccttttgggcgaggccatgacgcccatccgtctgatgggagccgcgctgatcatcggcggagcgatcttctgcgaactcgccggcagacgcgcaagcgccaagggcagcatcgctcaggcagtgcgcgcctaacagcccctcttcatgtttcaaagcaggacgcgtccgcgactatcacgttgcagcaaatcgcccagcgagtgtgtccctgttttgaaatgtcgcccgtgcaggcagctactccccagctggggattattgtctaaaacactccgatgtgccaaactgctcttatatgtataaagacggcataaaggttatctgccctcggcagaaaccagatgtctaagggagtccacgtggcacacaacaaactggagacaagtctccaagaccagcagagtcagggcgggcacggagccatccccctctccgctggtatgctgctcgttacgctcggcgtcgtctacggcgacatcggcacgagccccatgtacaccatgaagtcaatcgtcgccaacaacggcggcatcggcaccgtcagcgaggacatgatcctgggcgcgctttcgctcgtcatctggaccatgacgctcgtgaccacggtcaagtacgtggtaatcgccatgaaggccgacaaccacaacgaaggcggcatcttcgccctgttcagtctcgtgcgcaaggtggcgccatggctgattctccccgccatgatcggcggcgcggcgctgctcgccgacggcatcctcacccccgccgtcacggttaccacggccatcgagggcttgcgcactatcgagtggggccacgcgcttttgggcgacggccagaccaacgtcatcatcatcaccatcatcattatctgcggcctatttgccatgcagcgcgccggtacctcgtcgatcggtaagctgttcggcccgctcatgacgctgtggttcctgttcctggcaggcgccggcctgttcaacatgctcggcaacctgtccatcttgcgcgcgctcaaccccatccgcggcatcatgttcctgttctcgcccatcaaccactcgggcattatggtgctcggctttgtcttcctgtcgacgaccggtgccgaggcgctctattcggacatgggccacgtgggcaaggccaacatctacgcatcttggccgttcgttaaggcggccctcatcctcaactatctgggccagggagcttggctgcttgccaataactccaacccccagatgctcgcgatggatatcgtcaacccgttctacatgatgcttcccgaggctctgcgcccctttgccatcgtactttcggccgtggcggccatcatcgcctcgcaggcgcttatcaccggctcgttctcgctggtatccgaggcaacccgcctcaacctcatgccgcacctgcgcatccactaccccagcgacaccaagggtcagctctatattccgctcgtcaacaacatcatgtgggtcggctgcatctttattgtgctgctgttccaaaactccgagcgcatggagagcgcctacggtctcgccattaccgtgaccatgctcatgaccacgacgcttttgacgagctacatcgccggcatcctcaagcacaagctgggcgcttgcgtcttcgccctgctctttggcgccattgagctttgcttcttcgcttcgtgcctcaccatgttctttgacggcggctatgtgatgatctttttggccgcactgctgtttggccttatgtatgtgtggcgccgcggtaccgccatcgagcgtacgcagacgattctgctgcccgtctccaagtacatcgaccagctcaatcgcctgcgcaacgatgagacctaccccgtactcgccgacaacctggtgttccttaccaacagccccgacccgctcacgctcgaccgcgatgtgctctattccatcctggacaagcaccccaagcgcgccaaggcatattggttcatcaacgtgcacgttaccgacgagccttatacgcacgagtattccgtcgagacctttggcacggacttcctgttccgcgtgcgcttgaacttgggctttaaggtcaaccagcgcgtcaacgcctatctgcgccagatcgtcggtgacctgatggcttcgggagagctgccaccgcagcaccacacctactctatctacgagacgcgcggcaacgtgggtgacttccgcttttgcatgctgcgcaagatgctcgcccccgagacggacatcaaccgcaacgaccaccgcgtcatggccatcaagtatgccgtccgtcgcgcctgcggaagcccggcacgttggtatggtcttgagaactcggcaatcatcatcgagtacgtgccgctctttgcccgcatgcgtccggcagtcaagctggtacgcacccaggttccgctcgaggttcaggtcgaggaggccgaggaaatggaagtcgatatcttctcggacgacctggtcaacggcaacgaggccggcaagagcatgaatgtcgaccccaccgagcagctcgaaagcgtcgccgacacgcccgaacagcagcagctcgacggtctcgagagcacccagctcaacgacgccaacttctaaaacaccgtcagctatcaacgataacggccctgcatctcgccacgagatgcagggccgttttgcgttgcatcggaccggaagactacgagcgtcgcggctcgggagccacgagcttatcggggctcgcgccctcggcatccatcaggctcacgtagcgaatcgacgggtcatcgtacgttgcgtaatagtaattgcccgtacgtgcgctaaagcatccggtgtagatagtcttctcgaacttgccatcacccatcttggacgcaccctcgatcatcgccacgccctcgagcgtgcggaacatgcgaatgacgttctcggcctcgctgtctttttgtgggtaattggcgttaaggtacgccgcctttacaaaacggctcggcgaatagcagtcaccgggaatgccgcgcatgccggcgccggcgccatagggcttgagctcggcgccgcgccacgttgccgtctgcggaaaatcgttcgtggcggtgatgtaggtacgcaggttttccatgtgccacgggaaggtcggctggttggcaagggtgtcgaccgggtcatcgtacacatgcaggccgtcggccatcatctcgaccacaatgctacgctggccatcgccgataatccagtggagcagcgatacgcccagcccctcgccggcagacttggcgacaatcaccgtgtcgcgcagcgcggcctcgacctcatcgaccgtcgagaacgtcgccgccacccataggggaaactcgtaggccgcgatattggtcttgccctcgacagggccctcggcatactcggcatagccgggaaagttaagtcccgccacggccagtcccgcatcgttaccgcagtcgaaatacatagggtagttcttgtaatcaatacacataccgattaccgcgtgcgcggccgtcgcgtcatccataaacgaatacggaatgtggaacccgcgcggcatcacgcggacctgctggccatagccaaaactccagtcgaggttgcgacccaaatacatatggccggaattatcggtaaatcgaatgctcgtgcacatagcgcctcctagctaaacgttcttgctaggttcattgtcaccaaacaacagggcgctaaacaaagaagcccggacatgacaacaatgtcacgcccgggcttatacaagcaagataaactcaaccaagtcaaccccgcaggtcgtctaaggggtcaaagtgccgcagattgccacgaaaaaggagcgaagcgtacttaaggtacgcgagcgacgattgagcggcaaggtgcggtgctttggtccccttagaccaactttcctagacaatggtcgatcatatgttggaccatctgtgcctcgaagccgacaaagtcttgcttgcgctcgcgcatcttgccgtcgacgatcacgtcaaaggcgaccttgcacttgatgtagcgcgtggacttggtgatctcctcgtgcgtcaggcagctctcctccatcttgctggcgcccaggccaaacaccagacgggggttgtagagcacatggggctcgccggcatcgtccaggtagacgcagaccttcttggtgatgccgatctggttggcggcaaggcagccggcatcgtcgagcgacttgatggtatcgatcagatcttgagccaccgactcatcctcgacggtcgcgacctcgcaacgctgggacagaatagcctcgtcgtggcagagctctttaatcatacgttcctccataggggtcgttgtaacggcttaagtatacggtacctacacattttcatacggaaaataccgcccgtctgctacattgcgccgaacatcaacatgtggggaacgccaatcttacaaaggcgatatagtaggtgagttcgtgtcaatcggcctaaactcggggccgaacaaggaaagggtatgcatggacgaactttttcacgtcagtgagcgcaagtccacaatcggaaccgaacttcgcgctggactgacaacattcctggcgatggcctacatcatcgccgtcaaccccgcggtactctcgggcgccggcatcgatacgggagcgctcgcctgcgccacctgcctgggcgctggcatcatgaccatctgcatgggcatcttcgccaaccgccccctcgcctgcgcgtcgggtctgggaatcaacgccatgatcgcgggcatcaccaccaccatgtgcggcggtgactggcacgtggccatgagcgttatcttcctcgagggtgtcgtcatcttgctgctcgtcctttgtggcctgcgcgaggccatcatggacgccatccccgtcgtcctgcgccacgccatctcggttggcctgggcctgttcatcgccatgatcggcctgtgcgacgccggtatcatcaccgctggcgccggtacgctcgtcggcctgggcgacatcacctcccccacctttatcgtcggcatcatctccatcatcgtgacggttgccctggcttcccgcaacgtgccgggctcgttgctcatcggcatcatcgtcgccgttatcgccggtatcccgctgggcgttacccacgcccccgagggcctcatcgccccgctcaacttctcgacctttggcgctccgtttgccagcaccgccgacggcaatcttgccatcgtgaaggtcctgaccgacccgatgctgctcgtcgttgccttctcgctgctcatgagcgacttcttcgacaccatgggcaccgccatggccgtcgccaagcagggcgagttcctgaccgaggacggcaatgtcgaggatatccgccccatcctggtcgttgactccgtggccgccgctgccggtggctttatgggcgtctcctccatcaccaccttcgtcgagtccacctctggcgccgccgacggtggccgcacgggcctcacctccgtcactaccggcgtgctgtttatcctcgccgcattcttctcccccgtcgtctccatcgtttccagcgccgccacctgcggcgccctggtctacgttggctacctcatgatgagcgaggcctccgagatcgactggtctgatgtctcgcagggcttcccggcgtttatgatcgtcgcgggcgtgcccttcacctactccatctccgccggcatcggcctgggcttcatcgcctacgtggtcgtcgcgctctttaagggcaaggcttccaagatcaagccgctcatgtggatcgctgccctcgccttcctcgtctacttcttcgtggcgtagcggcaaggacgctaaagtaaaacaacaaggcgcggagccgctcgatgcggctccgcgcctttcttttgacggtcagttgcacgctgacgtgcgacaatcgtggcatcgatgtcaccacgttgagagaagtttgccatggaaacgcaccaaaagcggattactgtttattcaggacatacggaaggtgcacccgttatctacctccccgtggttatgggcgacggcagtgatgtctatgtccgctgccaagagctcgactgtccgccgtttacgctcgttgccattggcgggctcgattggaatcgcgagctgagcccctgggcatgcgatggaactgtacgcgatgccgagcctttcggcggtcaggctgccggttttcttgatgagttgctgagccagattataccgcaggccgagtcatcgcttccccagccgcccgtctggcgcggcattgccggctactcgctcgcaggccttttcgcgctttgggccctctggcaaaccgacgcctttgaccgcgccgcgagcgcatcggggtcgctgtggtttccccactttgtcgatcgtgccagcacggagccgtttgtcagcaacccgcaagccgtctacctgtcgctcggtaaaaaggaaaccaagacgcccaaccgcatgatgggacacgtgctcgacgacacgcgcgcgatggaaaagttactcgtcgagcgtggcattccaacaacgttgggactcaaccccggcaatcattttgcgcaaaccgatttgcgcatggcgctcggcatccactggatactgacgcattaaaatagccgccacgagcatgggtcccgtggcggctctcaattaaaccgacgccgtcaaccgcgttgtcgacgcctacttccaatcgcgctcggcaatgcgcttgaccagcgcaatctttgcccattgttcgtcttcggtcagcttgttgccaatctcgcagctcgcaaagccgcactggggcgacaggtacagattctcgagcggcacatactttgctgcctcgtgaatacgctcaacaatggcatcctcgtcctcaagctcggcggctttggtggtcaccaggcccaacacaaccttcttgccaggagcaacgtacttgagaggctcaaaaccaccggcgcggggcgtgtcaaactccagatagaacgcatcgacatcctcgtgcgcgaacaggaacggtgcaatggggtcatagccaccctcgaaggcatacgtggagtggtaattaccacggcacacgtgcgtgttaatgaccaggtcatcaggctttccctcgatagccgcattgttgagcgccacgcccagctcgctcaccttttgcagatcgacctcactcataccagttttggcgacaaaatcggtatcgcagtagataccccaggtgcagtcatcgaactggatgttgcggcagcccgcagcgtacaggtcggcaatcacggtgcgataggcagccgcgatggcatcgacgagttcctcgtcggtcttatagacggcgcgcaggctctcctgctggccgtcgcagcgatcgagcgtgacctcggagaacgtctggatcggtgccggaatggtctggcgcgcgacctggccctcgccctcaagcgctttgacaaacttaaagtgcgcaacgaacgggtggttctcgccgctgatggggccggtcaccacagcggtatcggccgtggtctcctcgtcgtggaacatataaccggtacgcgaggtacggcgctcaatgccgttgagcccccacataaaatcgaggtgccagtagctgcgacgaaactcgccatcggtgataacctgcaggccggcggccttctgcttggccaccaagtcgcgaatggcctcgtcctcaacggccttaagaccggcgtcatcgagcgcacccgcggcgtaggcggcgcgggcatcctttacggtctgcggacgaagaaagctgccgacgatatcggcgcgaaacggcgcgtttagctgggtcgaagtgctcataggtgtctcccttttgaggttggttgctttaccgagacagagtatgagcgtccttgccgtcatcgtaaaatatgcgtttattactgtttgtcatagaaattatctatatggcaaacgccaggcgcgcgtccccgcgcacgatcagcaccagctaaatatgctggcggattgcatcgatataggcctgaccgtagcgcgtgagcgttgtgttcttgcgcgtgatgatgccaatctccatgtactcgtccacatcgagcggaatcgaggtaatgccggggccgttgagctcgtggctgatcacgcccgagcataccgtgtagccgttgaggcccatggccaggttgaacagcgtcgcgcggtcgcgcacgcgaatgttcttgcggcgctcaaacgtcgaggtcagttcctcggaatagtaaaacgagttgtagctgccctgctcgtaggacaggaacgggtagtcttccaagtcctcaagcgtcacgctggagcggcccgccagcgggtggtcggcgcacacgaaaacatgcggcgtggcgcagaagagcccttcgaatacgagctcattggccgccagcatacgctcgataacctcgcgattgtgctcggacaggtacaggatgcccagctcgcttttcatgtgtgcgatatcctcgataatctcgtgggtctgctcctcgcgcagggtaaagtcgtagcgcgcggcatcgaactcgcgaatcacgtcgacaaacgcattgacggcaaaggaataatgctggcagctcacgctaaaatgcggcacctgctcagacgcacctttgtatttgtcctcgagcagatcggcctggtcgaggacctggcgcgcgtagcccaaaaaggtctcaccctcctcggacacgataacgcccttgttggtgcgctcaaagatgtgcacgcccatctcgttttcgaggtcacgaatcgacgcggtgatcgagggctgcgacacaaagaggcggcgcgaggcctcggtaatgctaccgcactcggcaaccttcacaacatatctgagctgctggagcttcatagtgacctccctaggcgttcgcgacgtgcggacccgccgcatctgtctgacgcataaacggcggcatctcccccgttgcggcacaggcagcaatctggtgcaaagctgcggcaaccgcatcgtctgccgcagcgccgatatgccagcgcgcggcagccgtgacagcctcgttggcattggcgaccgcaacggagttgggaacggcatcgatcatgggcaaatcgttatcggaatcgccgaacacggccacctcgtcgggcgtcaggcccagggcgcgtgccagctccagcgcagcgcagcccttgtcccaaccagccggaagaatgtcgaacaggcgcacgcggttattggggaacacaagcgagagctccggcacctcggcagcaacgcgctcacatagctcggcgagctcctcacgcgagcgggcgctccagatattcgccttgtataccggggcatcatcgacaacagggcggcacggggcctcttcgcccttgagccacgcgttgccacccgactccatggcacgacgcacgcgctcggggtcgcgcgttacgcaataggcatcgttgtcccaaaagtcatcacccaggctgtagacctttagatacgtatcgtcggtctcttgctcaaggtagtcggccaggcgcatcagggcgtcgttgtcggttgcgcgcgatgcgaccacctcgccgtcgacaaacatcacctgcccgttgcaaaaggcgccggtcgaaaagcactcggagcgattgcgaaacatccagcccatcgcggacggttgacggcccgaaaccgggccaaagtgcaggcccgccgcctgcatggcgtgaatgccttcgattgcatagtcgctggcgccgtcttgcccagccggaatcagcgtatcgtccatatcggtcagcacaagtttgatcataaggtcccctcggtcattctcatcccgtctattgtaccgacctgccaaaaagggacaggtttattttggcaggttttatctgggaaaacgcatcaccccggttagcacctgccaaaataaacctgaccctttttggcaggtgcgctagtataggggacaacagattcgatgcgggagtgccggcggtgcaaaccacaaggctgagagggcaatgggcccaatcctttgaacctgtcagttaatgctggcgtagggagcatgccgcctttacaggggcgctgtctatgcacagcgccccttttctatgccaaggaggcatgtgcagtgattgattcggaacagcttaagcaacaagtggtcaaggccgtggacgagattcgcgccaccaacccgatggcaggctccatcaccaacacggtgacgattgactttgtcgccaacgcgcagctcgccgtgggaggttcggccgccatggtctatctgcccgacgagggcgaggcgctcgttgccggcggcggcgccatctatctcaacatgggcacgctcttccccatctacgagcagacgattccccgcgcggccaaggcggcacacgatgccggcaagccctgggtgctcgacccggtgggcctgggcatcggcagcctgcgtactcagctggtaaacgagctcaagcggtacaagcccgccatcgtgcgcggcaacgcttccgagattatcgcgctcgccggcctgtggggccttgagggcgaggcggccgatctgagccgtgtacgaggcgtcgacacgaccgatacggttgacgccgcccgcgatgccgccgtggcactcgcccgctacaccggtggcgccgtggtggtctcgggcgaggtcgatctgatcaccgacggcacgaccgtggcgaagtcacacggcggcagcccgctcatgtccaagatcaccggctgcggctgctcgcagggcggcgtgctggccgtatatgcctgcgccgccgatccgtttacggcagccgtctgcggcaccgccgtctacaacgtggccggcacgcgtgccgccgccgtcgccgatgccccggcaagctttaaggtcgcctttatcgacgagctctaccgtgcaactgcccaggacatcgccgacaaccagctcgagctcgaggaggcataggggcatgtccgagtccgcaaccaaaaccggcatgaatacgctggtcgccgtggccatcgccccgtgcggcaccggcgacgagctctccgccgaggtcgccgaggtcgtgcgcgtcattcgtgagagcggccttcccaaccgcaccagctcgatgttcaccgagatcgaaggcgactgggacgaggtcatgcaggtcgtgcgcgatgccacctttgcgttggcaaacaagggcatccgcaccgaagtcgtgctcaaggcggatattcgccccggatttaccgacaccatgaccggcaagctcgagcgcatggaagcacagatcaaaaagcaggaggaagcataatgagcatccgcgacaaccttgatatctcggcctatctggtgctcggccccgaaaacacgctcggtcgccccgtgggcgatgtggtggcccaggcgctcgacgccggctttacctgcatccaggtgcgctccaaggtggcaagcgcgcgagagattatcgcgctgacggacgacgccgcacaggccatcgcccgtgcgggcaagaccggtcaggtcgccctgctcatcgacgaccgcctggattgcgtgcttgctgcgcgcgagcagggcatcgccgtcgacggcgtgcatgtgggccagagcgacattcccgtcgaggtctgccgcaagctgctgggccccgacgccatcgtgggtctttcggcccgttgcgaagagatgctcgagtacgtcaagactgccgacatgagcctggtcgattacctgggcgtgggcccgctccacgagaccgagaccaagcgcgattgcggacgcgcggccgacggctccatcattaccaagagctttgaggacctggccgcgctccatgcggcaagccccgtgcccatcgtggttggcggcggcgtcaagacggccgacctgccgcagctcaagtccaccggcgtcgacggcttctttgtggtgagcgccgtctgcagcgctgacgacccctacgctgcggcgaaggagctcgtcgacacctggcagcaggcataaacgcaagccgagcagctgctgggcagcctcatttcttcaagagcggaaagcgcatcccagaatggacgtccaaactgggatgcgctttccatatagaggctcaacgggaaactgcgtcccgttccgagcgcaaattccgggacgcactttccgaaaccctgccgtatgggaaactgcgtcccattccacggccgaaaagtggaacacactttcccaaacaagcccaacgggaaacggcatcccagtttccggccgaaaagtgggacacatcccgtttcgagctcaaattctgggtcgcagtttccccgaggggccccgtcgggaaactgcgacccgtttcgagcttgaatagcgggacacgctttccgtaagggcctccttgggaaaccgcgtcccggattcaccggggacggaggaaagcgggtcgttttgagtggcggcaggctgctatttcagcgtaatgcaggatgcgaggaggttgcagtacgtttctcccgtgaaatcataattgatcccaagcgggcggtatccatcctgaacatatccccagtaaggtccgccggacagcactacagtcttgcccgatgatgtctttccaatcgtcttagagaaggcggtctctgcgccgcgcggcgatccatcggttgcgtataccgtaaagttcgctttcgaggcaacatcttgcgctttaacgtcattggcggtaagggcgtcgggcgtcgtttcgaattccagccaatccatggggaaccagtcggggaggaccatcgtaaagtagtcggtctcaaacgtccttgcccgctttgcctcttcggccttcttcgcctcttcttccgcctggcgcctagcctcctcctcggcctgcttggcggcgacggcgtcgtcgcggcgcttggtcgcggcggccgcgagcgcctcggcgtcgaagtcgaagcccgccttcttggcgccttcgtcctcctcggcgtacttcttcgccgcggcgatctggtcgtcggtcacctcggacgcctcgaccggctccagcgccacgtcgcccgcgtcgactgccttcttcccgtctgccttctcgcccagcttgatgctgagcttttcagcggggacggcatagaccgtgccgtcggccgcgatgggggaggcggcgacctccaccttgtagctgccgcggcggagctcgacgccctcgccgtcgctgtccacgtagcgcacggcgtcgaccttcttgccgcgctcctccctgccagtgatgcgcaccggcagcctgctcgcgcctgccgaggtgtcccagccctgtgccgagacgctgaagcgcacggcgtgcttggccgcgagcgcctcctgctcggccgcctcgcgggcctgctcgggggcgtagacgccgaagtagtagccggcgccgccacccgcggcgagcagcgcggccacgacggcggcgaccacgaggggcttcttcgagcgcttggccttggccggcgccggcgcagcctcattggctggtgcgtttatgcccgcggccggcatctcgtccgttggggccgctgcgccgtcaggctgcgcctcgacccccccctcgatcgcggcggtaacggactcgccgcagacggggcagaacttcgccccgtcctcgattttcgacccacaatttcggcagaacatggactctcccctcgaatggcgcccgcgcgaaggccgggcacatttcctttcgtcctcatgctaagggcgaatgctcgcccgttgttgcgcaacattgccgagctctccgctcggaacccgcatcccagttttgcccttcaaggtgggacgcagtttcccgcggagcctcgattggaaaagcgtcccgtttcgagcgggtattccgggatgtattttccgcaagaggcctgtttgggaaaccacatcccgtttcgagctcaaattctgggtcgcagtttccccgaggggccccgttgggaaacgcgccccacttctcaagctcattctgggacgcgctttcccaaaccgctctcatagggaaaccgcatcccgttccgcggccaaaaagcgggacacggtttccgccgaaccagcggtcaccgccctaccctgccaggtatgcctccagcgccggcagcgtcgtctccgcatcacgccggccaatctgatagatacgctcgagctcatccggctcgcgacatagcgatggcacctttaccgattcgctcggccgcaccacaaagatctcgccggcagcctcgcggcgcgccagatcatcgagcgtggcattgtagacttcatgccgatgctcaagcgccgcaacaaaagcaggatagtggtggaacacgcgccgcagcatgggcatcacgctgttgggctgcttcacaaagcccgccggctgcgtaagcaccaccacgttgcgatcgtagccctgagcaaacagccaggcgctgggaatagagtccgcaacgccgccatccaaataccgatgcccatcaatccgaacaggcctggtcgccacgggaatcgccgacgaagcacgaatccactcgatatcgcgctcgtcaccgtaaggcaggtcatggtagacggcctcgcctgtctcgatatcagtgcatacgcacgtaaacctcatgggactggcgcggtaggcatctaagtcgatgggatcgcgctcgataggcacctcatgatacgcaaactcggcattgaacatgtcgccggttcgcagccagctcgtcacgctcgcatagcgcttgtcagcgcaataggccttgttgtaacgaatggcgcgaccaatctggcgcgacttaaagttgtagccaaacgcggcgcctgccgagacacccaccatatgatcgcaggtcaggccatgttccatccaaacgtcgagcacgcctgccgtatacatgccccggtagccaccgccctcgagtgccagacccaccgtgcgcgccttacttggcagtgccatgcaaccatccccgtcctcatgcttttgaacggaacaagtatacccgtcaacatataccgcctcggtcacatttgccaatgcaaaccaagcactaccactcggcgtttaatttttaccgactgaccatgtttatacaaacacgcccctataatgatgttcgcatcattaggcaacaacaccaaacagtagacaacaatccagcctatcgacaaaacaaggcggggacgaaagttcacgcgtccatagaccgcagaaggtcacattgacaagaaaaacatccgacgcaagccatctcgaccccagaaagccgctcacatatgaacacagccaacacctataccgagacgctccaaaagatcattcaagacctgttcgagcgcccggaagacctggtaaggacagcctttaccgaccaacttaccggccttggcaaccgcggcggctatacccgctcgttggaagagctctgggagcagggcacgccggtcaccatggcgtttatcgatatcgataacctcaagcactgcaacgacgccttcggtcacgacgagggtaaccgctacattatgcaggtgagcctgtaccttaagctctatatcaaagttgacgaggcggtgtttcgcctgggtggcgacgagttcgcaatcttgtccaccgtcgcgaccgaagacgaccttgccgagcgccttgagcattgccgctcggtgctgctcaaaaacaacgacgccgagatgcctcactcgtttagctatggcgtatcgcatgccgacccaaaactgggcgaaacgtccgatcgtatgacgctcgatgccgaccaccgcatgtacgactacaagctgcgccatgccgtacacctggatcgtcgcaatatcaaacaagttcatgcagacgattttgaagtcagcgaccgtgtcttcgacgccttctcgatgcttgacgagggacgatatttctttatcgagaacttggacaagcatcgcaccctttggtcacaaggcgccttgcgcgatttcggtcttccttcggagcatatagacaactgccacgattactggaaaacgcgcgtccatcccgatgacctcgaggcctatatcaacgatatcaaccagatttacaacggctccaagcactatcgcgtcatgcagtatcgagtgcgcaacgctgctggcgattacgtgctttgtcgcgtccgaggctatcgcatcgacggaaacggagacacgccctcgctctacgttggcgaactcgtcaatcacgctctggtcgagacgattgaccccgcaacagggcttggaacccagcgcatgttgatcggcgccattgatacttgccgccgcgataaccgcgggatgggccttgccgccgtgcgtgttcgcggtacaacgcagctcaatgaacgctatggggccgacgccgtcgatgccatgctttccgagtatgccggccgcatgctctcgctcatccgcggcagaagccgtgtattccgctcgcgcagcgcgcagttcgttgtacttaccgatagttttgaccgcaatgccttcgatcacctcgttggggatttggaacatgttgtctcaaaacccatccagattgccggcgacgtcatcacccccacatgcctggtcgtgcctgtctactacgagcgccttgttaaccaggcaccggacgttttggacgaactcgaccgccgcattcgcgccataaacggaccgttccacaacgacagtccctgcattcccgaaatcaagcgcaaaggcgcaatcgccgagcgcatcgacccgctcaccggcctctaccgccccagtgagtttatgcgacgcgccaatgcctttctgtcgacggcacaaggcagcgcatggtgcattgccaccgtcgacatgggacacatgcgcctgtttaacgaatggcacggacaaaccgagggcgaccgcgtgcttgccgatgtgggcacggtgcttaaggatatcgagaacgcgggcatgggcgttgcgggctactggggcatggacgacttttgcatcctcgctccctttgaccgcgatacgattcatcgaatttatgccagcgtgcgcgaggcggttgccaggcacgacgacggcgtgggtttttggccgtccatgggcgtctaccccatcgatccccgtgaggagatcaccatcgacgctcaggcaaaggccatgtatgccaaccgtcgcgccaaaaatgactttaaagaccgcatcgccgttttcagcccccaggagtacgcccacgaggttgcgtttcacaacacccttaccgatttccaatatgcgctctccaacgaccgcatcacctactatctgcagccccaagtggacatggaaaccggcgagattgttggtgccgaggcgctcacgcgctggattggtaatgacggcaccctcattccgcccgtttcctttatcccggcgctcgaggaaagcggttttgtggtgacgctcgacaaatatatttggcagggcgttgccttgtggcttcgcaagcgccttgaccaggggcttcgcgtggttccgatttcgcttaacgtgtcgcgcgtggatatccttgcctgcgatgtcgccgagcatatgagcgcgcttgcctccagctacaatctatcgcccgagctcatgcgcatcgagattaccgagactgcctataccggagagcccgaggctgtggataaactgacggccgacctgcacacccgcggcttctcgacctacatggacgattttggcaccggtcagtccacgctcgcgatgctcaagaacgtcaacgtcgacgtcatcaagctcgaccgcacctttgtgcccaccgaccgcgatcaaggccgcagcgcgcagatcgtgtcatcgatgctcgagatggcgcagtcgctccatctgcccattgtaatcgaaggcgtcgagacagatgagcaggcgaacatgctacgccacatgggtgcccgctacgctcagggcttcctctactaccgccccatgccggcgaaggattttgaggcattgctcgatggtggcaataacaactgatacgctcgcgcgcaaaacgccaccgtcgaagggggcatttgtctccattagctaacttattaccccaattcaaaccgaattggggatatgatacaaaccgttgttccgcccaaggaggttatccatcatgaacgagtcatatcgcctgggtgagcaatcgattattgcctatcttcagcgacttgcgaatggcatctcgaccgccgaactcgatgttgccgcgctgcctgctgagctgcgcgccgttggcgagcaactgcaaaagacgcatgccatcctgcaacaagagcgccggctgcttgagagcaacgcctatatcgacccgctcaccaacttgggcaaccgcggcggactcgaccgtcacgtcgagcagctctggcacaaaggtgaccccttcacctgcgcctatattgacatcgaccatctcaaacattgcaatgataggtttggccacgccgaaggcaatcgctatattctgagcatctgccgcacgctctccgaaaccatggagcacgatgagatgctgttccgcatcggtggagacgagtttgtgctcatctcgctctccgcaaacgagaccgaactcgagcagcgcttggagcgggtacgtgccgggctgatcgaggcgagctcaagtggcaaggcgcccatgatcgccagctttagctttggctgctcgcgcgtcgatccacttgccggcgacacgcgtcgccagatgacgatggatgccgatcgcaagatgtatcgctataagcttatgcatcgtgtgcagcaaccgaaagacaatgacgcgccgcaacgcccaatcgtcgatcagcttccctgcaacgaccgggtgttccaagcaatctctatgagctccgagacgcgctatccgtttatcctcaatctcgatacgggcgaatcgcaatggtcggtcaatgccgtgcgcgattttgacctgccttcccagcaccccttcaactcggtcgacatgtggctcgctcgtgtccaccccgaggaccgcgataacgtgcgctccgagctcgacatggtggtaaatggatcgtggcacttccattacatgcagtatcgcgtgatggatgccaccggaacgtacgtgctttgcgactgcacgggctaccgcttggacggcaccgacaccgagcccaacatgtacgtgggcattatcatcaaccgcagcctggccgatacgaccgattccgtgaccggcctgggcgatgtccacgctctggtcaacgccattggggagatgcgtcgcgtaccgcacgaggcaggctttatcaccatcaagatcgacgatatcgccaaggtcaatgcccgctttggctttgatgcgggcgatcgcgttttggccgaaagcgccgcctgtctcatggaatgttcgcgcggtaaaggtcgcctgttccgctcgacagggccaacgttcgtggcacttttcgatgaccttaaacccaaggcgatcaacgagatcgccgatgaaatcgaacggttcctgggctcgcccgtgctcatcgggtcgcttgaatatcaaccacccattcgcgtggccacgcttcatctggacgccgtcgaccgacagcccgtttcaattttgaacgagctcaaagcgttgcttaaagaggcaccgcaagtaccgggcaccaagctggactagcgttgtggggcgcatgatagttaatttccgatctcaggcgaacacattgggcaaataggtcatacccgcagttagccgaacgccccccgcagtctctccagagcccgggggcaccgttttcccagttgaaagaatggcggagatgcggttcgatgagtccggtggccatgctccgcccaccgcccgacatcctttcccaggcaaagtcgaacggtcggtccgtctattccgtttcccctaggccaggacagcgggggttccggagccgcccattacattcattcgggaggcgctaaattcatatggaacgagaaagagttgatcacccgattattattcccgccttaaaaagcagccaaatatacgtcccaatatcattccagcacaaccaggaatccattatttggctaattcaatagccccctcaccgctcattaccaaaatatgatcggcgacatcgagcaatctagaatcatgcgaaacgatcaaaaaggcctgacctcgcttattttgtttaatgtactctatcaggcaaccacatgccgatccgtcaagatcattggtcggctcatcgagaattacaaaatccgcttttcggcataacgccatagccaagcgcaacctttgcagctctcctccagatagattagaacatttttcccatcttattttatcaattggttcgaaaccgcattccttgagaaacgacgccattaactcatagctgatgccgtattcatgcaaatagtcttcaactgtgtcaccggggacgaaagccgtttgctgcatagcagagaaacactccgaccgaactcggtcaagattgatagcggtcaactttgtgcaatcgtactcgatattgtcatttgcatgctcgtaaaaacccaggagcagctttaatagtgtgctttttccaacaccattagggcctgtaattacatacgttctgcccacgtcaaattgaagattcaccccgcaagttatatcaaccagctcttcgtcgcgaattaaactgaagtctaaatctaggacctgtatgcggcccacattattaaccgcaaggcaatttcggtaatcccgttttcgcgcctttatttcattcagcctagctattgatgccctcgtttcctgcaaagactgaaagacgccgatatagtatttgccacagctcatcaatagggaataataagaatttatcatggtaaattccccaattgtcatagctcctgtggctattcttgctcccgaaaccagcaacaaaacagcttgaaatcctgccgccgccatacgatcgctagaacttactatactttgtactttcgcgagtgcaagaactgaaggatagtacgcaacatcaaactgtttttctacatgttcgaagctgctgtcataaccggctagcagcttaatctcgaacgtccgcgcgatacgtgatgctatggagctgaacaggaacccatcttcctctttcttttgaaatgaagcagcaagcagtgagggttgaagcataagcaccataatgcaatacgccccaagaagcgttatgccgacggtgcatatcgataaatcgagagaagcgattagcaaaaaaaccgcaatcattgtaatcgcattcatgaacaatggaatcatgtttatgacaacaaacgatgttattgaagaggtgtccgagtttattttctgagcagagtacaacggggaagtcgactctatgtccgtaagtggcaaatgttgaaagtctgacacgatttcttttaaaaaactgaaatacgagaggttcaggactgacgtctggagcatctttgcaaagtaagagaagaccgccgaaataatccccaataatgctatagcaaaggctaaaatataaatcgaatgcatgtcctgaccgtaaacgagcatatcaacaaactgtccgttcaaatacggtgacagcgatgtcagagcatagctcaccagaaccatgaccatcagcatctttgcaccgtggcatgacatcgttgttttgaccacatgccagaacaacgcgcactcgtctctccgccatttgaaatgcaccattatatcaaccacgcctctgaacagggccttttatttgagttgtcaattatattcaaccctctatccaaagaactgtcctttcgcagccgtaacacatagtaataaacgcctgcagtgtggtcatttcgatagagttcgtaaacatcatcaattgcctcatctactgatgtccaccttgttggattagccaaatacgcactccatgcaacaccctcaacaaacgaagagcatggatagacctcgtcatatcccagcaaagacatcgttcccgacaactcgctgctcattatgtcttgcactattgagactgcatccaggctgtccttatcagcacaagccatcattcccaccatcaacgcggtaccatcatcgcttaaataatctgggagcttttcgataatctcgttgctaactcggcatccatcaaatcccccatctccgacaaaaggatattcaagtccattgggaatggggaccagcggaggatttgcaacaatatagtcgtatttactatcaggttcgagcttctcatacaaattcccttgaaccgtttttatcgcaccgtccagcccattcaacttggaattaagcatgttagttgcacaagtttcggcgtttatctccaccgatgtaaccgtcatgccacccgctgccatgatcagcgactgaatcccagagcccgcacacaaatcaagccccttcttcccgagctgaggagacagccgcctggcaagtcctaatgaatctgggccgaaatatcttttagggtttggccgtggagcatccgcgacaatccagacacctctatatcgatttaaaaccagacccgttgagtggacaatcccgtcctctaaaacaacgatgccagcgtccactaatagtttaatcagctcaataaatggcttcatttcagcttgcgccacagactctccaagatacagaagcctcactagtcctcgatattcttggtttactttacccgatgcaaataagtgctcaacaacataaaacctatcccccgccacggatatgccctcgagtaaatctgttaagccaaccctatcaaattcttttgacaattgactgtattggtccattttgtcgtccatcccgcttccgctggctatcgtctcataaacacaaacctaactagccgcacgaacgacaaagaagccaagctgaacagaagtagaaccaaaacttcaaaaacactggtattccaatcgcgtacccagccctctaccgccaacaaaaaaaacagcagccccatccataacgtcacagaagaaatcaactttgcgtaagggcgtatatcaatcccgctctccctttttgtgacatcatatccagcaattgagcagagccatcttcctcttctgtattggattgaaaggataatcagggcaatcgaagtcatcaagcagacagcatcccctgtttccatagaacttcctttgctttccgtcctagttgcgcattcacaatcgaatcaaaccaagtgtgaattactcgatagcaaccgccttcgtataaaccatagccgctgcagcagcattaacgactgcgccgtagttaacaccaactacgatgtcataaactgcaactgcccaaactgcagccgggaatatagcaactcccaccgctggctccggatcttgactgccaccatttaagttaactggaccaacccgcggatcaaaatccatttttaccttctttctaacttggcaatagtctccaaaactacagatcaatctgcaattctctaatctccatatcaccttccattaactcattaggtatcactcccttcaagagagtgggcggcaaaagacaccgatctgtttcgctcaccgaatagatcaggtaattcagatctcgcattccatcacttttcaaatcctcttgagtcgtttcgctcttaaaaacaagctcaaagaccgacatgtagtcacgaattccctgccattgctgcaagtttggaattacgccaaatattgaatataggaagtaggcatcttcaacaatcgttcttacaaaagcaatttgcgtcatacactcttgctggttgtcctgaagctccaatacgactgatgatgagccgaagttatccgagatgtcattggccgtttgaactatagacccatcaacaatcggagacagatacgaacatctcagtgaagcggctttcgcgtagtagggaatatacatgatattgttacgctgatacagaaatctaggtgcaagatcgtctaaatcgccctcgagaaataagcctgttttccatattttcaaaattgtatttagaactttatcggcaacgattgacctatcgctgccggacaacttcttattggcgcaaatttcgttagcgatatctttaatgcaccgccctccatctatcaaattaacgatagcgagcgcatcttcattgagacgaatatagtagctgttcgcggtcaaaacgctaccggtctgagtgtgccttacgcgtacggcataccgcattctcggaacagcacccagcatctcccttttcttcatatttccttaccctacctctaggaaatagtaattcatgcttccgttcgcaagttctaccgccaccgaccatttaaacccaaactgctcgagcccagattcgcagccatccttagtgatagcggctactcgacatggcgtttccgaaccttcccagcgcaactccgcaatttgaatccccctttccaatataaataaaaccaaactgctagacctgcctcttagtgcagcgcccttagccgtaatcagcattccgcaaggttcgatggaatcagccctgatcaggcaaacctgataacgcccatcaaatagagtctgcctaattagacgtcctctcatctttccattttgtatagttgagaatgggtcaagcacgacatattgatccatgctttcattggctctataaacaaaagacaaaacctctttgcagtcgctctctttagccctaactgcttttacgcaacttacccccgtgcacacgtgcagcatcctccaattcttgagatatatctatgttcctttctttgaaaagaacaggaagcccctgttggatacttgtgaagtccgaaagctcctctatacgagctaggcacttctcgacaattgggtgccgtaacgcatatctatctatttcgagatcaatatagtcccgcagagtatttcgatttagattccaaatggtaatcggcaggtaaggagacaccgagagctccccatacgcattgacgcatatttgcggaattctccctgtctccctatacatatacaaatgatctacggggtcaccccaggtaatctgcatttgagaaacagcattgcgcgcgctcaaatatgcagcaagcgcatcattttgctcgggcgttaggcacagatccttataattcagctcacctcgtccgagcggcatcaaaggctgtgctctaaaatcacttacaccttctttttcacaaaaacttattattgaagggtattcccttatattcttagcatgggggagagaagcaactgcgacccttattccgtgtcttcgtgcgatcttaatcgcatccagtactcgatggagcttaccgttactcaacctcacatggtcataagacgcatctgaaagcccatcgaggctaaactgcactaaatccagtccatctctttttagggcgtcagcaatttcttctgtccaaagaatgccattgctgaccattgacacgagagtgccttgattaagctccttaactaacctcacggcgcgacgaatcaaatcaaacctaagaatgggctctccgccacaaatgcaaatcgacgaaagatcaatcaaggcaagctgtcgaaaaacgctgatcagttcgtcatcattcatttcctcataggcacattccccgccgaaatcaaaacaatgccgacatcgcaaattgcatcgataggtcacatcaactgaggccgagctaagataattcatatacaatccgctctctttcgtgcttacgaaatacttaattgcaattatggacctagcaattctcgtttatttctaattatctgcaatgagtatgtaatggattcaaaagctgtaagtttgagtcctacatattaaagacattggcggcttcctcgcacctaaagtggatggcagattccccaatcatgaaaaccgttatataagcccacgctaaaactcaatttgatgtttttattataggacaatctttcgcctcatctttatctgttttaccttgaatatcaacttcatccgaacacctcccatattcatccgtacatgtacggaaaagaagctgcgccgcgggggaggcggccccaatggctttctcatatcgtcttttcgggaagagcgacaatgcccaaagaattccttacctaccagcagcagatggagaagctcagaagctccggcctcagaatcgaggacgaagaggtttgccggagggtgctggcggacatcggctatttcccggtcgtgaacggctaccagtcgtttttccgcgacccgagcacccgggtataccgcgaaggtgccacttttggagacatcctagcgctttacgagttcgacgtcgagcttagggagataatgctcgatgcgctgctcaaggtcgaggcgaagatcaggtcggcgctggcctacgaattctgcgctgcatatggcgagtcccagagcaagtatctagacgcccgctgctacgcgatgtcgaagggcgcgaagcgtgttctcccaaagctgctaaacatgcttgactatatcgccaacaaggataccagccacgaataccttgcctactaccgcagggcatataagaacgtgccgctatgggtcgccgtgaacgccatgaccttcggacagacttcaaaaatgctcacggcgcttagggacagcgagaaggccaagattgctaagaggttcggggtgggaaacccgaaagaactctcgtcgtttatccgcgtactcgccctctacaggaacgtctgcgcgcatggagagcgcctcttctcccacaggtgtcacgtcgagattcctgacacggccttgcacgccaagctcggcatcgaaaagattgggccggattacgcttgcggcaaggtagacgttttctcggcagtgatcacccttcgatacctccttcgcgacgacgagttcaagacattcaaggccaagctcgtcaagtgcgttaacggatacttgtcattggatgagagcatcggcgaggagcgcctccttgaggccatgggtttcccagccgaatggaagaagataactaggtataaaatttagattcgacccgcctaaaagtatccgttgcgttctcaatcgaggtgcttcgatccaggctacgagggtgttcgcttagattgagggctcacttcccctatgtcccctttgggggcagtcactgttgttatgccttggtgctatactcggaggcctaaggaagtggttcgtatgtacttgagcgatactaagattcaggagctaatcgacagcaaggtgcttctcaatgccgatgcttcgaacatcggacaggttacgtatgacttgcgcaccgagggattctacaccaacgaaagcaagcaatccgaggtagagcttggccccggagattcgacattcgtctcttgcgttgaatgtgttgcgttgccaaacgatttgaccgcgagcgtgcttctgcgcaattcgcgcattcgccaggggctttctttggatgcgccgctatatttccccgggcatggaacacggctgttctaccgtgttacaaacgtaagcggtaacactattacgctcgataagtctaagggtatagcgcaggttgcattccagcgcgttgatggcatggtggcccatccttaccacggcgctttctctgatgaactcaactttaacggacttgcagattattccgacgtctatgccggagaacttaaaaaggtcgaggacaaaaaggaggaagtcgcccacattgagtctcgtatctatggcaacgttctggccctctttgccatctttgccgcgatctttacgcttgtaaatgtcaacgtcggaggcctttcttccgatattacaaccgtcagatttgttgcgctcgacctgctgattattggcggttttctgattcttgcatccgcaatcgagaccttccttgttaaagacagggaaaagaaggcatcgctgcctctcgtattgggcattgtctgcattgtcgtggcagtggttcttgcatttcagtaagtagggtgtctcaagtcgtgggagacttgacctaaggtacgttcaattgctcctgagtgagggtattggcttacgccgataccctcactttctttgtatagggccacagacagggctagctgtcagagttcgtgtcttatgggaataattcaattcacgccgcattacatctagtctgctctttatactcggatatcaacactaaggaggtagtcatgttttggagctatgttcagcttgatgatggcacccagtttgcctactcagagacaagagaagacggaaccgttcgcgtagccgtcgagcgcccggttgactttggctttgaccatgcggaatgcttcttgcctgcggtcaaatggttcaatgtcgaaggatttactgctgatgacctcaatttcttgacagaatttgttagatcaaacgccccgtttatcttcgagctcgccgaacgccaaaaagccggactggcggtttcggcgctggccctctgacgttctactgttgaacggtaaataacccatgatttcgactaccgacatatccactgcagtctcccgcgcgctgactcaatacgacgtcagcgaagcatatttatttggctcgtttgcccgaggcgagcaaacgcccgatagcgatattgacttgcgcctagtttgcggcaacaccatgacgttcggcacgctttacgaactctcctatgagctcgagatggaacttgggcgaaaggtcgatgtcgtcaccaacccaccagagcacatgcgcccggccttccgcaaaagcatcgagcaggatgaggttcgcgtctatgaagcgctgtaaacaggacgaggagcttgcgaataccaaccctcaaccctttccttccaatgagcccagcccggagaccctcgaggccatccgtgaaggtgatgcattctttgcgacgggggagtgcggtcgcttcgacaacggtgctgatcttatcaaagcggctctaaaggcccctcactcacggccagccaacgagtgatgactgtttatcgtgcgggtttaattggcgctcgcaaataccctggactgcactatcgaatacctcgtctggcaaccgattgctctggagtacgactcctagtgccactttgttgtgcgccccggtattgcatcgcacgtatagaatctaagcatccgcgcgcctgccattatcttgattggaagccgtatggaactccccagcaccctgtgcagcaatgtgtacgacttcgcgttttgccccgagccctgctacgaccgcttggccgaccttgccgaccccgaggactggggtcccggcaaccgcatcctcaaaaactacctgtcgttttcgtttagccgcgcggtgttcctgaccgagcgcgacgtggatcagaccgccccgtccaacctgccgctggtgttcgactacgaccgctgcctattcaacaccggcctgtacacgcgccgttacgagaccatctacggcctgtttgagcccaacaccaagcccgacgcgcgccagcgctggtttttgaagggcttctttaaggaaagcgaccccatgctggtctcgtttgagtacctgccatgccgtgtacgctttgccgaggacccttccgagctggtctttgactaccgcctgcccatccgctccaacatcgaccacattttgggcgacgaggaaaaccttacgcgtatccccgccagcctgatgggggagggcaactcgctgctgctgcgccgcgcttttgagggggccgtcggcgaggcagcgcgccgcgccgccgccaactacacgctcgccgtgccgcagttctacggaggccggatccagctgctgttgccgctgtgtctgaccggcgacaagcccgaactggcactgaccatccagcgcgaagacggtttctacgccgcgcgcacctgcctcacgctcgatatggcctacaacaacgcgcgacttatctgccgccccgagacctcgtggatcaagcgataaaggttggtttagctgcagatttgttggatgtcctgcttgcgatggggcgggtttcgtccgcgattgcgcccacgaatttaaaatctggggcaaaaagttcttggtaaaccacgcgaggctatgatagtatctcttttgccgaaaggcgacgggcgattggctcaggggtagagcatatccttcacacggatggggtcacaagttcgaatcttgtatcgcccaccatctaaagcacaggtcagaggtgttaagcctctggcctttttctaatatgagaaagccattgtcaataggcatgttcgttcgagcccggtttaaagaagctgcgccgcgggggaggcggccccaatggctttctcatatcgtcttttgttattagaacttttcgcggcaagttgggattcttctacgcatgcgaaggtcgtgaaacgctatctataaaaaagtcatggggttgggggctacattttccagccgcgtgaaaacgttgtgtatgcagcactaattcgttttaaagccatgagcgtgacgagtagaaagttaagaagaaagaaggcggcaagacagaataacaacctggaaaaaaactcattgatgttcttggtcaatggggcaatgcataaaaaaccaacaactaaaagtccatccaaaacaacccacatagatatatggaaagattcgtcaaccaacgtaaactcgcgatcgagtggctttggatctttttgagagcccatttgcaagcgcaattgaaagagaagtacggcaacaccacacataagaccagaaattatagaaatgcagctaataagattcgttattaaatcttcgcagataacccagccatcagaccatttaaaaaatagtgccacagatagcaaggcaggaataacaagttgcacagtaacatcaccgggcgatatcttattagttcggtaatcgcggagtgtatcaatatattttattagaattgcccagaagtttattttgcccatactatcgaccttccggagtaacgtaatagactatttgtctctattgaagacgtcctctgctctagcgaagctatcaagacaaacggcgacaaactcatcatcagaaagtggcggctgtccagattcatttaacacttcagttatgggaactgcaaattctttatcaagcataaacgtcttagtttttccgtcacgttgctttagcgtggctaaaacttcttctctgccagaatagttgcttgtaacaccaaagtactccgcgacggcattcttgtctttaatcatatcaattgtcgatagagggatgcgaaggcctcttttatgcttagctacgaatgatatagttcctacgtttgccactgtactgtcttcaatgtttttggaggggcgataacgcctaagttcgaattgttctacacctgtaaatgcgtctaatgcagacctttcctgcactcgctctgattttaaggatattccagtagaatgactggcaatataattctttagtgctgtaacgggcactgaggctcctccgccatttggaactgattcgatcccaatcagcgcatagccaaatccaggggtacatttaataagaagtctagaaggaaccatgccggccatttcttctgtgtaggaaatgccgctatcggcctttgttcttgtatcaacgacatcaacccgaagtcctgctcgaccagatttcagattgatcaaaacactgtcattaatttgtctataagaatcaaactgtatgaagcgctcgccttcattcacttgaaaaggaacattgctgtcgtttacaaagctgaaaatgtagtccgctagaggcctatcaccgaaattcgagacatcaagcctttcctctttgtgtctataggtgttcgcccaaagcctatagacaacaagtgagtgcatcgcgaataacccgggcattaaagcatctcctaaagcaatcaaattaacgttggagtaattttattcctgttgatggtcaattaaaaatactaagatgcatgttaagtaaagagttttcagcgtaggaaaataccatttcaacctcccggtctagttaagatattttccaataggccgtctatgtaacatcagcgacttcggacgctaagaaacccttctcatccagcgtacgttcgcgtatgactacggacatgccttgcccatcacaagcttcatgacattcttgaataaagctgaagtttatgactatcgggtgcactcttcatcgtaaaaaggtgtacccagcccggtagagcattttcgaagcgggcgctgttacataacaatttaaatttactttctgcaacgaggcctttacggaccacttggtctgaccaatctccgttgtctgcacgattgcgacaatctgctttaattagcctcattcatcagtcgattacaaatgtaaaccagcttctcgctctttagaagttgattgaaaacacggtcaagatcttcatcgtcttgtattgtgacgttgcacggctcggcctctttgaacttataacggtcatggatcttttcaagatcgttgcacacgcctcggtcgatggacatgacgacagggtacgacggatcgaattcaatggtgaataccctgaatcgatatctatccgaacgaatctcgaagcaataggaattcttcttgtacaagtcgtctgcattcataaggtcgacttttggagtttgatctaatgcgctggcagacgctacgtcttggaataccttggacatagcactaagcgcctccagcgttggggacaatgttatgttgatttcagaagtttgagaaaaaagccctttaaccttaccgtcagatgcctgcgacaacaacttggcctgttcattgaaatacggaacgatatctcctgttgacttttgttggggttgagaaagcacctctacccaaggattttcaccggaagacataaataactcacctaactcaaatcgatatcaactaacagcggcaaatggtcgcttatcttgctatcagggcgtacttttgcaatcagattcttctcccctattttctttagatagctgtaagaattaatacggtccatcaattcggggctcaccagtgcttggtcaaaacagttccaaataggactggtgcaatctccagagtagtaaaaggaaccgtagttttccgactcctccgacaaccaatgaactgttgggttatacagaaaagggtattcgtttccacaccacgttcttgtagccttatttcttactatttccttgaatagcattgcgttaaacgcgttagggagaagcaattccttatcgtatggatttgcgtttaagtcacccataacgattgtcttgttaattgatgccttgaattcgtatccgtgaattacatccatcattttgcgaatatccaataatcgtggttccggatcagccgaagacatacgatcaacaagatgagccgcggcaacaacaaaataggtttcgcccattttcattggtaacacggtaaaccgagattcctcatagcactcaagtacctcaatggactctcgagcaaaaactattactttgtcacacccaccgtggctaattgggcgatatccagaactcattaacaactcagcagaaaagtcagtgccagaaaactcagcaaaagcagcaacaccgatctcttcctctcgcataaacgtaagggcaagatcggcattgtctttcttatttatgttccaaaagagcagcttcataaatcagctcgaagaaatctgttgggccaacacgttaataattgcatattagcatggccattccatatgtgttctgacatgtacggatgatccccggcttggcatgggcgaggtcaacatgcacagctgaatcccaggacctttcgacaccgcctatattgcggatcggcgccgacgtccaccctgcctaacattgccactcggcatcgcgattaaacgccccgccgcgagccccgttgcgctcgggctaccatgcacttgagtgaacgaggaggttccacatggcgggaaggaccagggccagggagaccctgaagcttaggactgtgaacggtctgtcgcagaacgcaatcgcccgcacagcccacgtctcggagaacagcgtccaagacgtgctggagacagcgaggaagcgagtggtcgctcgacaagccagacagcgagttcagttcgatgctgctggagctgtggcacggcagaccgcctccaccgtcttctgcacccagataaagaagtaggactggcacccgaggctcggcgtcggggaccaatcgaacgcggtcaaggataggatggtacacaacatggtctgggtcaacatgcggcaacggcgcgatgccgcatgttgacaaataaaaggcaccagagcccatgacgaccccggtgcccaaacgtaatgacgccagtgttgtttcgcgacgttcatcagtgctcaagcgagcacatactcattcgacataaaatgacaaaatagctgcaacgatataaatacgtacacgcagacctaaagatgcttgcagataatatcgtacgcttccttctccttacgatcgatattcattgaataggtgccctcgtattcacaaggcgggtcaagttcaaatagattgtaaaaatcattcggcttgccacagtaaaccggagagtcattctgtaagggacgcggcttattgcgaaactggtcgccggtaatatcaactacggtgccatcagtaagttcaagccacgcatgtgactgcgaatcatttgttgagcaatcacgatacgttccagatacatactgcgttgctatgcccttctcggctagatacctttggagtaaatcacttgtgtatccgcaacaaccgcttggaaaggacccaattacagtacgacatagtctgtcggcctctagagctcgttcaatcgccttacgaaaatcgttcgcaaaggacctcacgagcttcgtctggttgtctaagatgccgctcaatatgtgcctcctttaatacgaaaagggctggtactagttagcttacgattaagtctcgcagattctcagcactcatgtatttaattatgagtggagagtctatgcgattagaagtagtggacatagccctatccgattaatcgcggactttcgacttaagcctgaggagttctcctcttttctttaacggtgaaagaccgccaaggaccgacgcaagaaaggaaccgcgctaacggaatccaagcaaacgccgtgactgcatcactatgagagattccgcccccgtccagcgaaaacaagagcaaaatggtagacccgtattctaaggcgcacattaacaggtacgatactaacgacagaaaggatatttcaaaacgtccgacaaacgcaggcaaaccaaatgtcaagactatcaataacggtgaaatcaaccacattaaggagcgaataaaccgtataaacaaataacgaaaacccctcaatgacagcgaatgacccttaagctctgtcctagcaattcctatcacatcaaaggcagttttgaaccacgtcgagtgctgcacgatttgagcttgaaaagaaggcgggcattcacatctctccaacactgagataggatggatatcaattccttgattgaataagctgaaactaaggcaaatatcttcacaccagtgttcgttcgtgaattcaagcttgtcaagaactttggagctcataactagaccgtgtccgacaacatatggagttgtcaaaagggagggaaatagactgcccagataaccgacctttagctcaaaattggtctgatagagcgagaaacctttcatgagcccactaaggtgaccgatgttcgcggtcatcgctgaatactgctgtatgacaggaaatccagccagcatggcttgctggaaagcaagtgccgtcccaggggcgggtttgctatcagcattgtaaatgagacagtaatcccaattcctatcgaggtaagccaaagcataatttagctgatcagccatgtatccatcaccgggatattcgcagacggaaacgttatgcccagtatcatctgcaaaacggaaaacaatatcggcagtattcaagccgttaacaggcttctctctctggcaggtcacaacgacaaccttagcgccaatcgaagcgaattcgccgcaaaccgagttcaatgtagaataaattcgtgcctgctcatcaagacaaggaattagaatgagtagcttcggctccctttcaagaggattgaaacttacggctaccgatcgatgtaacacgctgcaaatagtccgtgtgaaggatctcagtccaagagctatctctataacgcctacaataaagcacaacatgacatcaatgtacggcacagaggctcactccttgtacgcaacggcttcaagcacatacttctttcgtccattgcaccggaaagaccctttatcaagcacaacgttggaaaaacaagacaagcaacccttcaaatcatccgtatcgaagtaatgcttccgcttgccattcgaagacagcacgtagttcttactgagttcctcaacggtatcgttcaatttattgatttgatattccctgtcgtcattcactctcaagagaaaaatgccgcccggtttaaggacgcgatgcacatcggcgtagatttcggcagtcttttcagaagaaaaataatgagaacttaggtttgataccacggcgtcgaatgacccagcgtcataaggaaggtgattagacatatcgacacactcagtagctacgtctggcattgccgatgcaacctttttaatagccacgatagaaatatccgtcgccaggacattaaatccggccttgctcatagcggcggcgcacctcccatcgccacagccaagttctaatatgtccctgtaacctcgcgacttgaaaacccccagataggagtcaatccagtcggtatcgtagacgtattgcttgccgccgctgaaacgtttatcccaaatcgtctgttgttcaatcatgattacactccgtagaattccataacctggtgttccaaatcgctggcatcgctgaaaaacaccctaccatcgaccagcttgagtgacagtagctccatgaggaacgagtgctgcaacgatgttattccgtcatcgagccacacgtcggcaagggcagtatttctctttgcacgcctgcttcgtcttgagtcaagatcgagatccagcaaggcaatcttgacttcaccaaacgcggcaatgccgaactcatcaatcaaaccgaccatcttccggcgggcgtaatcaatatcgccaaacatgcctttggtcttcccgaaagcataggcagaagccataatcgaaagggccgatttatcgagaactacatcccgaccgcgttgagcagctgcaaatgcctcatgcaacttaatgctttcagcatcgaacagaagatcctggttgtgtctttcttcatcaatagaagaaggaacgcgcaatatctcctcacgcgatttaccgaacgaccgctcaagatagcgaaccccttcgtcagcaacaaaaaagccgtatcgctcggcaagtaacttacacagcgttgttttgccggtacaggaaacaccctcaattatcaacatataagtcctccttgccgattccggcgtatagggtcaagcgtctacacttcaactacttgaaacattgggggtaaacacgaaagaatttgttacagtttagactcattcttaacagtagatattcatcagcctcagcctgctgaaatatgaatcctttgttagcgattctccctttcatattggcaaattagcaataatatccttaaatcttcctccacaccatcttgtccacgacgccggtgtagctctggatgatcttgaccaccttggtggacacggtctcgtcggcgtagtcgggcacgggggcctcgggcagcgacccctccgcgtcgagctcgacggcggtgtggacggcctggagcagccccctctctgagatgccggcgagcgtgaagcatgccttgtccagggcctcggggcgctcggtggaggtgcggatgcacaccgccgggaacgggcggccgacgctcgcgaagaagctggactcctcgggcagggtgccggagtcggacacaacggcgaaggcgttcatctgcaggcagttgtagtcgtggaagcccatgggctcgtgcatgcgcacgcgcgggtccagtttgaagccggtggcctccaggcgcttgcgggagcgcgggtggcaggagtacaggatcggcatgtcatatttctccgcgagcgcgttgatggcggtgaacaggctcgtgaagttcgcctcggtgtcgatgttctcctcgcggtgggccgagagcagcatgtagcgcttgggctcaaggccgagctcggagaggatgttcgaggcctcgatcttatcaaggttcgcgcgaaggacctccgccatgggcgatccggtgacgtaggtgcgctccggggcgcagccggtgtccttcaggtagcggcgggcgtgctcggagtaggccaggttgacgtcggagatcacgtcgacgatgcggcggttggtctcctcgggcaggcactcgtccttgcagcggttgcccgcctccatgtggaagatggggatgtgcaggcgcttggccgcgatggcggacaggcagctgttggtatcgcccaggatcagcagcgcgtcgggctggacctggaccatcagcttgtacgaggccgcgatgatgttgccgaccgtctcgcccaggtccgcgcccacggcgtccaggtagacgtcggggtcgtccagcgaaaggtcgcagaagaagatgccgttcaaggtgtagtcgtagttctgcccggtgtgcgccaacaggcagtcgaagtggcggcggcacttcttgatgacctcggacaggcggatgacctcggggcgtgtgcccacgatgatcagcagcttcagacggccgtcgttagaaaaattaactttagaattatcgttactcaacatgagagccccattcattacaatttgttatagctgatatttaacgcgaattcatgcttttagcggttttttgatatcttgcgattacggataagcggtagataaataccgacacctcggcagcacttgtcgcgaggcacattgtatagacattaaaataatcagttacaacaagaatgataagtgcaagcagctgaacgcagagaccaataaaatttgaaaaatttgcccttgatgaaaggcctagagggacaagcacgggaaaacaaataacgtacgacgggaatatcaccattattgctggaagtagacagcgcactatcatgccggcctctacatagcttggtccaaaaacaaattcgcaaatttgattcgcatagatatacagcactgcagcccctacaacaataaaaggagttgtagtaagcaatattttcttaacaagcctgaaatctttgtttttaaccatatacggatataggctatccgcaataggggaaacgattgacttagaaacggacaagaatttttctgaggcagaatagaatccaacaactggcaagcctgcgtagaacatattgagaacaattggatttgctgttgagtataccgtggaagaaatgcgtgaaaagaaaaacggtaaagagtccttcgcaagtaaccgcacctcgacaaccgtggggcggtgaagatgtatgccaaagactctacgatcatacctaagacataccgctagcgccgtaacatttccaactaacagacagatcggaagcgctaaaacgtcactgtctgagtggagaaatataaatgtgcacgcagttgcaaaagcgcgtatcgctacagtcctgaacgttatgactttcatgcgctcaagccctcggtataaataatcaggcagcatcgcagcagcgacataagctaaataatagagagcgtagagtaggaaatatcggctatggtatggagacgagcagcatgctaccgccaaacaacatccacagataatagctgaaatgccttttagagcgaacacattgccataaagatgtgaaagaaatacagtatcttcagcatactgtgcgacttttgatgttgcagataaaagaattccaaaatctagcacaagcgacataaacgtcataacagaaatggcgacgccaacgacaccataagtttccggtgtaagcacgcgtgtttgatatggaattgtgatcagagcgagaacttgagatgaaaacgttagaatatacagaaataacgtatttttaagaagttgcttcttggaattatcgatcatgaactattgctttcaatttaatgagacgtccacgtactacgttgggaactaaatacttaacgagtcttttgagtttctttttaattgtacgagaaggtgtgacatcggcagcaactgacgcgatgcccgtctcatgtatccgcctgtatacgttgtctctcaaaccaggtcgaactactggatgtgaaagctgagcattcaattgaatttcccgttgataatcaataggaacgaaggtaaaaaggctctctacctctgaccagaaatttctagccttttcagtgtttaaggaaattgaagaaagctgaacccagggatagaactttgggtagcaattcgatgacgcgcagtcgccaatggtcacatcaccaacgcgttcagaactggcgtatttacacgtatagcagctttccctatttgctgaccccgtaacaaacagcgccatatacggatcgtcaaattcatctcgtcctttatatcgcaaaccgggcgcattaatatcaactgaaaaagtcgttctcgcagagacgtctttccttctgaatgtaatgctttgagctggttttccaccagtaattgactcgacatggtcttcccataccctcggagagggtactccatgacaaatcaaatccatcgtaatcagattgtcatatgcttttcccaaatatgaaatcaagccagcaacctgacaaggacatcctgagaataagacccttctaccagatttaagacatttttcaatttgacaatatattccctgacaatcgctttgaacgtactttgatttctgaagaaacgaaatttcatttgagttagttataaggcgatgataaacgtgcccagttgaatcaaccgctgctccgactacgattcctccatgatcgacaacatagcgtgcgcacgtggaaaatacaccgcccgaactgctctcatttctcagctgatggtcattagaaaatgctgcatacatatttgaaattgggcgcaacgtgcagcgatagacagcagggcatactctgaggcatttaccacaagcaagacacgatgcaccgtttatcgagggataaacaaagccttccgcatctgggaccatagagattgaatcgacaggacacgcatcggaacatgcagcacagccagtgcatgctctacccacgcatgaaatatcctgattactagtcatttaaggcacccttaatccacgacatgcatcgagagcgctcctcgcaaagggctgattcagcatagctatagtctaaatcgatactaggaagctcacatgcactttcagccagcatgcgattatccattccaactaaattaagcaaatcaacaattcgggcacgattacctcgaataggttccatagcgacgaacggcttacccatattcactgaaaacgccgttccgtgaaatgaatcagtaatcacatattgagcgtgatcaataagccaaacgaattcctctggggtcatacccaataggagcctatcgaaaaccttatccttaaaggtattgttgctaagtcgccaaagaggcagtcccgaatttattgagaaacgcttccaaagttccatttctttatcggttctgctcgcgagattgaaaaccagaatgtatcgttcattccctttaaatccttcgggcttttgggaaaaagtacgccaatattcacgatcaagaagtaaagttggatcgagacacctaaatactggcttatccgtcaacggcgcgatttgctctactgcatgagcttctcgcacgcttatcgcatcgaatttagtaaggtactctcgaatttcttgttgctctatctcgttatagatatgactaccgagactcgaagcaagtgaaagacggcgagttgctttgccgaattgaagaaaaaaagcgggctcaatgccgccggtaataaaaggattccaaacctgatcgctgccgacgattagcgcatcagcttcaatatcagccatttgagcacacgaagtatacacccgttccgttcgagggagcctcgaatggaattttttaaaagcgcgcgcatgcagctttgcacgctggaaaatggtatttttggccgctgctataaggccagctttaaaatcaccatccttgatgagctggaaaggagtctcatttccttttcgctcataaggattaatgaaattgagaatctccgccttgcaaccaacattcttaagtgcttctagagttgcaaatgcttgcaaacatgcgccatagctccacgtcatgtgaaaggtcagcagatagttgttattcgacatcagatatcctttctagggattaattcatgcgaacagattgaataaagaagaacaaatgcgtagacaagatgttgataaggaaaaaatccatttaatagcaacggaaataaaatgaaaacggtgaggagtacggctgcacccttatttaaagaagcgaacaacgaatgaaataaagcacataagcatgcaagatataggcaaagaccagttaggccaaatccatacagcaacattaccaagtcgtcatgagcccaaatataaagactgagcgcacgtttattgagctcatagattgttgaaaaagcgtttccaaaagctatgcccattgaaccagaattagcccatgccaggatatctgtgagccaaatttcgtttctaccattagtaattgcggatagcagcgagtctgcgtatatatttccgctagcaaactcaaatttattagccattccagacttcagaaatacggcctctccaaaaaataaaacaaggagtagcaaggcagctttagtccatttgtaagcaaatagattttgaatgagtagcagcaaacaaataagaactggcacaagaaacgttcgggcgccagtctccagcgtcgcatatatgatgacaagcgagcacccgcaatatacagccttagatccattagtccgaacgagaaaaataataaggacaagcaaaagagtacatatagacgcaagagtgtgttctgtattgcatagccccttaaagtagggggcttctccccatgcgacaacataaccagtgccagttgcaagtagtaaaagaagaaacatggatgaaaagattacgacaacagatatataagttcgatattggagcaatgcttctaaaatagatgttcgaaacctaggcgaacatataagggagatcatcaacattgtgcttgcgagatacaccaagtcgtttagctcctgagaagcgcttatcataacaagagttgaatggagtgacagaagaacgaagcagagcaggcccaaataggacagatgtgatctgcgagttgaaacccattcaaatataagtagaactacaagagcgaatccaagaatcttattaataggaatagagccaagagcaccttgaagtaaagtagtcacaatatacgttgcaacaatcaatacaattggtctagccgccattcctgtttcggagacgatattttgatcggcggcatttagggcctttgccattgaaatcaagctatcaactccctatatagagcgaatagtgtttgaagatacgcctgaaatgagtagcattcacgcaccttgttatatatacggcttcccgcaaccgatatcgcttctggatttgacagcacattcacgagcgtgttcgcaagcatttgagtgtcctgggcatttactagccaacctgagtctccattatcgataatctcggagattgacccgactgatgatgcgatagaagggatcccataagctgaagcctcaagaagcgaaaatggcattgcctcgtgatgagaaggcagtacgtttagaagatatttcgaaaagaacttacgattgggctctacgatgccgcaatatttaacacgatgagaaagatttcgtttttcaatttcaacttgaaccttgatgtgatccctaccgcacagttcgaaaattagttctgggtcaagcttgtcatcgatcagaacgagcgcatccaataaatccaagacgcccttgtccttagagatatttcccagaaataaaactctagtgcggcccggcgtgtataaattctcatctggacaagaaacggcattgggaagaattaatacacgctcacttggataatccaatttttggaacaaggggttcagatatgttcctagggcaatgatgcgatctgattttaatagcgaccaatctatcagctttttcatatgacttgaggaccgagatctaatctttgccaagtcacagtgaatgtgaagtacgacagactgtcgatatcttttagctaggaatatgataacgcacgacctgatcacgctcgcattatcagccatgtgtatatgaacaattccttcgccggttgaaaagcgttttcgggcctttaagagcgcgcttacaaaacaacggatcttttgaagggcatttccctgattggtcgttattaaatagcaaaaatcaacttgctcgcatctatctagctcaaaagaaagcatgcgcgttagcgtactaatgcctcctaaacagctcggatcaacaccaaacatacttaaggtgccaaactccgtcttattcctagtcatcaaatcgtctcccgattagacgtgcgggaacccccccccaaatgcaattttcttcataagggctacgaacgacgagcgcaccagcagcaattactgttccatcgggaatatgcacaccttttaaaatcgtaacgtttgccccaatccaaacatcgttaccaacaacaatgtcttggtcattactgggtaatttttcagttggccttacagctcgcataggcttgtctttgacatcagtgcgatgatcaccagagattagagttatatgtgggccaaacataacatcgttaccgataattacttctgcgcccgttgtccaaattcttgtatcgggcccaaatgacacatcattaccgactgaaatgttctccaagccttgcaaatcgcaacgctttccaagcgagaaaccctttccgcaccgtgcaaaagaccgtttaacgaggggctgaactatagctttacgaggaagcgctttcacactgcggccaaaacatagaagcgaccgcgaaaaagagcccatgcggctagacctcctcgtagtaggtgtcggggttctcggggtcgaaggactcgttggcccacatgaccgtcacgaggtcctcggtgtcggacaggttggttatggagtgcgtgtagcccgggatcatctccacggcgcgcatgtcagacccagaaactatgtactcgtcgacggggaacgggttcccctcggcatcctcccctactttcctcagcttgatcgacgcggtgccggagaccaccaggaacctctcccacttgctcatgtgccagtggttgcccttggtgatgccgggcttggagacgttgacggagacctggccgcgctcgggcgtgcgcaggaactcggtgaacgagccgcgcgcgtccgcgttgggcctgaggccgtaggagaagtttcccggctcgtagtaggacaggaacgtgctccagagcttcttggagaaggagccctcggtgaggtcgggaaccgacagcgtctcgcggctgtcgcggaaagtgcccagcaggtagacgatctcgcccagggtcttcacgtcggtgtcggggacgtagcagaacccgtcgccgtcgacgcgctcgatgccctcgtagccgcagcggtgctcacgccccagcagggcgcccagcatctcatccacgaggtcatcgatgtagaggagctccagctccacggaggggtcgttcacggtgtaggggcggccgttcgcgacggcgtcgcagaaggtggccacggcggagttgtagcgcgggcggcaccacttgccgtagaggttggggaagcggtagatgagcaccggggccccggtgcgctccgagtactcgcggaacaggccctcccccgcgagcttggactcgccgtagacagagccctcgaaccggcccgacaggctcgcctgcgcggagctggagagcatgacggggcatctgttcccgtggcgctcgagcgtctcgagcagcgcggaggcgaacccgaagttgccctccatgaactcggattgctcctttgggcggttgacgccggccaggttgaagacgaagtcggcgcgggagcagaagtcctccagctccccgggggtcgagtcgacgtcgtactccatgacctccagggggaggagttgctggtatttggcgcggcggtccttgccgtcccttatgttcttcagcgcgcagcagaggttcctcccgacgaagcccctggcgccggtgacgaggacgcgcaccctactgcaccgcctcgtgctcgcggccctccagggcaagctgcacgtactcggcggtcttgatcttggcgatggtgccagcaacgtcgagcctctcggtgttgtgggaggtgtaggactcgtcggcctgggtctccacctcgccgtccacgacgaacttgtcgtagttcaggtcgcgcgagtcgcaggccacgcggtagtagccgcccatgtcctcggccctcaggcgctcctcgcgggtcatgagggtctcgaagagcttctcgccgtggcgggtgccgatgacctgcgtgcccacgcggccgaagacctcctggacggcctcggcgaggtcgccgatggtcgacgccggcgccttctggatgaacaggtcgccggggttggcgtgctcgaaggcgaactgcaccaggtcgaccgcctcgtccaggttcatgaggaagcgggtcatgttggggtcggtgaccgtcagcggctcgccttttcggatgcggtcgatgaacagcgggatgacgctgccgcgcgagcacatgacgttgccgtagcgggtgcagcagatggtggtgcggccggcgccgttgcgggcgtttgcgtagatgatggactccatcatggccttggacttgcccatggcgttgatggggtatgccgccttgtcggtggacaggcacacgacgcggtccacgccctcgtcgatggcggcgtggagcacgttgtccgtgccgatgacgttggtgcgcacggcctccatggggaagaactcgcaggagggcacctgcttgagggcggcggcgtggaagatgtagtccacgccgtgcacggcgtcgcggacgctctgggcgttgcggacgtcgccgatgaagaagcgcaccttggaggcgagctccggcgacctctcctgcaggcggtggcgcatgtcgtcctgcttcttctcgtcgcgcgagaagatgcggatctcggccaggtctgtgttcatgaagtgcttgagcacggtgttgccgaacgagccggtgccgcccgtgatcatcagggtcttgtctttaaaggtggtcgaatctttcatctatttgccttccttacgtttggcttttgtaaactggtaaaagaggaatttcgtattggttacgaggtatcgtttgaaaagccgttttggctcttgaataagtctgtatagccactcgagactcaggttttgcatccatatcggcgcctctggcaccacgccagcgagaacattgaacgcgcctccaacgcctatcatcaacggttgagggccgcctttaagctcatgcatgagaacttcttggcggggcgcaccaagagcaatccatgcgaagtcagctcctgagttgacgatgcgatttgaaagctcgtgcttttccttgtccgacaaaggacggaaaacggatggctccattccagcaatttttaaaccggggaaatccctgttgagcgattctctgagggcgtcaagattcttctgttcatttccgtagaaatagtgactccacccgtattgactggaaatctcaaaaatctcgcgcatcaaatccggaccggtaacgcggtccatcgattcaaatgacttacggcctacaactgataagggcttgccgtcgggaacagacatgactgattccgcctggcaatcccaataggaggggtcatcatgagccaaaacagacgtgtgggcattagagacgcaaatgtactcgccatggagttcatcgatatgttcagttagaaaattaatgcaatctgacatgttcgttcccgtgatcggaacatcgatcacgggaacgcgattcaactcagagtatttcgaatagtcctcgagcattagcacgcacccttaccggtgatgacctcaataaccgtgaggacgacgatcttgaggtcggtgataacgcctcggttggcgatgtactccaggtctcggcggaccatgccgtcgaatccggtcgagttgcgctccgtcacctgccaccagccggtgatcccgggcttcacggccaggcgctgcaggtcatactcggtgtactccgccacctcgttcggcagcggcgggcgagggcccacgacggacatctggcccaggaacacgttgaggaactgcgggaactcgtcgatggagtgcttgcggatgaacttgccgatcctggtgacgcgcgggtcctcttttatcttgaacatggcgccggcgatctcgttctgtcccttgagctcggcgaggcgctcgtcggcgtctttgtacatgctgcggaacttccacatgcggaaggtggacaggctgccgtcgcgatgggtctgccccacgcggatctggctgtagaacgggttgccctcgctctctaggcgaatggccgcggccagcaccaggctgggcacggcaatgacggccagcacgcatccgctgaacacgatgtcgaacgcgcgcttgacggcgcggtagcccaggcgcgtgcggtcccagcccttcacggcctgcatggccttgtagcgcatgctcacgtcgccgccgctcattgcctgggcaaccagcgcggcccccaccggcgctccttctgaacattcagttttatctgacaatatttccttcaaacctacgtccccgcccccggggatcctccctgtcccgtttaacagtcgccaacagttaggcgatcgtcttttttaggtttcgcattgtgcgctgctcggctgaaagcacggcaaggccaacgcgggtggttacgcgtcggccgcacagatcgagctccaaataagcagtgctcttgcgtctgttaatggttttgataaggccttcgtggcccagcaacggacctgccgtcactacgacctggtcaccgtcttttagggcctcgctcatgggcactacgcggtttcccgcatgagtaaaactgctaataagctgggtctcttcggttgccagcggcacaaactgaccgtcctgggaaagcacccgagcaaagtcgtccatgcgcagcagatactgttgcacggtgcgaggatctgccgtatcgcagataagatatccgggaaagagcggctttgtcgtatcgacccattcgccgtgtacctttatctcggtttgaaattggggataaaagagttcctgcatggcgccagccggcgccatacgctcgatgcgctcgcgcattacgtcttcgcgaccgttaatgacctggatcacataccacacgagcaccacccccttgctgtcttacgtgtggctcacagggtttaggtatggcttcgccagggcgcttgtgcgcgaaggcactccatattcaaaccctgagcccagttagacaagcacgtggctctgccccaccgtgaacggtatgtatgcgtgcagttgctagagacgcggacgtgtatcgcaaaaagaccgcgtccccagctggctgcgtgcggcccagtaaagcgggtacaaaactggaccgcatgcaaacagctgtaggactgctgcgattagtcatgaaatatcgattcaaagtacagcttgaacaaagtcaagtacaaacactttcgatgcgatacgcatgacgacgctattggagctcgtggtttttctggcaccgccgttacggccggatgctgatcgaccttgtgctttgcggcttgctggagccgtgagcacagttgaactcatgtaacgctaggtattctagcacagcaggtggcccgtacgttttggggtgtgttgagcaacatattgtttatttgtcgtggttatgggagatattgtgccgtcttgcacgcattgccgcaggtttatggaggtgtgtgggttggcgatcactgcctgagttgtattgctgagggcgtgaattgctcaaactattaagtttggctaacaaactttgtacaaaaccgggaaggtaattgcgcaactttttgggcagcagttgtcgcaaaatttgcgacaactgctgctgccggcaaaattttgcaaataaaaaaggccactcgattgagtggccttgcattcacgatggtggagacgagggggatcgaacccctgacctcttgactgccagtcaagcgctctttgaacgtcagattgccgcttaggggcgtttgcagcgtcgagcagttacgcggtttggtaaaaccgcgtaactacagagcctcgagtgcgttggcgatgcgcttcatggcggcatcggcggatgcttggtcgggcgcttcggccagcacgcggataaccgactcggttccgctcttgcgcacgagcacgcggccctcgcctgccagcgcagcctcggcctcggcgatggcgttctgcacgcccatgttctcgagcgcggcgtccttatccgccacgcgcacggcaacctgcgcctgcggcagcagcttgcacggagccgtgagctgcgagagcgtctcgcgctcggcacgaatcacttccatcacgcgcagcgaggtcataatgccgtcgcccgtgcgctcgatatcgccaaagatcgtatggcccgtctgctcgccgcccaggctgtagccgccctcgcgcatcttggcatacacgtgacggtcacccacgccgctggtcacgacactcagaccggcaagctccagcgacttgaccaggccaaagttgctggcgatcgtcggcaccacggtaccgcccgaaaggcgaccgtgcttgttcaggtacacaccgcacacgtacaggatctggtcgccgtcgaccacgcggccgcgctcgtccacggccaggcagcggtcggcatcgccgtcataggcaaagcccacgtccaggccctgctccaccacgtggcgctgcaggcgctccatatgcgtagagccgcagtcgacgttgatgttaaaaccatcaggcgcggcattgatcacgcgcacgtcggcaccgagcgcgtcaaacaccggcttggccaccgaggatgccgagccgttggcgcagtcgagaccgatcttgacgccctgcagtgaaaagttcgcgctcgcgatgagcgaggcaatatagcggttgcggccctgcatgtaatcgaccgtagcgccgatgtggttgcctgtggccagcggcacctcactcttgccatcgatgtagtcctcgatgagctccagcacgtcctcgtccatcttaaagccgtcgctgttgacgagcttaatgccgttatcgcaaaacgggttgtggctcgcactgatcatgatgccgcaatcgaagcagccctccacggtctgatgcgccacgcccggcgttgggatcacgtgcagcatatatgcgtccgcaccgctcgcgaccaggccactcaccagcgccgcctcgaacatatagctcgagcgacgcgtgtccttgcccacgaccacacgtgccttgcgctcgcggttggcaccgtaataccaacccacaaaacggccaatcttgtatgcatgctctacggtcagcccaacgttggcctcgccgcgaaagccgtcggtgccaaagtacttcatatcttacttatcctgttcgaacgtttgagcggttggcgtggtacgaaccttaagctctttgtgcccagagtccttcgaagtcgtgaccgtgtactcgacctttatgtcttgtccaagaagcatgtggacaccgccccatgcaaccttcaagccatcgtgcgtcgcttcgttcatctcgatagaaccggagcccgaagtcttaatgtccgaaatgctgcctcccgcaggagcatagagataaagcctcagcacctcatcgtcaatatcctggctaatgccgttatggccctggaaataaccaggcatctcggccttctcctggggggtcatcgtattcttgagcgaggtggtcactcgatacgtcgtcgagccgtcggcattttcaaccgaagaatcgatggtgactcgcttatcgaggaaccaatccatctttgaatagctgtagttgttcacataaacgcccaagatcggagcctccgacgtatcggtttggagggcgcccgatattccaagagccttcgcggccttttcctcgtcatcgtttctcgaatacatgaggacgcgaccctcggaagcgcccttttcgatggcggcagcaatcttagtaatatcgctggagcccagttcgtccacgatcttgttaaaagctgacccggcaaccgccgcaaaaatggcgtcctgttcctctaccgggtaattccaataaatatcgtgcagcagcacctttgcagcgttgcttccatcaacgacggtgccgtcaggaagctgtgtgccacctacaacgccgagcatatactgcaaaaataccggatcgactgcaaatacaccgtcgatgtcatctccgacaatggccttctgcatatcgctggcaagctgagccgcgcgcggataatcgggcgtcatcgtaacgtcgcccatcgtgtatccgagcgtgttgaatccggtcaggccccatccggtcgtgaacaagtttgcctcttcatcggtgatgggaagcgggctcaaaggctctttcatcatgtcgactttgacaaaatcgcccagttcgagcttaccgtcagtcaccgacatcacgccgcgagaaccggggaaaccgccgcaggcgcgaatctcgacattgctcatcgcgagcacaagataatgacgcgtctggccgttggcgccgagcatctggggaaggacgggggcgaccttctccgccgcgtcaaccgcgccgttgagggtggcaaagccgtccttggccttatcgaccagctcggtcacctgggaaatatgagtatcgccaatgccctggatcttctcgttggcgctcttgaacaccttggagctatcggaaagcgaatcggcaacggcctgcagcgcggacacgttaatcatgccgtcctgaaacagcttgccgggcgtggcctgcgaaaggttatcggccatgggaaccagcgcattgctcgagacatcggacagggcgtcgatcatggtgcgggccgcattgatgtcgctgccatacaccgggataaacgaagccgccgtccacagcgggctcgaggtctccgccttcatgctgtcgcaaagctcatcaatcttcttcgcgtcgtcaggcagcgtcgaaaaatcgcccgacgtgaccttgtccttaaggccaccgacgatctcgacggcctccttcgcttcactctttacggtctttgccgagttaagcagcataaagccgcttgcgccaagcacaacgagaagcaccgcgactacagcggcaataatggcgccagtgtgacgttttttgcgctcgcccttgcgatggcgatgacggaccaggccgtcagaggtcgaactcgacgaagtgtcgctaccgtagttcaagccaaaatcgtaataatcttccttggaacccgagcccgcaaactcggcaccgctatcatccaggcgggcgaacgtgccagtctcggaggcgccggtgtaaatcgtgccaaggttacccgtaagccccgcgccaccggcagagggagtattgttggcggccttgccggcattaacgttgccggcggcattcgcgacgttggtagcacctgcgttgttcgcgggtaccgaaggagccccactcggctgcgacgtggaggttgcaccgcccgcaaagacatcccttcttgcacggccggtcttttttgccttttgagactgctcgtacagagcggtaaacatcgccgtctcgcccggggacacacgcttaccggaaccgccctgtccagcgccgcccggcgtaccggccttaccagccccgttcggacgcggcggaactgcaggacggccgctatcgctgcccttaaagtgattaccagccataaagaaatcctcgcaattgagtcgcaatgaaaaagtccataacgttactagtttatggcattttgagcatcgacagctaaactccagacacggacatcaattggcgaaaatgtggcacaacaccttttccgtcttggcggcggcgccagctacaccgtgaggaacatcatcacgatgatcatggcaaagccgataaggtcggtcggcaaaaacaccgtgcccagcataacggcgctcgtgatggtcgccgaaaccggctccacagttccgatgaggctcgcacgcaccgagccgatgtccttaacgccctgcatatagagcatgtaagcaaaaaacgagccgataaccacgaacaccgcgagcgcctcgacgccggcagcgtcgagtgccggcatatgcgcccagggctgcacgaagacacatgagatcacgcccgccgtgagcattgccgagcccgtgacgatggggctaccgtattcgggcaggatcttggcgggaatcaccgccatacacgcggcgctgaccgcacacataagacctgctgccaggccaagcggcgagatattcaggctggtagggtcgccgccggtggcaattaaaaaggttccacccagagccaggccaatgccgatgacttcgcgagtacgcggcatgcggcgatcggtcacgcaggcgtagcccatgatgataacgagctgcaggcactggagcaccgtcgcggttccggcgttcgtcaggcgcacggccgaaagatagcaaaactggttgaacagcaggccaaaggcggtaaagagcagcagctgcttgcgatcggcgggtgtggtccagagcttaatcaggcgctcgcggtcgcgcatgacaaccacggccataaagagtagaccggcgagaatctgacgcacgctcataagccacaaggtgtcgacgtggtaggtatcgaacagaaagctcgcgctggtgcccgagaagccccaaaacgaaccgcccaccagcgtggccaagacgcccgtgatcatcttgcgcgtcgaagcgctgttcaagcggtcgcgccatgcgcgacgggtgttgcggctgagctcgtcggtgccctcgggcacatcaatgttcgatatatcggtcatcggcaccgaagcctctgcaccttcgacctgctcgacacactctttgctcattccactcccccgaaacagcctggaaacaattcggcttaccttaccacggcgaaggcaccagccgaaggcttgtccgcttatcggtaggacaattccgcagacgtctttccatagctcgataccgcaatggccttgcattatgcgacagtcaaatcgcggcagcaggctcttttgaaatggatatgacaaagcccccgaattccacaatgtaagcgatttttaaaaatgttcttgccaccgagttcaggctccgttatattatcccttgcgcgcttgcgcacccttgatcgggcgtttagctcagggggagagcgcttccctgacacggaagaggtcagaagttctcgtcttgctcttcttgcgagaatgtcgttcatctcggcacctcatttcaagggttggcgactcacttggtagcactaacgtaagtataccaagcggtcgacccgccgctggctgggcatgcgcgtttgtctctctggaaacgagccccgttagaaatgttgagttgtttacgcatgctctggggcggcagtactatcatggttcgaattgagtgtgaatgatgatagggagcgccttttatgattgagctgctcaggcgttttggcggtaagtttcgccggtatatggtgattggtcctgcgtgcaagctgatcgaagtgatctttgacctgctgacgccgctcgtgattgcgcagatgatcgacaagggtatcggcgcgcacgacgtcaacgccgtcgtccactacggcatgttgcttggtgccatggccgtgatcggcatctcatttacgctcgtctgccaaaagatggcggcgctcacctcgcagggcatgggtaccgacatccgcggcgcgctctacgggcacatcaataagctgagctatgctgagctcgatcgctttggcacgccgtcgctcatcacccgcatcaccaacgatgtcaaccaggtgcagcttgccgtggcgctgggcgtgcgcatgctcatccgctggcccttcttggcggtgggctctatgtgcgcggcccttgccatcgaccttaagctcggcatcatctttttgatctgcacgcccgccatcggcctggtgttttggtttgtcatggcgcgctgcattccgtactacaagcagctgcaggcaaagctcgaccgcattgcgctcatttgccgcgaggggctttcgggcgctcgcgtggttcgcgccttcgtgcgcgaggaccacgagcgcgagcgctttgcccaagccgccgatgaccaggcgcatgttgccatcgcggtgggcaagctctcctcgattctcaaccctgtcacgtttctcgtgatgaacctgggcgtgtgcgccatcctgtgggtgggcggcatccaggtcaacgtgggcgagctcacgcagggccaggtcatggcgtttgtgaactacatgacgcagaccctcacctccatcgtgtacgtcgccaacctggtcgtggtctttaccaaggcgagcgccagcgcgtcgcgtatcaacgaggtgctcaactgcgcgccgagcattaccgacgagggcaacgagccggtcgctctgcccgagccgagtgcgatgggcgacaccgctttggtccccgcgctgagcttgagccacgcgagcttctcctttggcgcgggcgctgccaacgccgttaatgatgtgaccctggagctgccgctgggcaaaacgcttggcatcatcggcggcacgggcagcggcaagtcgacgctcgtctcgctcattccacgcctgtacgacgcgggcgtcggcagcgtaagcgtgatgggtaccgacgtgcgctcttggccgctcgaccagctgcgccatgtggtcgcgaccgttccgcagcgcgcgtcgctcgtgagcggcacgattcgcagcaacctgacctggcgcgacgagtccgcgaccgacgaggagctctgggcggcactcgatatggcgcaggccagcgagttcgtgcgcaacaagccgcagggcctggatgccccggtcgaagcgggcggcaagaacttcagcggcggtcagcgccagcgcctgactattgcgcgtgccctggtgggctcgccgcagatcctgattatggacgactccgcctcggcgctcgactttaagaccgacgcggcccttcgccatgccattcgcgagcgcagcgtgcgcggcgccgccgagggcgggctgccgctgacgaccgtcatcgtgagccagcgcgtctcgactgtgcgcgatgccgacatgatctgcgtgctcgaccacggctcggtcgcgggcctgggcacgcatgacgagctgtacgcaagctgccagctctaccgcgaaatctgccagtcgcagctccgccgcgaggagcttgagggccagcaagggagcgcggcgcccgcgtccgccccaagtcccgcgtccgccccgactgcccctgcatccacctgcgcaaaggagggctgctagatgaatccgtatacttcttccggttcggtcgccacaatgacggccaatgtgtccggcaacgataaccttaacgacctgggcgatggcccgcgccagcccggcgaccccgagcgctatcccgtgggcgcggtaacccgtcgcctgatgggctacgtgcgtccgcaccgcatttcgtttgcggcgtcgtttgtgagcgctgccatctcggtgatcttgcagctctacacgcccatcctcatcggcgaaggcatcgacctcatcgttgccgccgggcaggtggacttcgatgcgctgttgccgcttgtcaccaagcttgcgctggtcgtggttggcgctgcggcgttccagtggctgcagggctactgcgtcaaccgcctgtcctacgagacggtgcgcgacatgcgcgtggaggcgagcgacaagctcagccgcatgccgctcagctttatcgacagccatgcccacggcgacctcatgagccgtgtggtcaacgatgtcgaccaggtgggcgacggcctgctgcagggcttcacgcagctctttaccggcatcatcaccatcgtgggcacgcttgcgtttatgctgtccatcaacctgaccatgacgctcgtggtggtgcttgtcacgccgctttccatctttgcggccggcgccatcgccaagctctccaacaagagctttacggctcagcagcgcattcagggccagctcggcggccatatcgaggagtatgtgggcgagcaaaagctcgtggacgctttcgcctatggcccgaacgcgcagcagcgcttcgatgccctcaacgccgagctctacacggcgggcgagcgcgcgcagtttatgggttcgctctctaaccccggcacgcgctttatcaacaacatcatctacgctgtggtcgccgtgatcggctgcgtgggcgtgatcacgggcgtgcccgcggcgctcacggtgggcggcgtgcagatcttcctgtcctacgctaaccagtacaccaagccgttcaacgaggtcaccaacgtcattacgcaaatccagacggcctatgcctcagcgcgccgtatgttcgcgctgctcgatgcccgcgagcaggagcccgacgccgtggatgccattgagctcgccgctccgaagggcgaggtcgcctttgagcatgtggactttagctacgtgcccgatcgcaagctgctgcagaacatctgcatcgacgccaagcccggcatgcgctttgccctggtcggtcccacgggctgcggcaagacgacacttatcaacctgctgctgcgcttttacgatatcgatgccgggcgcatcgtggtcgatgggcattcctcgcgcgactacacgcgtgagagcctgcgccgcgcctttggcatggtgctgcaggacacgtggctgttcgagggcacggtggcccagaacattgcctacggttgccccgacgccacgcgcgagcagattatcgaggccgccaagcgcgcgcacgcacacaagtttatcgtgcagctgccaggcggctacgacacggtgattggcgaggacggcggcacgtttagccagggtcaaaaacagctgctgtgcatcgcgcgcgtcatgctcaccgacccggcgattctgctgctggacgaggccacgtcgagcatcgatacgcgtaccgagctgcaggtgcaggcggcattcgacgagctcatggccggccgcacgagctttgtcgtggcgcaccgcctgtcgacgatccgaaatgccgactgcatcctagtgatgcgcggcgggcagattatcgagcgtggcacgcacgacgagctgctagcggcaggcggcttctacgccgagctctaccgcagccagtttgcccagtgagagctgccgattggcggcagatggtttacatctgcgtcgttagtactaagatattcatctaataaattgcattagtggctttagttttgggggaaacgaggcaacgtgactatgacgtgctctttggtggttaacagcaagagcggtaataccaggatggtttcgggcgcgatcaagcgcgctctgcaggctgcgggtgttgagtttatccacgccgcggcgttgagcgacgatgcggatgcagatcaagttgcccgcgaggcgcagggtgcctgcgcagccgacacggtactcgtcggtttttggtgcgacaagggtgcatgcacgccttcggtcgcggcgctgctctccgccctgcacggcaagcgcgttttcctctttggtacctgcggctttggtgccgaccagagctattatcagcagattatcgatcgcgtgacctccaatttggccgatgatgccgagctcgtgggctgggccatgtgtcaaggcaagatgggtcccgcggtcaagcagcgctacgaggccatgctcgagcaagatcccgacaacgcgcgctttaagatgctgctcgacaactgggtcgccgcaaaggatcatcccaccaaagaagacctcgaggacatgtctgccgccgccaagaaggccgtgctgggggagtagctcccatcgctgacggcggtcggttcatctttctaaatgcaacgtcctcccgggcgtcggggcacgaagttccctgctctacagtcctgcgcaagacgaaggccacattaagtggccttctttgcgcgcggaactcgcgatgagcttcgtgccccgtcgtccgggagggcgcctctttattgatgggaggcctgataggtcgatggttccgtgcccggatgcgtccaaagtgggacgggctttccggatgggcaggctttcggaaaatgcgtcccggaatttgcctttggaatgggacgtagtttcccgttgaggtgctttgcggaaagtgcgtcccactctgggcgttcgaagtgggacacactttcccaaaggcgctccaacgggaaattgcatcccgttattcggtcaagaaacgggattttcccaatgagagcaaaaccggaaaatacatcccagaaatggcctttgagctgggataagatttccgcggcatctcggattctcaaaaatgagacacgccgttggcgaaaatgagacacgtgatatcgggcgtcggacgtatcatttgcaaaaatgagtccactccactcgagtaaagcgaggtccctcatgtacgttccacatccccgtatccgtaggctgtcgaaaatcccgcttgccgggacggcggcgcttgctgcgttgatcgcaacgagcgtcgcctgtttcacggcggctcccaacgtcgcccaggcggccgacacgcctgagatcaccgatatgaccgagcaggactatagcgatttgggcctgggcacgagcgaggacattccggccgataccgttggcccctattccaccgatacccccacgacgtttgccacgcgcagcgaggtctatatggcagctaacggcagccatggcaatcgctacactctgcgcgacaagctcgagaacgtcgagcgcggcgatattggcggcagcagcaaactcaccgatggctatggaagtgtgtggggcgccgcaaagttctggcaaaacgtcaacaatttcgatacgaacagcgacctctacaagcacagcgattatggcggcggcacctggtcgtatctgagcaacaatgagtcctcaacagtgctcgccaacgacaacaacggcttctcgggcattcacgccacaagcgttgagttctgcagcgatgccaccacgggcaaaaagagccgcgttgccgagcttcgcgcctatggtgacagctcgtccacgacgatcgacggcaagtcgtacgccggaaaggttgagctggtcctctattcgtttagcaacgggcgcacgcgcagccttgatacgcgcctgccggtgacggtcaacaccaatatgatggacggaggccgttttaagtatctgaacgccggctacctgcaagagcacgacgccgtctttgatgtcgaggcgggcgatgtcgatggtgacggcgtggacgagctttttgtctatgcgggctgctatgtcgacgagagcggcgtgcgtaaggctgtagtcgatatgtacgacctggagggcggcaactggaggcagagtgtcgtcaaaatcgacgccggtaacgccgcggactacaccacgcacaacgagggcgggaacgactcttggacgcagctgcagtcagctcctgtcgtttcgctggctgccggagacctcgaccgggatttttgcgatgacctcgccatcgtggtctcggcaccctacggcaagaagaatatcgccaagtcgacgcattgcgagctgttctcgtgggatgcatccaagggtgcactcgtccatgtcgatgctctgggtgacgcgggcgcaatctccctctcctcgaacggcaagaccatggtcgctgcgaatgcgacgttcggcacgtttgccgcctacgatgaagaaggaaagaagacgggtgaaaccgtcacgggccttattcttgcgggctatgactggcaacgcagcgcttttgattacgacgcctatgacggcagcaagggactgtacggcgcgctgtaccgctacgcgtattttgactcggagtctggcgagttcaaactatccgattgcaaggaatacagagacgggctccttgcctcctatggactgatgcatgtgcccagcagcgcatggaaggatagtgctcaggataagcgctatccgtgcaccttggcgcctattgcccttgccactgccaaccttgacggtctgtctgagcagccggcggtcgacgaggtgctcgtgggcggcgatgtgttccgcgactttgcctgcaacacggcgcagagcggggcccagggcttgggttccatggtcggaaccatgagcatgagcggccagcaatacaacagtagcaacaagcatgaccacaagggtatcgagcaggtgtggatcagcgacgttaaggcgggcagcgtctcgggttcggaccgctataacgagagctttatcgccgtagtgggcaagcaccgcgacgaggacctgcgcaagaacgatgattactattggatgaccgcctcgcatttttcgctcgacgagaacggaaaggtacgccgcggcgaggagcaggtgattagcgagagcaaccgtcgcggcactacctacggcacgtttatctcgctcgcgctgcccgatgtcgacaacgacagcgtcaagatcacgtacaaggaccgctataaggtctataccaacccgcgcgtgcttgccgtgctgcaggatgcgccctatgttgaggacctggagcaggcatacggctatctggtgctgggtggtacgtcatacggagagggaaagggcacgggggaaacccagggctataccatcggtgccgagttgggcgttgccgtcgaggtacagaccggtccgcccctggtggcgattaatgcttcagtcgattttgccgccgagggatgctatgactaccggagcgagcgcacagtgagcgccagcgtaagttatgagtcgcatgccggcgaaggcgacaaggccgtgctctacacgattccgatggtctattacgagtacgagatcgaaaatgaggaaactggtggcaagggcgtgatggcggcgcccgtgtcgctcggcgcgcagacctcggtcgttaatgtcgaggcctatgaccgcattgccaaacagcacaacatgacgccgctcagctactttttgaccaaccggtcgggagaacccgacagctattacacggcgctcaacggcacgactcccgtgcaagattcctttggtctgggcaagcccggcgtgacgcgcgcctacacgcacgatgggtttaacggcgccgtcgcgcagtcgggagcgagtattgagcagaccatcgaagtcgaggagggcgaggagcaggagtttgagtacggctttacgctgaacggcagcgttgtcatgggcgcgaagcttgcaaagcacgagttatttggcggcctgtgctttggtgccaacgccggctttactacgggtaactcctcgagtgaatcgaccgaatacggcggcaccgtcgacaacctgcccgaggccgcgaaggataagtacggctttgcgtggcgcctgggcgtcaacgcggtggatgtcgacaagttcgaggcagactcgggcgacaagctcggcaccaaggacaccgaccagttctggatcgtgggctatgaggttaaggacgtcgagatgcccgacgcgccggccgtgacgggctttacggcaaacgccgtcgattcgaccagcgttacgtttagctgggacgatgtactcgcaaacaagagtggctttagctacggcgtgggcatgctgcagagcaatgcggcggatgcggtcgtcaatagctggaagattgccgacaacacgcagacctcgctcaagtgggatgggctgcagcccaatacggagtatcgattcgccatcgccgccgttaagaatggatccacgaccgaaacaggtattcgctcggcaatcatcacggtcaagaccatgcccgatggcatgacgatgaccgtgagcggacctgcggcggatgctgcggaggggtcggatcttggatacgactcttcggttgagcgcacggcgggaagccacctgacgctctcggcgattggccatgtgaagcaactcggtgccgacgatagcgaaacagggctggcaccgacctatatgtggtaccgcaagggccgcggcgagacagagtttaagctcgtgggtgccgatggcaacctcgcggctggaacggcctcaaaactcgagattgacctgaccgcagacgatgacggtgcgcagtattactgccacgtgggatacaacgacgtgggcctcgacaccggcacgacgctcgtgaatatcgaggccgaggagacggcgcccacaacggtgaacgccaccccgatccgcacgcgccgcctgttctcacaggcaagtgcgggcgccaagaagttcctggaccatacgctggtaaacaccgccggcccaaccgattccgaaggctcaaaggaccccgagactcctgagaccccgacgaacccggacaagcccaagtccgacaacggagctaagaccgacaccaaggtcaagactacgaccacagcgaagaacctcgcaaacaccggcgaccaaacgttcgccatggtcgccaccgcagctgcagcgggcgcaacgctcgtagtgatagccctcatcatgctaatcaaacgtcgcaagacccactagcacccagtcgaacatatcgacaaagtaaaacccgggtagccaaacaacttgctacccgggttttctctatattagaaatcagagtcttcaaggcaagagcccgattcaaccagagacactccgaatactccccacgacaagccgtgcttcaacaacaaggcgtctgcccgggcggcgcggaatgtaaggttcatcgcgagttccgcacgagccggagagcacttaatgtgctctccgtgcgagcaggtccaggccgtccaggtcgcggtcctgcccaagggcgaccccgccccgggcgacacctccacgcctttcgtcgacaggtcctccgagcccccctcggtctcctaccgcgcccacgtcgccggcatcggctggcagggcgccgtctcggacggcgccgtggccggcaccaccgggcagggccgcgccctcgaggccctctcgggctccgtctcctggtacgggcacggatcctcctccctcgaggtgagggcccacgtctcgaacgtcggctggcagggctggacctcggggaccgccggcaccaccgggcgctccctggcggtcgaggcgctccagttcaggctctccggcgaggccgcctcgtcctacgacgtctggtaccgcgttcactgctccgactacggctggctcggctgggccaaggacggcgcgtccgcgggcacggtcggcctgtcgaaggccgtccaggccgtccaggtcgtgctcgtccccaagggcggcgccgcgccggggccggccggcggggccttccgcggcgccggcgagcgcctgtccgggtcgtccctctccgtctccggctcgccggcgggctcgtcgttctcgggcggggtcctgacgctcggctccgagagggggcccgtgctgggctccgtcgccgcgaccgtcgacaacctcgagtccgacgggtcggtctgctaccgcggcctgctgctgggctccggctggcagggggaggccagctccgacggggcgcagctcggcgcctcgggcggcgggctccagctcaaggccgtccgcttcgagctgtccggcggcctcgcggaacgctacgacgtctggtaccgctcctgtgactccgcgcgcggctggctcggctgggcgagcgccggcgagccctccggcgtcgagtccggcgcgtcgggcctcaccgccgtccaggtcgccctcgtcgcgaagggctccggcgcccccggcccggccgagggggcctacgtctccggcgccgcctccggcccgtcgctcgtcctgcagggccacgtcgccgagcgcggctggctgcccgcggtgggcggcggcgaggacgtcggcacgaccggcaggggcctcgcgctccaggccgtgcgcgcctccctcgagggggcgggcgaggggagctccgtctccgtcgcggcccacgtggccggcatcggctggcaggacgccgcctccgccccctcctacgccggcacggtggggcagggccgcgccgtgcaggccgtgagggtgtccctctccggccccgtctccgagcgctacgacgtctggtaccgcgtccacgcggccggctacggctggctcggctgggccaaggacggcgaggccgcgggcaccgaggggctcggcgtccaggccgaggccctccaggtcgtcctcgtcgagaagggcggcgacgccccctcgacgggcgcccccgccgagctctccgtcccctcgctcagcctcagggcccacgtctccggcgtcggctggcagcccgccgtcggcaacggcggcaccgccggcacgaccggccagacccctcggacaccggcttcttcacgctgtccgagtccgagatggttcagcaggaccgccaagaccgtaagcaggccaaggtccgtcgccgtcatcgccacacgggtctcaaggtcttcatcgtgctgcttctgctcatcctgatcgccgcgggcggtctgggctttgcctacacgcgcggccttgggttcccgtctcaggagtcggtggttaccgacctgttccaggctgccggcgatggcgacaccgccaaggcggagtcttgcctcgcctcgagcctgtccgaggacgccaagtcgatgatcatctcctcgattccgcagggtgctaccgtctccgtcgagggcatggaccagtccatgaccgagacgaccgccaaggtgaaggcatcgctgtccaagggcggcgagcaggagtacaccgtcaagttcgtccgttccgacaaccatatcggttgggccgtgtcttcgctcgatatcgatttctcggccgctgacaaccagtagtgaccttatgggatttggctttgcccggcgcttcaccgcaagtgaggtgccgggcttgcgctagtatgatgggctagtagttttccagcaatcatccaacatatcaggagttgcgttgttttctttgatggatatgttcttcggtagctatgcgggcgatctcgcgatcgaccttggcaccgccaatacgcttgtctccgtgcgcggcaagggcatcgtcattcgcgagccctctgttgtcgccatcgacaagaacgatgagcgcatcctggccgtcggtatcgaggccaagcgcatgctcggccgtacgcccggcaacatcgtggccgttcgtcccctcaaggacggcgtcatcgccgacttcgatgttaccgaggcaatgctgcgctactttatcgacaaggcgtccgagaagcgctatccgtggactccgcgcccgcgcgtcgtcgtctgtgttccctccggcgtcacgtcggtcgagaagcgcgccgtctttgaggccacgatccaggccggcgctcgccaggcctatctgatcgaggagcccatggcggctgccatcggcgccgacctgcccgtcgaggaacccaccggctccatggtcatcgatatcggtggcggcaccaccgaggtcgccgttatcgccatgggcggtattgtcgtttcgcagtccatccgcattgccggcgatgagttcgatcaggcaatcctcacgcacgttcgcgatgcctataacctggccatcggcgagcgtacggcagaggacattaagatcaaggtcggctccgccgtcccgctcaaggacgagctcgacgtcgaggttaacggccgcgatgttatcacgggcctgcccaagaccgtgcgcatcgagagcgaggagatccgtcgcgcgctcaacaagccgctcgacgagatggccaaggccgtcaaggacgcgctcgacgccacgccgcccgatcttgcctcggacctcatgtactacggcattttgctgaccggcggcggcgcgctgctgcgcgggctcgacgtgcgtctgcgcgatgagaccggtgtttcggtcaacgttagccccacggcgctcgataacgtcgtgaacggctgcgcccgcgtgctcgaggccaacgcgtttgacggtggcttcgtccagaccaatgcttaatttccaaaaggtggattccatttggcacgatcttcgggtttctccacaaatctgaataccaagcgacaatcaacgggtatgcgcccgttgattgttttcagcctgatttcggtgttgctgctcacgttttacatccgcgagggcgaggctgggccgattcatgccgttcgttcgggtgtgacgacgatcacctcgccggtgcgcttcgtgggctcggccgtggccgcgccgttcaatgcgattggcaacgtgttctccaacctcacggcgtcgcaggaaacgctcgacgagctcaaaaagcaaaacgaggacctgacctcaaaggttgctgagctttccgaggcccagaagactgctgagcgcttggagggtctggtcgggctgcagtccacctacaacctcaagtcgaccgcggcccgtatcgttggcgcctcgggcgatgcctggacctcaacggtcaccatcgataagggttctgccgacgggctttccattaacatgcccgtgacgagctcggccggtgttatcggccagattatcgaggtttcggccaagacgtcgaccgtgcgcctgattggcgacgagaactcgggcgtgtccgctatggtgcaggacacgcgtgcccagggtatgttgcagggtcaggctgacggtacgttgcgtcttgagtacgtgagtgtcgactccgacgtcaaagtgggcgacatcatcgtgacctcgggcatcggtggcgtattccccaagggcttgccgctcggcactgtgtcctcggtggagaagtctgccaacgacgtgtactacaccattgtggtgcgcgcccagactacggccgagaacaacgaggaagtgctcgtcatcacctcgctgaccgacgagcagtcggcttcggacgaggacgtgagcaccgccaacagcacgccgcaaggcacgtcgcgcgatgccgcgaccaagactaaggacgagagttcggacgacagctccgacacgtccgaaacgaccgactccggttcgagtgaatagggaggcatgtccgtggatcttcacgagcagggggctggctcccgtacctttgtgattgccgccatcgtctgcgtgttgctgcaggcgggtttggccccgcagatctccatcgctggcggtcgcgttaactttatgattatcctggtgtgcctgagcgcgttctcgggcgaccccacgcgtgccgtcgtctgcggtttttgcagcggcctgttttacgacctttcggcggctgttccggtgggcgtcatgtctttgctgctgacggttggcagctttgccctggtgcatagcgctgccggtcagacaagcggcaccccgagcgcgcgcggcgttaccgtaggtgtcttcgcgctcatcatcaacgtgatctacagcatcatcttgctgttcatgagtctggagacaagctttgtcgtggcgatttttggccacgccctgccgtcttcgatcctgacgggcctggtcgccattccgtttttgatgtccggcgtcgtgccgcagtccggttacggattctccgcacgtggcggtcgtcagacgggtatgcgctttaagcccaagactcgcaaactcaaataggggaggctcgtagatgtcttcccagatgacggttgttatcgccggtatcgtgctgctcgtggccattgtggtcgcactggtcattatgcgtcgcggcgattcccgctttacctacgacacgcagcatggaacggccccgcgcgccaccgagggcgagggcaataccgcagcgaccgcctttaagggccgcttctccatcctcaccgcaggcgtgggcgcgatgtttgcggcgcttgccgttaagctgtggggcatgcagatggtctcgtcggattattacgagaaacaggccaacagcaatcagactcgcaccgtcaccacgcctgccgttcgcgggcgcattctcgatcgcaacggcgtggcgctggtgcaaaaccgtccctcgcttgccgtcgtcgcctatcgcgaccttgccgacgataccgtgttggtccatcatctcgccaacgttctgggcatgccctacattgcggtccttcgcaacattcaggacaattccgagggcgctcagagcctgcataccatcgcgacggacgtgcgccgctcgacggtcgcctatattcaggagcacgccggcgagttcccgggcgtgaagattgccgagcgtaccgagcgtcagtacccgtatggcgagaccgcctgccatatcttgggctataccggcaccatcacctccgagcagctcgaggcgcagaataggaagtcctctaatgacaatgatgcctctgctggccagattacgtaccagtcgggcgatatcgtgggtcaggcgggcgttgagagctactacgaaaacctgctgcagggtatccgcggcgagcagaccgtcaaggtcgatgcctcaggcaacgtgaccggtcaggccggtgccgtgcccgccaaggccggctcggatattaagctcacgctcgaccttaagattcagcaggcttgcgagacggcgttggcgagcgctatcgagcttgccaagaccacaggctacagcaatgccggcaacggtgccgtggtgtgcctcgatcccaataacggcgagatcctgggcatggcaagcgagcccaagttcgatccttctgtttttatcggcggcgtctccaacgacgtgtggaccgagctcaacgatgacgagggttcgcacccgctgctcaaccgcgccatcagcggccagtacatgtcggcctcgaccattaagccgctctcggcgctggctggccttgagtttggaacctacacttcaacacagacaaccaactgcacgggctattggacgggcctgggcaaggcttggggcaagcgctgctggctgacgtctggtcacggcaccatgacgctgcagtcgggtatcgccaactcgtgcgaccccgtcttctacgacatgggcaaggcattcttttacgacgaccagcattccgagggcctgcaggaggtctttcgccgttggggcctgggcaagacctgcggcatcgacctgccgagtgagggcgcgggccgtattcccgatgccgagtggaaagagtcgtactttaccgacgcctcggccgaggatcgcaaatggaacgcgggcgatatgaccaatattgctatcggccagggcgacatcctggtgacgcctttgcagatggcctgcgcctatatgggccttgccaacggcggcaagcagtacgtgccgcacgtgttcttgtcggccgtgtcgcgcgatggcgacggcgatgcctataagtacaacggcaagggcaagaaaaagcgcctggaggccaaaatcaatagcgactcggatctggctcttgttcgcaacggcatgcacgacgtgatttataccgcttcgacgtcgctggcggctcactttggcaccctgacgccgcaggtatacggtaagtcgggcacgggcgagaaaagcggcgaggacgaatacgcatggttttgcgcctatgccccggccgatgaccccaagtacgtcatcgctaccgtcctagagcagggcggcggtggctccgataccgcaatgcatgtcgtgcgtgacgtgctcggcgtgatttatgacgagcccgatacctcatcggcttcgggcgattcttcggttcgataggaggttgcgatggatttttcgccggcggatctgttccgctcaaccaagaccggctcccgtagcagcctagaccgcgtcaacaagcagctttcggcctcgcgcggcacgtttcgccagaaggtcaatgtcggtgttctgctggcctctgtggcgctcgttacctacggcgccatcatcatctggtcggcctcgcagtttaaggccgatgcgtcattctcacgccatctgctgggaatcgttattggcgcaatcctggcggtgcttgtttggcgtaccgacctgcgcggcatctccaacttctcaacggcgctgctcgtcatcgacctgatcgtgatcttctcgcccaagattcccggtctttcctatacgggcggcctaggtatgacgggctggatcaagatccccggtatcggtctgaccttccagccggttgagcttgccaagctcatcaccatcttcttcatcgccacgcttggctcgcagtacaacgggcgcatcgataccgttcgcgactacgttaagctctgcggcatgctgtccatcccgtttttggccgttgtcgccatgggcgacctgggctcgggcctggtcgtgctggtctcgggcgccatcgtcatttgcatgagcggtgcgcgccgcgaatgggtgctgtccaccctggctctgttggtgggcttggtggcgcttatcttggcgctcgactcggtcttcgattcgctactcggccacgacgtgctcatcaagcagtaccagatgaaccgcttgacggtctttatcgaccccgacaacgccgattcggacgatgcctacaacctgcagcagtcgcttatcgccgttggctcgggtggctttttcggtaagggcttgggccatgcgacgcagtctgccggcggctttctgcccgagttccacaccgactttgtcttcgccttcctgtccgagaccttcggcttttgcgggtcctttttgctcctgtgcctgtatgtgctgcttatgttctcgacgattcgcgtcgcctttaagtgcgagtcgctgttcctgcgcctgtcgtgcgtgggcatcgtcggcatgtgggcattccaaaccttcgagaacatcggcatgtgcattggcatgatgccgattaccggtattccgctaccgttcattagcttcggatcatcgtcgatgatgattcagttggtgacggtgggtatcgtacaatccatatggcggcatcgttcgggcgccgcgtaacgctggaggggtttgctatgaagattcccgtggacaagcttacccgcgcttttaagatgggcgcgtctgttaagaaggactccgatacgccggtgcgcgtctcggtgtacttggattcgtctgcctcgcgctttttggtcgagacggtccgcgatgcctttgtgccgcagacgacgtcgggcattgtgcgcgttgaacgcctaggtgaggagcgtatcgttcccaagaccgataccgatgtggtgctggttctctcgtgcggctccgactgcctggagagcgccgtgcaggagctcgtgattgccggtgcgcccgtgtgcgtgctcgctgagtctgccgtcgaggtgccgttcatcgaggagtccacgcccatgctcggcgtggtggcggcgaccgacaagacgtatctgctcgagacgctcgcgcgttggattctcgatcgcaccgacaaggaaacggcgtttgccgcgaactttgcctttatgcgtatcgccgctgcaaaccgcatcatcacctcgtgtgcgctcaccaacatggcgaccggggctttggtgttcttgccgggtgccgactatcccgttatggcgctggcgcaggttggcatgctctttgagctcgccgccgtctttgggcgcggcattaagcccgaacgcggctatgaggtcgcgggtgtgcttgccggtggcctggtgatccgtgccgtcactcgcgcgctcgtcaagcagacgccgcatatcgggtttgccgtcaaggcgctcaccgctgccgcgggcacctatggcatgggccgtgcactcgtttcgctctatgagcgcgatgtcgactacagccgtgccaacgaggttgttactgccacgttctctcgcgttcgcgacctggtaaccacggtcgccggcgccacccgtcctatggcgtcctaccaggatgtatccgatctcgctgcttaggggttttcgttgcgcgttccgtaccaagactgttttcacttaattgagccgctgctcgccaaggtcgagaagccgagtcgctatatcgatcacgagtggggcacgctttccaaggccgatgccgactaccgttgctgcctgatctatccggatgtttacgaggtcggtctgcccaaccagggcatcgccatcctctacaacattctcaaccaggccgagggcatttcctgcgagcgcggttatgtgccgtggcccgatatgggcgacgccatgcgcgaggcgggtattccgctgctgtcgctcgagggtgcggcaccggtcgcttcgtttgacatcgtcggtctgcatgtgccgcacgagatggccgtcacaaacttcctcgaggcgctcgacctcgccggtattccgctgctggcggccgaccgtggcgaggacgaccccatcatcatcgccggcggcccctcggtctataaccccgagccgtatgcggccttcttcgatgctatcctgatcggcgagggcgaggagtcgctgctcgagacctgccagctgcatcgtcgcctgcgtgacgaaggagtcccgcgcgcgcagatcgttgaacagcttgcgtctgttgccggcaactacgtgccggcgctctacgaggtgcgccatgacgagccctgttcgccgcacggctataccgtgccgcgtgagggcaaggatgtgccgcccgtggtgtacaagcgcgtcgtcgaggattttggcgctaccaatccgctctcgcagtcgtgcgtgccctatgcgcagctggtccatgaccgtctgtccatcgagattctgcgcggctgtgctcgtggctgtcgtttttgccaggctggcatgacgtatcgtccggtgcgcgagcgctccgccgaccagatcgtgtcctcggtgatccagggtctggagaagaccggctatgacgaggtctcgctcacttcgctttccacgaccgaccactcctgcattcgcgatgtgctcggtaggctcaaccgtcgtctggaggacacgggcattcgcgtgtccattccgtcgcagcgcctggattcgtttggtgtggatatggcagagtcggtcgccggcgaaaagaagggcggcctgacgtttgcccctgaggccggcagccagcgcatgcgcgacatcatcaataagaacgtgaccgaggaggacttggaccgtgcggccaaggcggccttcgaggccggctggaaccgcatgaagctctactttatgatgggccttcccggcgagcgcgacgaggacatcgtagctatcgccaacttggccgaccacgtgttggagcttggccgttccgtggtgcccaaggcgcgccgcggatctatctcggtgtccatctcggtttcggtctttatccccaaggcggccaccgcgtttcagtggtgcccgcagctcgattacgacgacgttaagcgccggcagaagctgcttatcacgagcgtgcgcaatcgcgccgtccgcgtgcattaccacgatgccgagacctcgctcatcgaggccgcactctcgcgtgccggtcgcgatatgacgcccgtcatcatcgatgcctggcgtgcgggctctcgctttgacgcctgggttgagcatttctcgctcgataactggaaggcagccgccgccgaaaacggcatcgacctcaacgagttggtgcatctgccctacgagctggactggcgcctgccctgggagcacgtgagccccggctgcacgcgcggtttccttgagcgcgagtatcgtcgctcgctcgagggcgtcacgacccccgactgcacccgcacgtcgtgcaccggctgcggtatctgtcccacactccacgccaagaacgtattgatgggtgatcgcgcatgagtgagcgcttgaccgacaatcccacgctctttaggctgcgcgttcgctacggtaagcgcgaccgcctcaagtacctgggccatctggaactgattcataccattgagcgcatcgtgcgccgcgcgggcctgccctatgccgtcacgcagggcttctctccgcatatgcgcgtgggcttctcgtcggcgctgccggtgggaacgtcgtcgacttgcgagtggtatgacctgtttatgaccgagttcgtctcgctcgacgaggcgtttgagcgtctgtccgcggcgtccccggacgatctggcgcccatcgaggccgcctacatcgacgtgcgcacgccggcgttgacggctcagctcacacgcctgtcatatcgcatcgacctgcacttggaccccgagtccccggtgagtgccgacgaggtgcgcgctgcgatcgatacgctgcgcgcgggccatggcatcgactatgcgcgcggcaaaaagagcaagcgcctcgatctggaccatacgcttgtgggctatgagctcacggcgggggagcgcacggaccatctggtgctcatgctcgacacccacgccgacaatgagggctccatgcgtccggaaattttgctttctgctgctgatgttttgttgcagggcttgaccccgggcgtcgatgcacctattgtttccaccggtatgcaagacctcgtgaccatctgctcctacgatgtcgagcgtcagaatcaagcatgcgaggacgacgagggccgactcgtcagccccatacctgtgcgaacttgtggatttgctccacatactcgttgacgggggtattttcgcctgctactatattcggctgttgcactaactgatgcatgaagggcaagtaaacatgtacgcaatcgttaacacgggcggcaagcagtacaaggtcgccaccgacgatgtcatcaccgtcgagaagatcgagggcaatgagggcgacaaggtcaccctgccggtcattttcctcaacgatggtaagaagatcgtcaccgatcccgacaagctggccaaggccaaggttaccgctcagatcgttgagcagttcaagggcgagaagcagctggtcttcaagttccacaagcgtaagcgctatcgtcgtctgaagggtcaccgtcagcagctcaccaagctgaagatcgtgaaggtccaggctacgtcccgcgccaagaaggctgtcaaggcagaggccgaggctgttgccgaggctcccgtcgccgagtagattacactcgtaacgaaagagtaggtatacacaatggcacacaaaaaaggactcggttcctcccgtaatggccgtgactcccgcggtcagcgccttggcacgaagcgcttcgccggccagacggtaaccacgggcacgattctcgtccgtcagcacggcacgcacatccacccgggtgagaacgttggccgtggcaaggacgacacgctgttcgcgctggtcgacggtaccgttgagttccacaagggtatcaagcacagggtcagcgtacgcccgctcgcgaacgcgtaattcacccttcatagagcacatatgtgggaggcacttgagttttaggattcaagggtctccctcttttttgtaggaggcgattctgttgtcacagttcaccgatatcagccgcattaacgtgtgcggcggcgacggcggagccggatgcatgtcgtttaggcgcgaggcatttgtccccaagggcggccccgatggcggcgacggcggtcgtggcggcaatgtcgtcatccaggccgatgctcagctttcttcgctgatcgattaccgctttaagcatcatttccgtgctgagcgcggcacgcacggtcagggcgcccgccgcaacggcaagagcggcgaggacctgattctgaaagtccccatgggcaccgtgctgcgcgagctcgatcccgagacgcagaccccgatgttcgagatcgccgacctggtgcatgatggcgagcgcgtcgtcgtggcccccggtggcgccggtggtctgggcaatacgcactttgtgacgtcggtgcgccgcgcgcccgccttcgcccagctgggcgagccggccgaggagcactggattgagctcgagatgaagctcatggccgacgccgcgctcgtgggctttccctcggtgggcaagtcctcgctcatcgcgcgcatgagtgccgcacgccccaagattgccgactacccgtttaccacgctcgttcctaacttgggcatggtgcgtgccggcgaatactcctatgtcgttgccgatgtccccggcctcattgagggtgcgagcgagggcaagggcctgggccaccagttcctgcgccatatcgagcgcaccgctttgatcatgcatgtcgtcgatatgacgggcggttttgaggatcgcgatccggtcgaggactatcgcatcattaaccgtgagctcgagcaatacggtgctgagctttcggagcgcccgcagatcgtcgttgccaacaagtgcgacgcgccgggcaccgcggataagattgccgacctgaagcgcgcggcgctcgacgatggacatatgttctttgccgtgtctgccgtgacgggcgccggtctgaacacgctgatgcttgccgtgggcgagcaggtggccaagctccgcgccgagctggcggtctctgatgaaccggtcgatcttcgtgatgacgagtgggagcgccgccgcctgcagcgcgagaagcgtttccgcattgtccaggaagagcccggtgctttccgcgtggtcggtcgtgcgatcgagcgtatggtcatccagaccgactgggaaaacgaggaagctgtcatctacctgcagcataagtttgctcgcatgggcgttgacgacgcgctcgagaaggccggttgccgcgcaggtgacgaggttcgcatttgccagcgcgcctttgactttgagggcgccgaggatttctcggagtacgaggatgagctcgaggatgcgggcgttgaggtcgttgaggtggcggatgccgcggatgagagcgtcgaggctgtcgacgcagcggacgtcgctgacgatgttgagaccccggagggcgagtaggccatgtcgctgcgcggtggaatcggtttgcctgagcttcgcattccagaaggtcgggaatatcgcttaggcattatgggcggcacctttgacccaatccattacggacacctggtgaccgccgagcaggcgcgcgagtcgctcgacctggatgccgtgctctttatgccggcgggctctcctgcctttaagctcgacaaaccggtgacgccagctgaggaccgttatgcgatgacggtcctcgccactgccgcgaatccagcgtttttggcgagccgattcgagatcgatcgcgagggtgtcacctacacagccgatacgctgcgcgccctgcgcgagttttatccgccgcaggtaaagctctactttattacgggtgccgatgcgattatcgatattgtgacctggcatcatgccgatgagattgccgagctggcaacttttattgccgcaacgcgccccggcttcgatatcgatacggcccgtgctcggatcaaggagtcgagcttgccgttcgacgtgcgctatatccagattccggcgctggcgatcagctcgacgaacattcgtaagcgagtcgcccgcggcatgagcgtgcgctatcttacgagcgagtccgtgctcggctacattcgcaaacgcggtctgtatgccgatctgggccaagaagattttgagtgatgggggtcaacgttgaccgttgaagatcagtttgagggcgatgaacgcgcactgctcaagcgcattcatgagctgctcgatgttcgcatgaaggacaagcgcaagcgctatgtccattcgttgggcgttgccgagaccgcgctacatcttgccgaggtgtatggtgtcaatcgttttgatgccgctgccgccggcctgattcacgactgggacaaggtgctctccgatgatgagctcgtggcgcgtgcgctgcactatggcatcaaggtcgccggttctccctctgccgcgacgccgctgctgcacggcccggttgccgcttatgagcttccgcagctctttcccgagctttcgccagcggtctttcaggctgtcgaccgtcacaccgtgggcgcctgcgacatgacgccgctcgatatggtggtctttgtggccgatgccatcgagcccaaccgtcacggcgattacgcccatggcttacgcaagatggtgggggagtcgacgctcgacgagttgttcttctcctgttttgcgcagggtctggtctatgtgatccagaccgggcgttatctttatcccacagctattacgatttacaaccattacgcccagctgcgctagcttgggctgtctagaaagaggtattccatggccgatgagaccatgactgacgagcagattcttgagggtgtggagcacaagagcttcgccgccacgtccgaccgcaccgccgcctcgctgcccgcgagcggtgttgccgccgaggatgtcgcccgcgccgccgcgcaggccgcctacgacaagaagggcgaggacgtgcaggtgctcgatctgaccgagctctccgacgtgtgcgactactttgtgctcgcaaccggtaccaataaccgtcaggtcgattctattgttgatgagatcgaggagaaggtcgccgaggcttgcggtgagcacccgttctccatcgagggtcgcgagcagaagacctggatgctcatggactacggctcggtcgtcgtccacgtcttcacccccgaggcacgcgacttctatcgtctcgagaagctctggggcgacgctccccagctccccctcaacctcctctagtagttaatttgggacggggcttttttagctaccctcaagtatttcgccgggcagtcgccttttccgcagctgcccggctttctttttgcccaaaagtagctaatcgttgaagcgggattggcggccgaaggatagggcggtgtcgccgaatttgtctcggacggcgtcgattgcaacggacaggtcgcgtcggtcgctggactgggctccgcggtcatcgacttcgcagaacaggtcggtctggatgccgccctggtggttgaagtcgctcatgccgatgccggccaggcgcacgtgcataccttcctgccagatgttgtcgagcagctcgagggcaaccgcaacaaagatattctcgtcatcggtggggtggggaagcctgcgctgtgccgtgcgaccgctgccatacgaatacttgagcttgagtgtcacggtgccgcccgtaagcccctgacggcgcagacggcgcccaaccgactcgcccagcagtgcaatggctgcctcaatgtctccgcgctcggtcaaatccttggcgaaggtgcgttcattgctcaccgatttgacctcgcgctcctcatccaggctcgtgaccccagaaacctcgagccccaacgcacgctggcgcatacgctcgccattcacgccaaaaatagaggccaacgttgactccggtgcgcgagaaagctcgcccagcgtaaagatgcgcatgcggcgcagccgctcctcggcagagcggccgatgccgctcatggcagacaccggcagcgcggccaaaaaacgctgctccgtgccggggcgcacgatggtcagaccaaacggtttgtcgcgctcgctcgcgatcttggccaccgtcttgttgcagccgacgccaatggagcaggtcactcccagcgccgccacgcgatcgctgatgcgccgcgccaccagcagcgggtcctcgggcgcaaagcgtcccggcgtaatgtcgataaaggcctcatcgatggacacacgctccacacgcggcgtctcgtcggcgagaatcgccatgacctgtgcgctcacctcgcgatagcgatcgaagtgcccatgcgtccaaatcgcctgcgggcacaggcgacgtgcctcggccgaggccatggcggaatgcacgccaaagcggcgcgcctcatacgaacacgtggacacgacgccgcgcgattcggcgtctccgcccacgatgagcggcttgccgcgccactcgggatggtcgagcatttccacgctggcaaaaaacgcatcgaggtccatcaggcccaccgccggacccgtccagggcggcggcgtgacgcccgcagcatcctcataaccgtatgtatgttcgcgtctttccatgtcatgagtataccgcgcagctcatgtggggtgcgtggatgtgcttgcaaatcgtgaattcttgtctaagatatggatttgccttcgactacaccgaagaagttggtctcacggacttcacctgcccgcgtcgatggcgtattatgttcaactgtttgtttgtagttgcagcctaaagctgcttggttggaggagtttcctttggcagtcaagattcgccttgctcgtcacggcgctaagaagcgtccgtactaccgtgtcgtcgtcgccgattcccgcgccccgcgtgacggtcgtatcatcgaggaggttggccgctacaacccgatgaccgcccccaagaccatcaacctcgacctcgagaagatcgccgactggcagtccaagggtgctcagctcaccgacgctgtcgccgctctggtcaaggccgccaacgagggcgagaagaccgagaccgtcgtcaagaagtccaagaagcagctcgccaaagaggccgaggccgctaaggctgccgctgaggccgctgagggcgccgaggagtaaatcgtgcctgaggttgacgctgcacagctcgagggtgaggcaatgctctcagatcgcatcgccgatctcgtcgaatatctcgttgttcagatcgtcgacgacccggattccgtgagccttgaggtcatcgatggtgacgacgcctccacgattgaggtttcggttgccgaggatgacgtcgctaaggtcatcggccgtcgtggccgtaccatcaaggccattcgcacgctcgcccgtgcactggccgctcgcctcgacactgctgtcgaggtagaggttctgggctaggaccttgaggtcccagtacaaaaacatcgcccgtgtggtcaagccgcacggaaggaagggggaggtcctcgcgcaaccgctgcgggggcttccttctgtattggagccgggtatgcgcgtcgccctgacgccgccggcgctcaagcgtgaccgtttttgcacggtcatgtccgttaccgatacgggcgatggcgatctggtctcgtttgagggcattgacgacttgacagccgccgagggcattaccggatgctacgtgctggctaaccgtgatgactttgaacttgattcactcgacgctgcctataccgaccttatgagtcgcgaggtggtcgatgagcgcttcggttcgctcggaacgattgtcgagatcatgtcgacgcccgccaacgatgtttgggttgtcgagggcgatcggtacggcgaggtgctgattcccgtgatcgagcaggttgtgctcgatcttcccgacacaggaacaatttccgtccatgttatggacggcttgatcgatacggacaagtagggaggacaacatgctgatcgagaccctttcggtctttcctgagatgtttgagcccgtcatgtccacatcgatcttgggccgcgcccgcaaggccggcctttttgattttaaggcgtataacctgcgcgactggacgcatgaccgccatcgcaccgttgatgacgagccgtatggcggcggacagggcatgctcatgaaggtcgaacccattgccgaggccatcgaggccattggcgccgagggccccaagcccaccgtggtgttctttactccttgtggcgagccctttacgcagcatgtggccgagcgcctactcaaaagcgagcgcctgctgttcgtgtgcagccgttacgagggcgtcgacgagcgcgcgtatgcgtatgccgacgagcgcctgtcgatcggcgactacgtgctcacgggcggcgagctgcccgcgatggtcgttgccgatgccgtcgtacgcctcattcccggcgccttgggcgatgagatgagcaacgtggacgagtcgttttcgaccgctgaggacggtggcctactcgagtacgcgcagtacacccgtcccgccgagttcaacggcgagggtgtgcccctggtgctcgtgagcggcgaccacgccaaagtcgacgcctggcgccgtaagaatgccatcgagcgcacctgccgctggcgccccgatcttatcgagacggcgcggcttacgtccgaggagcgcgcatttgctcaggaaatcctggacgcttcgtattcgcagagcgaggagtgagtatggttccatcgcagcattccgcgctgaggggcgcttttgagtggatcgcggttgtcgcgatcgcgctcgccgccacctttctgatccgcacgtttgtggtcgagccctttgtggtgcccaccggctccatggagtccacgattgagattggcgatcagattctggcgcaaaaggttacccttgagctcggccagcccgtcaaacagggcgacatcgtggtgttccataaccctgatggtacctccgagcacgatgtgctcgtaaagcgcgttatcgccaccgccggccagacggtcgacctccaggacggcaaggtcgtcgtcgacggccagacgctcgacgaggactatacgaccggcatgagctggccgctttcggtccaagctcccggcgctcaggtgagctatccctacactgtccccgacgggtgcgtgtgggtgatgggcgataaccgtgagaactctgctgactcccgttactttggcccggtcgaccgttccgatttgattgcagtggcactcgttcgctactggccgctcaaccgcatcggcgctatcgactaaaaaccgctatagtacagtacctaaccgtgtaatcgtttcgacgaggggatattagaggcatgaacgcttcatcgctttccttccaagacatcatcctgcgcctccagcagtactggggcgagcagggctgcgtcattatgcagccctatgactccgaggtcggtgccggtaccttccataccgcgaccacgctgcgctcgctcggtcccgccgagtggcgcacctgctatgcgcagccctgccgccgtcccgccgacggccgctacggcgagaaccccaaccgcatgcagcactactatcagttccaggtgctcatcaagccctcgccggtcaacgctcaggagctctatctgggctcgctggccgccatcggcctggaccccaacgaccatgacgtccgctttgtcgaggacgactgggagagcccgacgctcggcgcctggggccttggctgggaggtctggctcaacggcatggaggtcacgcagttcacgtacttccagcaggtgggcggcatcgaggtcgaccccgtgcccgtcgagatcacctatggcctggagcgtatcgccatgtacgcacagggcgtcaactccgtctacgacctggtgtggagctacctgcccgacggcacgcccatgacctacggcgacgtgttcctggagaacgagcgcgagttcagtgcttacaactttgaggtcgccaacgtcgagatgatgcgtcagaagtttgacgactacgaggccgagtgccactcctgcctggagcgcaagctgccgctgccggcttacgactgcgtcatgaagtgcagccacgccttcaacctgctcgatgcccgcggcgcgctgtccgcggtcgagcgcgccaactacatcctgcgcgtccgcgccgtcgccaaggcgtgctgcgaggcctacatggccgaggtcgccggaatcaacgagaatgccgaccaggaaggcgaggtggcgtaagccatggcagacgctaaggatttcctgtttgagatcggtacggaggaaatgccctccgcaccgctgaacaatgccgtcaagcagcttggtaccatgatcgccaagggtctcgacgaggccggtctggcccacggcgaggtccgcgtgatctcgagcccgcgtcgtctggccgcgctcgttgccgatgtcgccaccgcgaccgatgaggtccacgaggtcaagcgtggccccgcggctaacatcgccttcgacgccgacggtaacgccactaaggccgcccagggctttgcccgcaagtgcggcgtggctgccgaggacctggtccgtcgcgaggacaccgacggtcgcgagtacgtctttgccgagaagaacattccctccgcaccggcaaccccgatcctgacggccctgtgcgagaagaccattgccggcctgcagtggcccaactaccgctcccagcgctggggccacgagcacgccaccttcgtgcgcccggtccgctggatttgctgccttctgggcgaggatgttgtgcctgtgtcatttgccgacgtgacgagcggcaacaccacgcgcggccatcgcgtgctcggccccggtgaccacgttgtcgccagccccgccgcctacgagcaggtactcgaggacgccggcgtgctttctgccgagcgccgtcgcgaggccatccttgccggtatctccgaggtcgaggccgctcgccccggctgccatgtcgatacgcccaagaaggtcttcgaggaggttatcaacctctgcgagtggccgacggtgctcgtcggcaccttcgatgaggagttcctcaaggtcccgcatgagatcatctgcgagtccatgctcaccaaccagcgctacttcccgatctatgacggcgagggtaagctcacgcgtgagtttgtggtcgtctccaacagcaagcccgagaacgccgagcgcgtgatcgacggtaacgagcgcgtcgtgcgcgcccgtctggacgacgcaaagttcttctacgaggaggacctgaagatctccctcgacgagttccgtgagcgtctggccaaggttgccttccaggagaagctcggtagcgtgctcgccaagtccgagcgcatcgagcagctcgcgctcgctatcgcccgcgaggctcacctgggcgcccatcttgccgccgacgctgctcgcgccgcgcacctgtgcaaggccgacctggtgtccaacgccgtcgtcgagttcacgagccagcagggcgtgatgggcggttattacgcgaccgcgatgggggagaacgacgaggtcgcccatgctattcgcgatcactatcgtcctcgctttgccggtgacgagctgcccgagggcaccgctggctgcattgtggcctgcgccgacaagctcgataccatcgccggtatcttttccatcggcgagcccccgaccggctcttcggacccctatgcgctgcgtcgtgccgctatcggcatcatcaacatcctgcgcgaccgcctgccgattgaccccacgtcgctcatcgacttcgccctcgagctctacagtgagcagggcattgagttcgacgccgccgaggtcgcccagcaggttcgcgacttcttccatggccgcctggtgagcatggcccgtgacgaaaagatcccggccgataccgttgccgccgtctccgcggtgcacatcatcgctccgtccgtcttcttcgcccgctgcgccgccctcgacgaggcccgcaagaacgacgctgagacgttcgacaacctggctaccgcctatgcccgcgccgcgcacatctccaagcccgagctgggtgcggagtacgaccgcagcctgatgggcgaggtcgagcttgcgcttgccgacgcctccgaggctgcccagaccgctgtcgatgccgcccttgctgccgaggattacccggccgcatttgccgccctcgccgccctgcgtgcccccatcgaccgcttcttcgacgaggttatggtcatggacaaggacgaggagctccgcgataatcgccttaagttgctcaaccgcttcgaggccgttttctccggcatcgccaacatcggtgagcttgcccgcaaaaagtaagctagcctgcgcataagcgcaaaaggagccccgcatggattgcccggtcaccgctcgtcccaccgttatcgttatctccgactcgctcggtgataccgcttgtgaggtggtgcttgcggcgtccgggcaatttgatgaaggggcttttcatctcttgcgcctgcccaaggtgacctcggtggagcaggttaaatcgtttgtgggcccgcgtgtcgatgcggaccatcgcgatattgccgtgttccacaccattgtcgatccggcccttcgtgctcgtgtgctcgactacttgggcatgctgcacattcgctcggtcgacctgatcggtccgacgctcgccgtgctgtcgtcgctcatcggtgtgccgcccaagggcgttgcgggcgtgattcacaggaccgatgaccgctatttccatcgtatcgaggccatggagtatttcgttgagcacgatgacgggcgcggttgcgacgatctgtcgggtgccgatatcgtgctgctgggcgtatcgcgcacgtccaagacgccgttgtcgatgtatttggcctatcaaggttacaaggttgccaatgttccgttggcccatggcatggagccgccgaagtcgatttacgaggttgacccgatgcgcctgttcggcctgatttcgaccgtcgatgtgatttccgaaattcgcgatagccgcttgggcgacgactacgcccgtgccgtcgccggctcctatgccgagcccgagagcgtgcgcagcgagctcgaggaagctcgcgccctcatgaagcgcctgggctgctttgtggtgcgtaccgacggcaaggccatcgaggaaagcgctgccgagatcatcagccacttggaggaaatccaagaagctcgcgcccgccgagccacccgccgcgcctaatagtagtatcattttgataaagcgatttagcaaaaacatcgcatctgacctgcttttttattgtagtggtatcttcataaggtaaccaactttacctaccgtttaccgccagttttagcacgtttaccaaaccgcgtatcctctgctcaagcccgttcaaatccggccgtatagttccctcacggcccgcatccggcgggtcgattcgttaccacggtcgtgcgcgtaagcgcatggaaggggaagtatcgtgagcgattgcaagagggtttaccgttttggaaccgacgcccagggcacctgtgtcactgagggcgacaagtccatgaacttcgtgcttggcggcaagggcgcaaaccttgccgagatgagccgcatcggcctgccggttcccggtggctttaccattacctgccagacttgcgtcgagtactccggtgccggcaacgtctggcccgaaggcgcactcgacgagatcgttgccgccgaggcagacctcgaggcccgctgcggcaagaagctcggcgacgcctccgatccgctgctcgtgtcggttcgctcgggcgctccgttttccatgcccggtatgatggatacggtcctcaacctgggcctcaacgacgactccgttcagggtctcatcgcccagacgcaaaacccgcgttttgcctgggatagctaccgtcgctttatccagatgttctcaaacgtcgtcatgggcgttgacgccgacctgttcgaaaacgccctgacccgggcccgcctggtcgctggcgttcgcgtcgattccgagctttcggccgaggacctgcaggagctcgtcgagacctttaagggcatcttctccgagaacgtcgaggcgaccctgtatcccgagctcgaggtcgccgacggtaagcccgttttcccgcacgatccggagctccagctgcgccttgccatccaggccgtctttggcagctggatgaacgagcgcgcctgcatctaccgcaagcagcacggcatttccgacgagctcggcaccgccgtcaacgtccaggccatggcctttggcaacaagggcgagacctctgcgaccggcgtcgcctttacgcgcaacccggccgacggcaccaaggagttctatggcgactttttggtgaatgcccagggcgaggacgtcgtcgccggcatccgaaacaccgagcccatcgccgacctcaagaccacctcgggcctcgagtccgcaggcgaggagctcgagcgcgtgttcctgacgctcgaggatcattaccgcgatatgtgcgatatcgagtttaccatcgagcagggcaagctctggatgctccagacccgcgtgggcaagcgcaccgccactgccgccctgcgcattgctatcgaaatggtcgaggagggcctcatcacccgcgaggaggctgtgagccgcatcgatcccgcgcagctcgaccagctcctgcacccgcagttcgacgcctccaagaagtacgaggccctggccagcggccttaacgccagccctggtgccgccgtgggcgaggtcgtgttctcgagtgatgacgccgtcgcgcgttccgccgagggccacaaggtcattctggtccgctgggagaccaaccccgacgacctgaagggcatggtcgccgccgagggcatcctgaccagccacggtggcaagacgagccatgccgccgttatcgcccgcggcatgggtacgccctgcgtttgcggcgttgagcgcttccacattgacgcggcagagaaggtcgtgcgcatcgagggcagcgaccgcgtgctgcgcgagggcgatgtcatctccatcgacggcacccagggtatcgtcgtcgacggcgcggtcgacctggtctctgcagagctcaccggcgacctggacaccatcctgtcttgggccgatgagatccgtttggacgagaccgacggtcacgccaaccgcgtgcgcgtcaacgccgacaaccccgaggatgccgagctcgcgctcgagtttggcgccgaggccatcggtctgtgccgcaccgagcacatgttcctgggcgatcgcaagaacatcatccagagctttatcctgtctgacgatgaggccgtgaagcagcaggccctggccgacttgctcaaggttcagaccgaggacttcctggcgatgttcaagaccatgtccggtcgcgatgtggtcgtccgcctgctcgatccgccgcttcatgagttcctggataatcctcgcgagctcgaggtcgccatcaccaagaaggaggccgccggcgctcccgaggaggagctcactgccctgcgcgcccgcctgcgtcgcattgacggcatggtcgagtccaaccccatgctgggcttgcgcggcgtgcgcctgtccgtcgtctttggcgatctgccgctcatgcaggttcgcgccgtcgccacggccgctgcccgccttatcaaggagggtgtcgacccgcgccccgagatcatggttccgctcgtttccatcacggccgagcatgtccagacccgcgaggttatcgagcgcgtgatcgccgaggtttccgccgaggaaggcgtcgagctcaatattcccgtgggcacgatgctcgagctgccgcgtgcctgcatggtcgctgacgagatcgcccatcatgccgacttcttctgctttggcaccaacgacctcacccagacgacctttggcttctcgcgcgatgacgccgaggccaagttcatcccgctgtacatgcataaaaagatcctgaaagacaaccccttcgagaccatcgacgcggcggtgctggagctcgtgcgcttggccgtcgagaagggccgcgccaccaatcccgacatgcactttggcgtgtgcggcgagcacggcggcgaccccaagtccatcaagggcctgtttaacgtggccgacgtggactacgtgtcctgctcgccctatcgcgtgcccctcgcgcgcctggctgccgctcaggccaagctcgaggccaagcgttccgcctaacgttttgggtttagacgcctagcgtagcccccttcatgccgcccgtctcattcgtgagacgggcggttatcatgtgcgggttttgtctttttgtctgcgcaaaaaattgttcttgcagcagaaacccgcgcgtgtatactcgaatacgtttgttcaactacgtgccggccaaggtggtacggcacctctagaagagtaaggaattgcacatggattacatccgcgcaatcgagcgtcagcagatccgcgaggacattcctcaggttcgcgtcgccgacaacgtcaaggttcactaccgcattaaggaaggcgaccgcgagcgcattcaggtcttccagggcgacgtcatccgcatggccggcgccggtgcccgcgagaccttcaccgtccgcaagatgtccttcggtgtcggtgttgagcgtaccttcccgcttcacagccccaagatcgccaagctcgaggtcgttcgtcatggtcgcgtccgtcgcgccaagctgtactacctccgcgacaaggtgggcaaggctgctcgcatccccgagaagcgctaagaagatcgcagcgtctgtccactcgtttggacacaagggtcaccttcgggtggcccttctttttatctgatttgcatgcaaggagggcctggtatggccaacatgacgagctcggtttcggcatcgcaggttgccggtgagttggcgagcgctacgtttgaggagattcccgccctcgtggagcattatcgcgaggacccgcgccagcaggtgatcaaggcttgtgaacgcgccctcaaacgccatgccaaagagcttgccgagcgcgagcgcgtcaatgacatgtacgagcttatgcacgagcttggcggcgatggggtggtcgttggtgtcgacgaggtgggtcgcggatcggtggccggtcctttgacggtatgcgccgtctgtcttcctatggagccgcgcgtctggggcatcaatgattccaaaaagctcacgcccgcgcgccgcgagttgctctcagtgaagattgccgaggtggcgacggcgatcggtttttgccatatcgcgccgaaggatatcgatgagatgggcatggcccgtgctatccgtaccgccgtcgcgggcgccgtggccgatacaggactcgagcccgactgcgtcctcatggatggcaatcccttgggcgccgttcctaacgagcgcgatgtggtgaagggcgatgccaaaatcgcctgcatcgccgcggcgtctatcatggccaaggtcacgcgtgacgagataatggtcgagtacgacgccgagtatcccgagtaccatctggccgagtcgaagggctatgcaagccccgagcatatcgaggccattcgcaaacatggactttgtccgctgcaccgtgtgagcttttgcggaaactttctgcagactgagcgccttttctaggtcaattgtggagacagggacctctggggttttataaacctgctggtagcgggccgtatgcaacaccattgctgcgtacggcccgttttttgacggcatttggtcagcttttggtttgcttccggtacttacccgcatgaaaggtgccctcatcatcggggcactgcagtgtgcgggaaaggagaccccatgagtgccgcaagcaaaaagagcaagacgcagcagctcaaggagcgttgggaaaacggcgagctcgactgcggggcgatgacgcccgagtttatcaagggactcagtccccgcgagctgggcatgatgggcgagctgatcaccatcgactactttaacgagcgcggctacaccttgctggagcagggttatcgttgcaccgagggcgaggccgatctggtgctgctcgatgagctcgacgatgtcgtggtgatggccgaggtcaagactagacgcgtcgccctggattgcgacgcgcgggtctttcccgaggaggccgtggacgcccaaaagcaacgccgctaccgccgcatcgcaagctgctatctcatggagcattatccgctcaaggcgattcgcttcgatgccgtgggtgttaccattcgcggcgggcatatcgccgagatcgagcatcagtacaacgcgttcgattggcaggtgtcgtgatggcgttcgagacgtttgccgttcacgcggcctgcatccgcggcgtcgaggcgattcacgtcacggtcgaggtctcgcttgccggtggcgttccgggcatccagatgctcggcattccgagtatggaggtgatggagtcacgcggtcgtattcgctgtgcgatgcgctccgccgggttcgagattccgcgctcgggcattacggtcaatctggcgcccggcgatattcgcaagaccggtagcggctttgatctgcccatcgccatcgcggtattggcggccgatggtcagatttcccgcgacaacctcgatcgttgtcttattgctggtgagcttggcttggacggtacggtgcttcctgtcaagggcgaggtggcgtttcagctattggcgcgtgatatggggctgtcctttatcgccggcaggtccgatcagcatgtgccgcttgcgggcgtggattgcggatttatcgatcatttgtctcagcttgctcatggtatgggcgatgccgcgcggcactacttggattctgaagtgctcgaggcgacctttgagcccgaactcgactatgccgacgtgctagggcaggaggttgccaaacgcggcatggcgcttgcggcggcgggtgagctcggcttgctcatgattgggtccccaggttcgggcaagacgatgcttgcgcgtcgcatgaccggtattttgcccgagctttctgttgaggatcagcaggaggcgctgtgtatccattcggtcttgggcgaaaacatcgatgggctgctggcggggcatcggcccttccgaagcccacaccacagcatttcgaccgcgggccttatcggtggcggacgtccggtgcatccgggcgagatcagcctggctcatggcggtgtgctctttttggatgagctcgccgagtttcccaccggcgtgttgcagacgctgcgccagcccatcgagcgcggctatgtgaagatcgtgcgtgttgacggggcctttaccttcccgtcgcgctttcagctgctgtccgcgagcaatccctgcccctgcggctttttgggtgatcgcgaagtgccgtgtcgctgctccgcctcgatggtcgaacgctatcgggctaagttacgcggtcctttggccgaccgtatcgacatgatgctcgacgtgacccgtcccgacccccaggtgattatcgagggcgccgagggcatgtcatcggccgagttgcgcgattacgttgtgcgtgggcgcgccttccgcgcctggcgcgagtcgcatatggacgatgcggacgccgaggccgaggatgacgagtcccgctccattgacggcgtcgtgtcgacctttgcgctcgacgaggcggcagagaagtgcgtgcttggcctgtcgaagcgtacgcatctcacgggtcgcggcatcgtgcgtctggtgcgcatcgcacgcacgatcgccgatgtcgccgaaagcgagcgggtgacgcaggaccacgtgctcgaggcggcgatgtatcagggaaggagggaccaatgatggcagaggggatcttcgagttgcatcccggtgatgcgttgtatccagcagctgttctagaactttccgatgtgccccagacgctctatgtgcgcggcgatcctgccgtgttatcgacgcccgcgctctccatcatcggcgcgcgcaaggcatctccgtatggccttgccgtcgcggaacttgcggccaaggtggcggttgaggcgggcgtcacggtggtctcgggtggcgccgtgggctgcgaccaggcgtcgggttgggctgcggtcaatgccggcggcaaacacgttgtggtgctggggacaggcgccgacgtggtctacccgcgctcgagtgcggggcttatcacgcgcacgctcgatacgggtggtgcggtcgtgtcgatctcgccgtggggcatgggtccgcgcaagtttgccttcccgcggcgtaatcgcatcatcgccgcgctgtcgcaggcactttttgtttccgaggcgggcatgccctcgggtacgttctcgacggccgaggccgctatggacctgggacgtgaactgctcgcggtgccgggttccatcctgtcgcccgagtcgcgcggtaccaactacctcatcgccaacggtgcctgctgtatcgtggacgaggaatccatcgagatggccatttcacgcatctacggcaccttgcgttactcgcgccccgatgcgcccggtatcgccgatctggaccctatgcaacagaccgtgatgcatgcgcttatcgcctcgccgctcaaggtcgacgacattgccgcgctcgtctcgctcgatgccgtcggtgtccttaagctcctgggctcgctcgagctcgagggcctcatcgagcgcatgatggatggaaggtatgcgccctcaaagtttgcgcttcacgctcagacgcccttcggtcacaatggaaagcgtgtcaattagaaaggtgtttgcagatgctgtttgatcaggtgacggttattggtggcggtctggcgggatcggaatgcgcgattcagctggcagatcgcgggttcgccgtaaagctgtgcgagatgcgccctcaggtgagttctcctgcccaccataccgatcacttggcggagctcgtctgctccaattcgtttaagtcgacccgtccggactctgctgccggcttgctgaaggccgagcttgagcgcatgggatcggtgctgctcgattgcgcccatcgtgcggccgttcccgccggcggcgccctggcggtcgaccgcgtcaagttttccgagcttgtcgaggccgaggttgccgcccgccccaatatcgaagtcgttcacggcgaggtcacccggattcccgagggccatgtggtcattgccgcgggaccgctgtgctcgccggcgttgagcgaggaagtcatgaagcttgtcggtggtgacgccctggcgttctttgacgcggcggccccaatcgtcgatgcctccacgctcgatatggacgtgctgttctcgcagtcgcgctatgaggagcaggggagtggcgactatcttaacgccccgcttaacaaggaagagtacgaggcctttatcgaggcgctcactacggccgaccgtgtggtgcttaaatactttgagggcggcgacctgttccaggcctgccagcccgccgaggaggtcgcacgcaccggcaaggacgccatccgttttggcgccatgaagcccgtcggactcaccgacccgcgaaccggtcgtcgtccctgggcggcgattcagctgcgcgccgagaacaaggagaagaccgcctataacctggtgggcttccagaccaatctgaccttcggcgagcaaaagcgcgtgttccatatggttcccggtctggagaacgccgagttcttccgctatggcgtcatgcatcgcaatacctttgccgatgcgccgcacgtgctcgacgggacctttgccgtgcccggtacgagtgtgcgccttgccggccagattaccggcaccgaggggtacatggaagcggtggcgaccggtctgcttgctgcagtcaacacctatgccgaggctatcggggccgcgggcgtcgagctgcctcgcgtgggcgccctgggtgcgctcgtgggctatgcgaccgatcccgccacggtgggctaccaacccatgcatgtcaactttggcctggtgccgccgctcgaggacggcaaacgccgcagcaaacgcgatcgctaccaggcctatgcggaccgcgccctcgaggctctcgatgcctacttggtcacgcgttccgacctgtttggaggcgaccggtcatagcctttgacctgtacgataccgtcgactcgtttatcgcctatatcgcacgcgtcgagggtctgtctcccaacacggttgccgcctatagctcgcgcctggaacgttttgcggcttggtgcaagcgtacgggcaccgacgcgcgtgcggccgacgtgcgcaccgttcgcacgtatttggccgagctctcgcgcgagcaggtggcaccccgcacgcttgcggcgcatctgtcggctatccgatcgttctatcgctggatggctgctgaggggattgtggagggcgatgcggtctcggcaatctcctcgcccaaactcccgcgcgacttgcccggggtgctgacgacccagcaggttgaggagctgctccgtgcccccgacaccgcgatgcccgcgggattgcgtgatgcggcgatgctcgagctgctctatgcctctggcgcgcgcatctccgagctcgcggcgctcaatgtggaatccattgcatggtccgagcgcacgctgcggctgtggggaaagggcagcaaggagcgcatcgtgcccctgtatcgccgcgcgctcgaggcgacccgcacctatatcgaggaggggagaccggcgctgctcgcccaggcaaagcgtcgcgatgccgcaaatggtccgcatccgttgtttatctcggcgcgcggcaaccgcatgagcgccgccatgctcaggagaaggttccatatgatggcgacgctcgccggcattccggctgacatcgccccacatgcgatgcgccatacgtttgcgaccgatctgctcgagggtggcgcggacctgcgctcggtgcaggaactgctgggccacgcgagcctgtccacgacgcagatctatacgcatctcacgcccgatcggctcaagaacgccgtggctcaggcccatccccgtggagagtagatagggcgtctcgcgctgaaccaccaaggtgtgtggttttgattgcgggttggcaggaagaagtaatcctgctatcattcatcgggttgcttcacggcaacaggtttttatcacgcacgcgcggctacttcataccgtggtgcccgggctttggtagcacatgtccgggttggttttggaggatgaccccgcgcggaggcaaaccacaggaggtttaacatggctaccaagattaatatccgcaccctgctcgaggccggctgccacttcggtcaccagacccgtcgctggaaccccaagatgaagccgttcatcttcggtgagcgtaacggcatctacatcctcgacctcaagcagaccatcctcgacgccgaccaggcctacactttcgtcaagaacgttgccaagggtggcaacgtgctgttcgtcggcaccaagaagcaggctcaggaggccgtcaagaacgctgctgagcgcgccaacatgccttacatcaaccagcgttggctcggcggtatgctgaccaacttcgtcaccatccgctcccgcatcaaccgcatggaggagctcgaggccatggtcgaggacggccgcatggctgttctgcccaagaaggagcaggcagtgctcggtaaggagctcaccaagctccagaccaacctcggtggtgcccgcgacatgaagggtctgccccaggctctcttcgtcatcgacaccaagcgcgaggagaacgccatcaaggaggcccagcgcctgaacatccccgtcgtcgctctgatcgacaccaactccgatcccgacgaggtcgagtacggcatcccctgcaacgatgacgctatctccgctgtcacccttatgtgcgagctcatggccgacgcctgcctcgccggctccggcaaggagcaggtctccgaggccgagatggccgctgagcccaaggccgagtaaatcagtcttagttaattctttttcatctctttgaaaggaaccacaatggcccagattaccgccgctatggtcaagcagctccgcgagatgaccgactccccgatgatggagtgcaagaaggctctcgtcgaggctgacggcgacatggacgccgctgtcgacgttctgcgcaagaacggtctcgccaaggctgccaagaaggctggccgtgagaccaacgagggcgctgtcgccgcgttcgtctccgaggacggcaagtccggcgctctgctcgagctctcctgcgagaccgacttcgtcggctccaacgccaagttcaccggctttgcttccaaggtcgctgaggttgtcgccaccaccgagccggctgacgtcgacgctctgctcgagaagccgatgggcgaggagaccgtttcctccgagctcaccgagatgatccacatcatgggcgagaacatgaagatctcccgttttgccgcccgcaaggccgagaacggcgctctcgcttcttacatccacatgggtggcaagatcggcgtcctcgtcgagttcgctttcgagaaggccgagaccgctcaggctgagtccttcaagaccttcgctcacgacgttgcccttcaggttgccgccgtcgccccgatctgcgctacccgtgagcaggttccggccgagaccgtcgagcacgagaagcagatctacatggctcaggctgccgagtccggtaagcccgaggccatccaggagaagatggctgtcggccgtctggagaagttctacaagcagtccgtgctcactgagcaggagttcatcaaggacagctccctcaccatcaagaagtacgctgagcaggtctccaaggagcttggcgacaccattaccgtcgttgccttcgaccgtctggtccgtggcgagtaaataagctcttgtagctggtaatgagcaggctgtgggttttactcacagcctgctttttcatggctccccgttaagcctttgttatcatattgagagtctaattaaaggaggatcgctttgtccgacatccgatataaacgcgtgcttcttaagctttccggcgaagcactgatgggcgacggccaatatggcatcgaccccaaggttaccgaccatcttgccaagcaggtcaaggagctgctcgccgttggccatgaggtcggcgtcgttgtcggcggcggcaatattttccgcggcatggccggcgctgccggtggcatggagcgtgctcaggccgactacatgggcatgcttgcaaccgttatgaacgcgctcgccctgcaggatgccttcgagcataacgatgttccctgccgcgtgatgagcgctatccagatgaacgagatctgcgagccctatattcgccgtcgcgctatcaaccacctttccaagggcaacgttgttatttttgccgccggttcgggtaatccgtactttacgaccgacaccgccgcggctcttcgtgcgtgcgagatcggcgccgagattctgattaaagccaccaaggttgacggcatctacgacaaggatcccgtcaagtgcgccgatgccgtccgttttgacaagattacttatcacgaggttctcgttcgcggcctgcaggttatggattccacagctacggccctgtgccaggataaccgtatgcctattttggtcctcaacatcgatggcgaggacaccgtcaaacgcgcgctcgcgggtgaacccgtcggcacgctcgtctatcaggaggattaagcatggcagagaacatcaccgcccatatggacaagtcgctcgagtccctcaagcataacttctccaaggtccgtaccggtcgcgccaacgccaacattctgtccgacatcaccgtcgattattacggtgtccccacgccggtcacgcaggttgccgccgtcaagacccccgaggctcacatgctgctcatcgagccgtgggacaaggccctcatcaacgctatcgtcaaggccatcggcgcttccgatctgggtattacccccaactccgatggcaccgtcgttcgtcttccgttcccggctcccactgaggagcgccgtcgcgagctcgtcaaggagtgccgcgagtacgccgagcaggccaaggtgtctatccgtaacatccgtcgcgacttcaacaacaagctcgagcgcgatgaggagctcaccgaggacgatgtccgtcgcgagcaggccaaggtccagaagcataccgatgagtatgtcgccaaggtcgaggagcttctgaaggaaaaagaagccgaggtcatggagatctaaggtgcaatacgacgagcataaactggtcgagtactttgccgacgcccctgcgggcgtcggtttttccgaccttgacctcaataacattccgcaccatatctcgtgcatcatggacggcaacggtcgttgggccacgtcgcgcggtcttgcacgcaccgagggtcataaggcaggtatcgtctcgctgcgcgagatcattaccgcctgcgtgcgtctgggcgtcgacgtgctttctgcctatgcgttttctaccgaaaactggaaccgtccgcagcatgaggtcaacgtcttgatgcatctgtttgccaagacgtttatcgacgagctgcctcttctgaagcgcgaaaacgtgcgcgttgtttttttgggcgacatttccgcactgcccaagaagacccgcgatgtctttgagcgcggtctagccgagtgtgccgaccacaccggtatgacgctggcgcttgccgtcaactacggcgcccgtgccgagatcacccgcgctgtccgtcagattgcactcgacgctgccgccggtaagatcgatcctgccgcaattgatgacgacatggtggcttcccacctctataccgccggccttcccgatcctgagcttgtgattcgcacctcaggtgagctgcgcctttcgaactatctgttgtggcaggtggcttattccgaattctacgtcaccgatacctattggcccgactttgatcgttggggccttgtcgacgccattttggcctatcagggccgtgaccgtaggtttggtggactgagcaagaccgaggaggcttaatcgtgtccgatcgtcccaaggcatctgctcccaagacgcctgcgcgcaaagctgcccctgcaggggcgcccgcagcgaagggcagctccggttcatggctggcgggctttatcacccgtgccgccgccggtatcgtctatgccgtcgtctttatcctgtgcctggttttgggcattgttcccacggctatcttcgtgtccgtcatgagcggtctgtgctgctatgagttcttccgcatgacgaggctcgatggcaagatggctaacgagcgcatgggtatcgctgccgccgtactctttccgctgtcggcgttgggcgattcgatgttgctgaatgccctgctttttgccctgatgctcgctgtgggcatttggtatgtctggtcgccgcgtacccgcatctctgatgtggcagtgacgctcatgggtcccatctacactggctttatgctgtcggctatcgtgctgctgcgcgatgccgtgcccggttttgccggtgccctgctttcagtgggcgtttgcgcgtccctttgggtctccgattcgtttgcctacatcgtgggcagccgtatcggcaagcacaagatggtccccaagatttctcccaaaaagagctgggaggggtttgtcggcggcatcctgggctcggttttgatttggctcatcctgtgggcgacgcacttctacaagctcagcctgccctatgcgctgctgtgcggcgtggtcgtgtccattctgggcgttatcggcgaccttatcgagtcgcgcatcaagcgcggtgtgggcgtcaaagattccggcaaccttatcccgggccacggcggaatgctcgatcgtagcgattcgcttatcttcggttgcatcaccgcgcagctgttgctgatgatcggaggcgtgctgtaatgtccttccagacgacgtatggccctgatggacgccttcgcgttgccatcctgggttgtacgggctctatcggcacccaggcgctcgatgtgtgccgccagcatgccgatcgcctgcaggtgacggcgctgtccgttaactccagtacctccgagctcgttgccgctgcccgcgagttctcggttccggcggttgccgtggccgctgtcgatcatggcgatgacgccgtgctgcaggagttgcccgagggaacgaagctcggcgttggcgcgcaggcggtttgcgagctcgcgcgtcgcgacgatgtcgactgcgtgcttgtcgctattgtgggcgccgccggtctcgaggcgagtcatgcggccttgacctcgaataagcgccttgcccttgccaacaaggagtccctcgtcgtcggtggcgacttgcttatgccgttggcgcaaccgggccagcttattccagtcgactctgagcactccgccatttaccagtgctatctgggggagaacccgcgcgaggctcattgtatttggctcacctgctcgggcggtccgttctttggccgcacgcgagacgagctcgatcgcgtgacgcgtgccgatgccctcgcgcatcccacgtgggccatgggtgccaagattacgattgactccgccacccttatgaacaagggtctggagcgcatcgaggcgatgcatctgtttggctgcgacctcgactttattaacgtggtcgtgcagcgtcagtccaagattcactccatggtcgagttcgccgatggctccgtgatggcgcatctcggtgcctccgacatgcgcattcccatccagtttgccttctcgtatcccgagcgctgggatacgccggctccacgtatcgacttccgcgagctgggtcagctcacctttgatgccgccgacatggataccttccgctgtctggcgctggccgagcgtgccggtaagatgggcggcaccatgccgtgtgtgcttaatgcagctaacgaggtcgccgtcgacgccttcctgcacgatgggtgtagctttaccgatatcgaccgcattgtggaatcctgcatggatgcccacgaggttcaggcagttgcctcgtttgagcagctcgccgatatcgatgcgtgggcgcgtgaaaaggccgcgcaggtgctcgccgcaacccgttcttaacccataaggattgctttttcgttttatggatactgttctgagcgttctctcatcggtcttttggggccttctgatgctttccgtcctcgtgtttttgcacgagggcggccactttttggcggcgcgtgcctgcggtgtccgcgtgaccgagttctttttgggcctgccgtgtcgctttgatatccaccacacgtcgcgtcgtatcggcaccaagtttggcgtgacgccgctgctgctgggtggctatgcagccatttgtggcatggatccgaccgacgtctcgtgtgccgaccgcgtgcttgctgccatctatcgtcacggccgggtgacggtggccgatcttgccgtcgagctcgagctgtccgaggaggatgtgctcgaggcctgtgctttgctgttgggctggggctccatcgctccctggtatgaagaaggggaaaagccttcgcccaattactatcccaccaagtaccagaccctgccgcgtgacgcggcgggttataccacctttgacggccgtcggttcgatcgtgagcacgcgactgccgagggcgatgtatgggagctgccgtgcggcgagtccgaattccttgcacgcgagcgctcgcacacctatttgggccagggctttgtcaagcgttcctttatgctgcttgcgggcattatcgtcaatatcctgacgggctttttgctccttatgagcatctattccatcgcgggcgtcacggtgccggtggataccaatgtgatcggccaggttgacgaaggctcgattgccgccgcggcgggaatcgagggcggcgatgcgatcctttcggtcgacggagtatcgtgctctacctggatggacgtttacgatgccatcggcaaggctgccggtaaggacgatatcgccatcgagtacgagcgtgacggcaagcagcattcgaccacggttgcgctcaaagaggacgagcgcctcggtgtgtatgcctctacgcaggtggtccgtttggaccccatcacgtcggctcgtttgtcgttctcctatatcgtgcagacagcggagggcgtgatgcgcctgctccagccgcagcatacgatggagattctcgaccagtcctcttcaatcgtgggtattagcgttatgtcctcacaggctgctgccgccggccctgccacgttcctttcgtttgccgccctcatttcgttctcgcttggctttatgaacctgctgcccatcccaccgctcgatggcggcaagctggtcatcgagatcattcaaaagattgcgggccgcgagcttccgctcaaggtccagacgattgtgagctatgtgggcatcgcgctctttgcgctgctgtttgtctatatgcttcgttccgacatccttcgatttattctgtaggggagtggttggattgtctttatcccatcctttgcctcgcgagctgacgcgtcccgtgcatgtgggcggcgcgcagatcggtggcggcgcgccggtggtggtccaatccatgacctgcaccgataccgctgatgcccaggcaacgcttgcgcaagtgcgtgctttggcgcaggctggctgcgatatcgtgcgcgtgagtgtgcccaccgaggccgcgcttgagggtttccgcaccatctgtgccgagtctccggtgccgattgtcgccgatatccactttaaccataagctcgccattggtgccgttgaggctggtgctgccaagctgcgcatcaatcccggcaatatcggcgattgggccaaggttgacgcggtaatcgatgctgcgggtgctgctggctgtgcgattcgtatcggcgtcaatgccggttcgcttgagcaggatattgccgagcgcgacgacctcacgcagcccgaaaagctcgtgatgtcgagcgagcgtttcgtcaagcactttgaggaccgcggttttaccaacattgtgctttctgccaaggcccatagcgtgcaaacgacgctcgatacctatcgtgccctgtcgcgtgagattccccacgttccgcttcatctgggcgtgactgaggccggcaccaagctgcagggcaccatcaagagttcggtgggccttggtatcttgctttccgagggcatcggcgacaccatgcgcgtctccctcacggccgatccggtcgaggaaccgccggttgcttggggtattctgcagtcgctgggcctgcgtcgccgtggtcccgagatcgtctcgtgccccacttgcgcgcggtgccaggtcaacctgattcccatcgccgaggaagtcaccgagcgacttaaaaactacgccgcaccgctttcgattgccgtcatgggatgtgccgttaatggccccggcgaggcgtctgatgccgacctgggcgttgcctgcggacgtggtcaggctctgctcttttcgcatggccagatcattggtaaagtagctgaggatcaaattgtcgacgcgcttatggccgaggtcgacaagcttattgaggagaaataaatgactcgagcaatgtacatgtctaagctctatgcgccgacactcaaagaggatccggccgacgctgagctcgcaagccaccgcctgctgcttcgtgccggcatgattcgcaaggaggccgctggtctctactcctacctgccgctcgcttggcgctcgatccgcaagatcgagaacatcgtgcgcgacgagatggacgccgccggtgctcaggagctcatgatgcccattatggtcgatgccgagctgtggcgtgagtccggccgtatcgatgcctatggcaaggagctcgtgcgctttgacgaccgtcatggccgcgagttcgtcctgggccccacgcacgaggagaccgtcacggccctggtgcgcaacgagctgcgctcctacaagcagctgcccgtcaacctctaccacattcaggacaagttccgcgacgagttccgtccccgctttggcctgatgcgcggccgcgagttcatcatgaaggacgcctacagcttctccgccacgcaggagagcctgcaggaggagtacgacaagatgaagcaggcctacgccaacatctgcgagcgctgctacatcaaggccctgcccgttgtcgccgactccggtgagatcggcggcgacacctccgtcgagtacatggctctggccgaggccggcgaggcatcgctcgtctactgcgacgactgcggctttgctgccgacgatgaggctgcgagcaccaaggtcgttgtgaccgagggtcctggcgacggtacgctcaccaaggtcgagactccgggcatgggcactattgaggccgttgccaagttcttcggcttccccgagaacggcacgcgcaagtcgctggccctcatcgacgccgagggtaagcccgttgtggcgatcgtcccgggcgatcacgagctcaacgactgcaaggccgagcatgtctttggtaagggctatcgtatgatgaccgacgaggagctccaaacctatggcctgcacaagggctttatcggaccggtcaacctgcccgagggtatccgtctggtctgcgacgagagcctgcgcgagtccaagcagtgggcctgcggcgccaacgaggtcgactatcactttaccggtgcctgccccgaccgcgacttttccgtcgacgagtgggccgacctggtcaccgtcgttgccggcgatccgtgcccgcattgcggcaagccgctctctgctgctcgcggcatcgaggtctctcaggtgttccagctgggcaccaagtactccgaggccatgggcgccacctttatggacgaggacggcaaggagaagccgctcatcatgggttgctatggcgtgggcgtgtcccgctcgctcgctgccgtcgtggagcagcacaacgacgagcatggcatcgtctggccggtttccgtcgctccctacgaggtcgcggtgattccgctcgaccccaagaaggaggagtgcgctaccgtctgcgacagaatcgtcgagggtctgtgcgccgagggtatcgaggtcgtcgtcgatgatcgcgacgagcgtcccggctttaagtttgccgataacgacctcatgggcttcccgtatcaggtcgttctgggtaagcgcggccttaagaacggcaccgtggagctcaaggaccgtgccacgggcgagcgcgaggacgtcgccatcgacgaggttgtcgccaaggtcgccgagcttgtgaaggctgctcgccgctagtcgacgacatcgccaataactgtattacggggctgccccgcatttctccagataggggagatgcggggcagccctatttaccccgatatgctcaaattcaaaaaggaaaaccccacagcccggatgagctgcggggttttcctttgtgcctccgatgcgaaataaatcgctcagatattactgataatcgacgacgtcgatccagttcttaaggaactcatcgttcacgttgcgcttacgagcgagctcggaagcggcgacaatgctcgtccactgacgcacgacctgcatcggcatgtcggcgcggtcgcagtagagctccagataagcctcggcctgatccttgctgttgagggcaaagagcaggtaggtcgtggcaacgtcggcggcaggggagccctgggtggcgtgtgcccagtcgcacacgtagagctggccgtcgtcgccgacgatgacgttggaggggttgaagtcgccgtggcagaccttgaactccttggtcatgccgtccagacgctcctgaaggttgtagcgcgtggtggcattgagctgatccaggctgtcgatcatgcgggcgaacttgtcgcgctgacggttgagcagcggggaggtgtagccgtggatctcgatctggaggtcgacgaacatctcgaggtactcaccgaagcgctggggctcggcagtcatcttctcggcaagggtggtacccgggaccttctcggtcacgagtgcccagccgttggcgttctcgagctgggaaacctcgagagccttggggctgcggatgccgcactcattgatgcgggcaagattcaaagcctcgttgaacacgtcggagacaggcttggtctcgttgaagaccttgacgatcttgtcgcccaggtcgtaaacgaccttgttgccacgacggacgagctcggtcttggaatcgggtagcagcatggttgcatcctttcaacgatgcgatagaagcgacggcgggggtgtgtgaaacacccgtgcacccccgccgtaaaaaaccgtgctagaactagcagacggcgtaatcctggggctcgcggccgtagtaggcgtccaggtagagctccttgatctcgctcatgagcgggtagcgcgggttagcgccggtgcactggtcgttgaatgcctgctcggtcatctcgtcgagggtgtcgaggaagtactgctcgtcgacaccgtagtcggcgatggtcttcttgacgccgatgaagtccttgagctcctcgagcttcgtaatgaagttctcgaaggtctccttgtcgtccttgccctcgatgccgcagtacttggccatctcggcgtagttgtgcagcgcgttggggtaaggatactgggagaaggtgcccatcttgacgggggcctcggcggcgttgtagcgcatgacgcgggtcaggatgacagcgttggcgatgccgtggggcaggtgatggaaagcgccgagcttgtgagccatggagtggttgaggcccaggaaggcgttggcgaaggccataccggccatgcaggaggcgttgtgcatctcctcgcgggcgtgcgggtccttggcgccgttctcgaagctggagggcaggttctcaaagacgagcttagcagcgcgctcggagaggcccttggtgtagtcggaagccatgatggagacgtaggactcgatggcgtgggtcatgacgtcgatgccggaggcagcggtcaggccgcgcggggcggtcatgcagttgtcggcgtcgacgatagccatgttggggagcagcgcgtagtcggcgagcggccacttgatgccggtctccttgtcggtgatgatggcgaacggcgtgcactcggagccggtacccgaagaggtcgggacggcgacgaagtaggccttcttgcccatctcggggaaggtgaagatacgcttgcggatgtccatgaagtccatggccatgtcctcaaacttgcactcggggtgctcgtacatcatccacatgatcttgccggcgtccatggcggagccaccgccgacggcgatgatgacgtccggctcaaagagagccatctgcttggcgccacgacgtgcgcactgcagcgacggatcgggctcgacgtcgtagaagcagtcgtgggcgatgcccatctcgtcgagcttggcctcgatggcgcgggtgttgccgttcttgaagaggaactggtcggtgacgatgaaggcgcgcttcttgcccatgacggtgccgagctcgtcgagagcgacgggcgtggaacccttcttgaagtagaccttctcgggagcgcggaaccaaagcatgttctcgcggcgctcggccacagtcttaacgttgatcaagtgcttcaccccaacgttctcggagacggagttgccgccccaggagccgcagcccagggtcagagacggcttcatgccaaagttgtacaggtcaccgatgccgccgtgcgaggacggggtgttgatgacgatacggcaggccttcatgacgtgctcgaacaggctgatcttctcggcctgggcggggtgcacgtacagagaggcggtgtggcccgggccaccggcgagcaccaggtgctcggccttgtcgacggcctcctggaagtccttggcgtggtacatggccaggaccggggagagcttctcgtgggagaactcctccttggcggggtcggtggagttgacctcggcgatcaggatcttggtcttggcgggaacctcgatgccggcgagctcggcgatcttggcggcagccatgccggggatgcggtggtcgagagcgccgttcttgaacatggcgccacgcagggcctccatctcggcaccctgcttgacgaagtagcagccgcgcttctggaactcggccttaacctggtcatagatggtgtcgatgacggtcacggactgctcggaagcgcagatcatgccgttgtcgaaggtcttggagtggatgatggagttggcggcgagcagcacgtcggcggtgtcgtcgatgacgaccggggtgttaccggcgccaacgcccagggcgggcttgcccgaggagtaagcggccttgaccatgcccgggccaccggtggcgaggatgatatcgacgtcgcgcatgaccatgttggtcagctcgatggaggggacatcgacccagccgatgatgccctcgggggcgccggccttgacggcggcgtcaagcacgagcttggcggcggcgatggtgcacttggcggcagcggggtgcggggagatgatgatggcgttgcgggtcttcaggcagatcagcgtcttgaagatcgcggtggaggtggggttggtcgtcgggatgacggcacccacgataccgatgggctcggcgatcttggtgatgccgtaggcctcgtcgcgctccaggacaccacaggtcttggtgttcttgtaagcgttgtagatgtactctgcggcgtagtggttcttgatgaccttgtcctcaagaacgccgcggccggtctcctcgatggccatcttcgccaacgggatacgagccttgttggcggccatggcggcctcatagaagatcttgtcgacctgctcctgcgtgtacgaagcaaaaagcgcctgggcctctcgcatctgagcgagcttagcctcaagcgcctctacgttgtccacaattgcgggagtagtgttttccggtgactttttcaccatttgtgtctccttgcgatcggagatttaccctacgccttgcatgatagcaataaattattcggtaaacggtcagattcccgtaaaaggcatactaaaacgcttcaacaaaatgaagcgattcaactaataatgcatcgcctcactcattggggacaggcttacatgagtgcattcactcatgtgggacagacatcgatttgtcattttggttgatttccgatctcagccgaacacattgagcaaataggccgttcccgcagttagccgaacgcccccgcggcccctcccggggcccgggggcgccgttttcccagttgaaggaacggtggagatgtgtttcgatgggtccggtggccatgctcctgctgaaccatctcggactcggacagcgtgaagaagccggtgtccgaggggtcgggcataaactgaccggtcgcacccgtaggatcgagcgggtcgacggcgggagcgtccatcgcgggcgccggggccgtggccatggccgtctgagcggaaagcgcggccagtgaatcatgaacgcgggcaagttcatcggcctgctcgggcgtgagctggtagatgccgtcggcggtagcggcgttaaaggcgtcgagcgcatcggagggacgaccggcggcggaaagcgcctggcccatgccggcgttgagcgcacgtgtatcgtcacgcgggccggcaaagtcgatggccgtgcgatacgtctccacggcatctgccgggcgaccgagcttaaggaagcaacggccaagctcgcccagagcggcggcaggagccggattggcgccgtcgatagctgcctgtcggaaggcagtgccggcgttggcatagtcgcccgcctggaacagcgcgttgcccaagcccagataggccttgaacggcgtggcataggaggcgtcctgcgttgcagcggaaaaagcctgggcggccgtggtgtagtcacccaccgccgcgagcgccttgccgcgattggtgagcagcgcgccgcgcttgccgtaggtaccgtcgttgagggcggcagcgtaggcctcggcggcctcggcatacatgccgaggtgcatcagggcgttaccgcaaagatggtcggcctcgcccataatctcatcgggggtctttgccgccgagagcatctgggcggcagcggaaaaatcacccgcgcggtaagccgcgcgaccctgttgaatcagctggctattcaaggaagtcccctttactcgtgaacgatctcgacgtgaacgatctcatcgccggcacgcagctgcgagatcacatcgaggccctcgaccgtggtgccaaagacggtgtaaccggagtcaaggttatgctgggcgcccaggcagaagtagaactgcgagcccgcggaatcggggtccatggagcgagccatggcaagcgcgccgtcaacatggctgttgcgcgggttggtagcaaactcacccttgatgcaatagccagggccaccggtaccgggcatgccgtcggggccctcaaggccggcagcgacgtcggcgccggacatgtcgcgggtattgggatcgccgccctggataacaaagccggggacatagcgatggaacttaaggccgtcgtagaagcccatcgtggaaagctcgcagaagttcgccacatgaatgggggcgccctcaccgtcaaacttgaccttgatggtgcccttcgacgtctcgatcaccgcgcactcgtcaccggcgagctggtactcgggcgtatagagctctttcttaaaaccaaacatgtggttccttcctcgtgcgtttaaagcatatttgtacgaattgtagcaataagcacaggcttccatcaattgcgcacgtaggttataccgtccagggcgaactaatttttatgaacgctgctgcggcttccaagcgcccacgttggcatcgtactggttaagggcgctgcttccgccctgagctataggtgccaagatctcgctttggtgggaactcatcgactcgccatcgggaatggcaagcgagatatcccagctctggcagatcacgtcgacgcgctcatacatccactcggcaagctgctttaagtgggcgatgtcatccgcatagaccgtatcgtcctggtacttaaggttgttgagctcgtcttgcgtctttttaatctggtcgcgcagggcataggcactctgggagagttcctggcgcgtggagagcggagagcggagatagccgttgttgaacgagtcgataacctcgccaatctgatcctcgttgccgtacgacacgatggtctgatacagaccatcgagcctggtatagagctgatcatcagtgagaacggtttcttcctggaccacttcggcaggatcgtcctgcttggtgtcgtcctcggtcgcctcgcccttttgacgcgtgggaaacgtggtctgcgcggcctggccaaactgatcataaaagccgggcatgacacccatgggatcggccgtcacaaaccaataggcaccgccgcacacgatggcaagcaccgcaatgacgataagcggcttggggatatgacgcttgtgcttatggtaggcgtcctcgtcgggatgcaccttgcgcttggatttttgagtgtcttcatgcagggaaaccggcatcgggatatcgaccttggggataccgaagtccttatcgaaagccggcagcacgcaggtctcattggggtcggcggcatccgaaagcacggcggcagccgaagcgggcgcatggggcacctcggtatcgatctgctcctgcgtcaagcgcggaaaaccggcggtacggcccgccgccaggtcggatgcggcggcgtcctcggaaaggatgcccggagcggggcgtccacatttgggacacgtgcgatcatgcggggaaagacgcgcgccacagccctcgcagaacacgaactcggtgtgctcgggaccgtcgcccgggccgacgtaggcgttgcagtaggggcagaacgaggcgccgtcctcgatggtcttaaggcaatgcgggcagatcacggcatcctcttttcggagcaattcaaacaatcgaggttagagcatagcatcgctacgcccccacaggagcaaggcaccaattcaacatcgccagggcgcgtagttatttcttctttttgcttggcatcgagactttgatgccttgggcggacttggtcacgcgggagcgcttgactccggtactcttctttttcttgggctgggcctgggccacgccctcgagtgcgcgggcctcggcctcacgaacggtgcgagcttcgcggcgctgcgccatgtcggcggcgacgcgcttggcaaaacgctcggccgtcgaacccgtcgagctcaccttgccgccaccgcgacccaagcggacgcgcacaccgcggccaaaaccagttgcggcatgacgacgacgcggcttgagcgaatccatcatcgtggcgagcttaaagaacaccgagcaggtgatgaccacgatgacagccaagataaccatctggcccatcgacaggttggcaatagacagcagcttcgggaatccgataacgcccgtcaggatgccggcaactacaaacacaaagagcgccacacgtaagggcgtgaggggctgcgagatacgccagatcaggctgacactcgcagcgcacgacgtaagtaggcacatcgtagacagcgtgagctggttaaagccgaacacgcgcgccacaaagatatcgagcgccgcggccaaaatgaccgcaagcgacgccggcagtgcccgcttgagcacgttcgtcaggaacgaccccttcacgcgagcattgttgggctccaggcccaacacaaagcccggcgcgccaatgcagaagaagttgatgagcgtcatctgaatcggctcgaaagggtacggcggcagtgcgatgcacagcgccgccaggcccatcgagaacagcgtcttggtcaagaacagcgaagccgaacgctgcaggttgttgatggagcgacggccctcggccaccacagcaggcatcgaggcaaagtcgttgtcgacgagcacgatctcggccacgttgcgcgcggcatcggagccggccgccatggcgacggagcagtcggcctccttgagcgccagcacgtcgttgacgccgtcgcccgtcatggccacggtgtgctcgcggcgcttgagtgcctgcacgagctcgcgcttctgctgcggggtcacacgaccaaaaacatggtagcggtccactgcggcatcgagcttggccggcgtatcgagcgtcgtggcgtccacataagcgtccgcccccggcacgcccaccacgcgcgcgatcgacgacaccgtacgcgggtcgtcgccactgatcacgttaagggtcacgccctgctcgttaaagtagccgatggtctcggccgccgaggtacgaatctcgtcgcggatggtcacaaagcccacgggctcggcctcgcccaccatatcgccatcgggcgtaaagccgtccacgcgcgccaccacgagcacgcggcaggtatcggcaagctcggcgacacggttctcgacctgggcaaacgcacgatcagagagcacaaactgcgccgcacccatcacataggagccctgcgcaaacgaagcaccactccactttttggaggacgagaacggaatgaccgacagcggctcagacacctcgaccgggcgatcggcgtaatagttgagcagcgcctggcaggtctcgttggcatcggccgaggtcgcacgcgccacgttagccagcgcaaaatcgagcaccgtggtatcgacgggaacggcggcgtcgctctcccccacacccataccctcgaccggtagcggataggtaccctcgacctccatgcgacccgacgtgatggtgcccgtcttgtccaggcacagcacgtcgacgcgagcgagcgtctcgatgcagtaaagctgctgcgccagcaccttgcggcgggccaggcgcaccgtggcgatggcgagcaccgacgaggtcagcagcaccaggccttgcgggatcatgcccagcagggcgcccaccgtggacagcagcgccgacgaaggcacatgaccagccaacagctcggagaagcaccacgaaagcgcgctatcgcccggggttcccgcggcatcccacagctcgctcacactcgaggcaaacaacgccaaaccgagcgggatcatgatgatgctcgcaaagcgcacgatggcgttaagcgcgttcatgatctcggaattgacctttttgacgtacttcgcctcgttattaattttggccacgtagttgtcggcgccgacatggatcacgcgggcgcgcagcaagcccgagtcgataaagctgccgctcatgagctcggaaccgggctgtttcttaatgaggtcgctctcacccgtcagcaggctctcgttcacgagcgcctcgcccgaaaccaccacggcgtcagcgggaatctggtcgccgcgccccaggcggatgatatcgtcgagcacgatctggtccaggtcgagctccacctcggcgccgtcgcgcaccgcaatggccttcttggaggtcagcagcgtgagcttatcgaccatcttcttggaacgcatggactggatgacgccaatagcagtattgaggaacactacgaacaggaacgtcagattcttaaacgaaccggtcaaaatgactaggaacgccaaaatcacgttgatcaaattgaacagcgtgcagaggttctcgatgatgagctctttgaccgacttggtcttgagctccatgttgcggttgatcttaccggcggcgatgcgctcctcgacctcggcggtcgagagtccgcgctcgatatccgttgctgccataccacgtcccatcacgtcgcgtcggtataagaaaaaccgcccggaccatgcgaggttcggacggtctcacgttcgatggtgccccatgttggattcgaaccaacggccttctgctccggaggcagacgctctaatcccctgagctaatagggcgaacggaatgcattatacccaagtgcaccacgggctatcaaaataaaagaaaaagctttgcaattccgaggaagacgcgccgcatcggcacactttagaaggcaaaagtgagtcagatagtataaactctcatgcaccatatatccacggctcgcgatgcgggccgtttttgcaaaggatatccatcgaggtgagaggcacaccatgattgcaattttaaagcagagcgccagcgacgaggccgtcagccacatcgtcagctggattgagaagaagggtctcaagaccgacgtctcgcgcggcgagaacgagaccatcatcggcctggtgggcgacacgaccaagatcgacccgttcctgctcgagtccatggacgtcgtcgagcgcgtacagcgcgtctccgagccgttcaagcgcgccaaccgcaagttccaccccgaggactccatcatcgactgcggccacggcgtcaagatcggcggcgaccagttccaggtcatcgccggcccctgctccgtcgagggcgagaacctcatccgcatcgcccgccgcgtgaaggccgccggcgccacgatgctgcgcggcggcgcctacaagccgcgcacctccccgtacgcctaccagggcatgggccccgccggccttgacctgctgtgcgaggcatcggccgagctcgacatgccgatcgtcaccgagatcatggacccgcgcgacgtgcagatcttcctcgacaagaagattgacgtcatgcagatcggcgcccgcaacgcccagaacttccccctgctcaaggaggtcggcaagaccaagaccccgattctgctcaagcgcggcatgtccggcacgatcgacgagctgctcatggccgccgagtacatcatgagcgagggcaacgacaacgtcatcctgtgcgagcgcggcatccgcaccttcgagacccgcacccgcaacaccttcgacctcaacgccgtgccggtgctgcaccacctgtcgcacctgcccgtcgtcgccgaccccagccacgccaccggctacacccgctacgttgagcccatggcgctcgccgcgaccgcctgcggtgccaacggcctggagatcgaggtccacgacgagccgagccgcgcctggtccgacggcgcccaggccctcacccccgaccagttcgacgacaccatgcgccgcattcgcgccatccgcgaggtcgtctgccaagagaccatggagtagcccatgggtacggtgagaaacgcgcgcgttaaccagggcggtcccaaatgcgcgggcatcgtgggcctgggcctcatcggcggcagctttgcccgcggctatgcgcaggcgggcgttcgcgtggtggcctgggaccccgatgacgatgtcatgacggccgccagcatgggcactgtcgccggagagctcaacgacaagacactcggcgaatgcgacatcatcgtcctggcctgctaccccgaggcctgcatcgagtggctcgaggcgcacgcccaggcgctcgccgacgccaccgacaccgacgccatcatgggtcccgtggtgatcgacaccgtgggcgtcaagggcattgtgtgcgagcgcgcctttgagcttgcccgcgagcacggcttttactttgtgggcgcgcaccccatggcgggcacccagttctcgggctacgctaactctcgtgccgacctgttccagggcgctcccctggtgctcgttccgcccgcggtagacgatgcccttaagctggagctcttgggccaggtgcgcgagatggtgcgccccttgggctttggcaagttcagcgtgaccagcgccgcagagcacgaccgcgtcatcgccttcacgagccagcttgcgcacgtggtatccaacgcctacgtaaagagcccgaccgcccaggtccaccacggcttttcggccggtagctaccgcgatctcacccgcgtggcgcacctcaacccgcaaatgtggtccgagctcatgatcgacgacgccgacgcgctcgccttcgagatcgaccatctgatcgagtcgcttgacgcctacagccgagcgctcaagaaccgcgaccagcgctatctggagaatctccttgccgagggcgaccgcatcaagcgcgcgctcgacgacgaggcctcccactagaccacctatcacgccaggtcgaaaggaccgaagcttatggcgattaccatcgatatcgacaccgctcgcccctaccaggtgcatgtgggcacgtttttgctggagcaggcgggcccgctcgtacgcgccaccgccggaggcacccgcgccgtcatcgtgacggacaccaacgtgggcccgctctaccagatgcccgttaagcagagcctggaggcgtcgggctacgaggtgagcatctgcaccttcgaggccggcgaggcccataagcgcgccgagacctacgtgtccattttggagtttgtggccgagcacgagctttcgcgctccgacgtgatcgtggcactcggcggcggtgtcgtgggcgacgtggctggctttgtggccgccacctacatgcgcggctgcaaatttgtgcagatccccacgagtctgctcgccatggtggattcgtcggtgggaggcaagaccgccatcgacctggctgccggcaagaacttggccggcgccttttggcagccgagcgtggttatcgccgacgtggggtgcctggccaccctcactcccgagcagttcgccgacggctgcggcgaggtcgtcaagcacgccgtgatcgccgacccggagctcttcgccgagctggagaagaccccgctcacgctggagctgctcaaccgcgacgtggcccgcgtagcgctcatcatcgcccgcaatatcgacatcaagcgcgccgtggtcgtcgccgacgagcgcgaaaccaaccagcgcaagctcctcaactttggacacagcgccggacacgccgtcgaggcctgcgagcactttgagctcggacacggcaactgtgtgtcgatcggcatgggcatcatcacgcgcgccgcggccctgcacggcgtttgcgatgccgcactgcccggtcgtattgaggaactctgcgcccgccatggcctcaagacccgctgcgacctagatgccgatgccgtctttgccgaggcgctccacgacaagaagcgcgcgggcgacaccatcgacctggtgattccgcacggcattggccgctgcagcatcgaccgcacgccactttccactttccacgaactcattgccgagggcctcggccagaagggagacgcatccgcatgctagcccgcatcaccccgtccccgcttaagggcaccgttcccgccatcgcgtccaagtcgatggcgcatcgcctcatcatctgcgctgcgcttgccaacggcgagacgcacgtcacctgcaacaccacctgcgccgacatcgaggccacggtgcgctgccttacggcactgggtgctcgcatcgagaccgtcgaggacggcttccaggtccaccccaccatgaagagtgttgagtttggcctgctcaaggcccttgccggcggcacgcttgactgcggtgaaagtggctccacgctgcgctttatgctgcctgtcgcctgcgcgctgggtgcggatgccaccttcgtaggccagggccgcctgggcgcccgcccgctgtccccgctctcggacgaaatcatcgccgccggctgcgacctacagggtctgggtggttttccgctcaagacgagcggccgcatgcgcccgggcacctttgtgctgccgggcaacgtgagctcgcaatatatctccggccttctgctggcagccccgctgctggcccagccctcctgcgtgcaggtaaccggcctcattgagagccgtccctacatcaacctgacgatccaggccatgaaggcctttggcgtcgaggtcaacgtcgagcgtattccggccaaggacggccagcccgaggtcacgaacttccgcgtgagcagcggctcgtaccgcacgcccggcagcgtagccgtcgagggcgactggtccaacgctgccttttggctgtgtgccggcgccatcggcaccgaccccatcaccgtcgagggcgtatccctgagctccgcacagggcgaccgcaacgtgctcgccgcgctttcgcgctttggcgcccgcatcgtacgctccaccaacgccgccaccgtgcagtccgacaaactcgccggctttgagatgagcgcccacgacattcctgacctggtgcccgtcatctcggccgtagcctcgctggcgcagggccgcacctttatccgcgattgcgcccgtctgcgcatcaaggaatccgaccgcctggtcacgaccacccgcgagctcaccgcgctgggcgcgcaggtgcgcattgccggcgatgacctcatcatcaagggtgtcgatgcctttaccggcggcgaggtcgattcgcacaacgaccatcgtatcgccatgatggccgctatcgccgcgagccgtgccaccggcgaagtcgtgatccacggcgccgaggctgtcaacaaatcctatcccgatttcttcgaccactaccgtctgctgggcggcaaggtcacgctcgaggaggaatagcatgtcctcgacctttggcaacgttttgcacctgagcatcttcggccagtcgcactcccccgccatcggctgctcgctcgacggcatccccgctggtattgccgttgaccaggagcagctgcaggcctttttggaccgtcgcgcccccggtcgcgacgagaccgcgaccaagcgccgcgaggccgacgccgcgaatatcatcgccggtgtggtcgatggacacaccacgggcgcacccatcgcagcgattatcgagaacaccaacacgcgctccaaggactattccgagctgcgccgcaagccccgccccggacacgcagattttccggcgcgcgtgaagtaccacaatatgcatgacgtcgccggcggcggacacttttccggccgtctgacggcccccttgtgcatcgccggcggcatcgcgctgcaggcactcgaggcccgcggcattcaggtcatggcgcacgtcgcgcagatcggcgggatctccgacctgccgatggacgatatggtctatcgcgaggccgaccgcaaggcgatccttacgaacgatctgccgtgcattgacgccgccgcagccggccgcatgcgcgaggagatcctagccgcgcgcgacgagctcgacagcatcggcggcatcgtggagtgcggcatctacggcctgccggcaggcatcggtgaccccatgttcgacggtatcgagaaccgcatcgcgcagatcgcgtttggtattcccgccgtaaagggcgtggagtttggcatgggctttgccgtggccgccatgcgcggcagcgagaacaatgatccgtatcgcatcgatgccgagaccggcgagatcgaggtcgagtccaacaacgccggcggcatcctgggcggtatttcgaccggcgcgcccgtcatgtggcgcatggccgtaaagccgacgccctcgattggccgcgagcagcagacggtggacatggacgctatggaaaatgccgagctctcggtccacggccgccacgatccctgcatcgtccccagagctgtccccgtagccgaggcagccgccgcccttgccatctgggacgccctcctcgaagacgccgcccagcgctaactacccacccctcaacatcccccgacacgtgaaaggggtctccatggaccttgctgacatccgccaggccatcgatggcatcgacaccacgctcctcaacagctttgtcgagcgcatggacattgccaccgaggtcgccaagtcaaaaatcgagatgggcaaggccgtcttcgaccccgcccgtgagcgctccaagctcaacaacctcgccagccgcgcgcccgagcgctacgaggcgcagaccatcaccctgttccgtctcctcatgagcatgagcaaggccgagcagcagcgctacatcaacgagctaaagggcatcaccgtctcgcaaaaggcccacgccacggctgcagcctccgacacgcccttccctcaaacggccaccgtcgcctgccagggcgtcgagggcgcttacagccaaatcgccgcgtgcaagctcttcgacgtgcccgacatcgcgtttttcgagaccttcgagggcgtcatgtgcgccgtgcgcgacggcttctgcgagtttggcgtgctgcccatcgagaactccaccgccggctcggtcaacgccgtctacgacctgctcgcccagttcgacttccacatcgtgcgctcgctgcgcctcaagatagaccacaacctgctcgtcaaacccggtaccaagctgcagaacgtacgcgaggtctacagccacggccaagccatcgcccagtgtgccggctttatcgaggcccacgacctgcatgccaccaagtaccccaacacggccatgtcggccgagatggtcgccaactccgaacgtaccgacgttgccgccatcgcctcgcgcagctgtgcgacgctttacggcctggaggtgttggagcccaacattcaggactcggacaacaactacacgcgcttcgtcgtcatcagccgcgagccgcgcgtctaccccggcgccaaccgtacctcgctcatgatcaccacggccaacgagccgggcgccctctaccgcgtgctcgagcgcttctacgcgctcaacatcaacctcatcaaactcgagagccgccccatccccgggcacgactttgagtttatgttctactttgacctggactgtccctttggcagcaaggccctcgacgatctgctcgattccatcgacgacgtatgcgagagctttacctactttggcagctacacggaggtgctctagatgaccgataccgccgcaacccgcccctacggcgtgctgggccgcgtgcttggccacagctacaccccgaccatctacaaggagctcgcgggcctggtgtacgtgcgctttgagcgcgagcccgaggaccttgcggcctttatgacgggcgacgagtgggagggcaccaacgtgaccatcccctataagcgcgccgtcatggagtatctggacgagctgagcccgctcgccgagcgcatgggcaacgtcaacaccatcacgcgcctggccgacggccgcctgcgcggcgacaacaccgactacttcggtttccactgcctagtcgaggagctgggcgtggaggttgccggtaagaaggccctcgtgctcggggccaccggtggtgccggcaccacggcaagcatggtgctcggcgatctgggcgccatcgtagtgcccgtaggccgcacgagcgaggtcaactacgacaacatcgtccagcagtccgacgccgcgctgcttgtcaactgcacgcccgctggcatgttcccccactgccccgacgctccttgtacgctcgaggggctcgatgcgctcgagggcgtcatcgatatcgtctacaaccccgctcgcacggggctcatgctcgaggccgagcgccgcggtatcccctgcatcggcggcctgctcatgctcgtggcccaggcagcacaagccgtcgagcgctacaccggccaggtcactccacgtgagcgcatcctggacgtgacggagcatctgtcccgccgcgagcagaacatcgcgctgatcggcatgccgggctcgggcaaaacccgcgtgggcgagcaggtggcacagctcacgggccgcgagcacatcgacttggaccgcgccctcgaggagcgcctcggcatgccgtgcgccgactttatcgtcgagcgcggcgagcccgccttccgcgaacaggagacggcggcactggccgacatctccaagcgcagcggcctggtgctctccaccggcggtggcgtcgtcacgcgcgacgagaactacccgctgctgcaccagaacagtcagatcgtgatgctcaaccgcaagctcgatgagctcgcccacaaggggcgccccatcaccgcccgcgacggcatcaataagctagccgagcagcgcatgccgcgctaccgcgcctgggccgattacatcatcgactcgcgcgactgcgctgccaacaccgcccaagccctcctcgacaccctcccacccgctctctaaccaaaaccaccacaaaggggacaggcacctttgtggtggtttttcaatcgcaaaggaagcaaccatgaaagcactcgtcattaacggccccaacctcaacatgctcggcattcgcgagccgggcatctacggcagcgacaactacgaccgcttagtgcagatctgccaggaagcgggcgctgcacagggcttcgacgaggtcgaggtcttccagtccaaccacgagggtagcatcgtcgacaagatccaggaggcctacggcaaggtcgacggcatcatcatcaacccggcggcctatacgcacacgagcgtggcgatcctcgatgccctcaaggccgtcgccatccccgccgtcgaggtacacatcagcgccgtcgagacccgcgaggacttccgccaggtgagctacgcccgcctggcctgcttcgccaccatcaccggcgaaggcttgcagggttacgcccacgcgctggagctgctgaaagagtatctgctacactaatctttggggtaaataagccagtggcgtttatcccgaatcatttgtaactgtccaattgacataccaaaggagtatatccatgtcccagttcgattaccttgtcgtcggtgccggcctttcgggcgccgtctttgccaatgccgccaagcgcgccggcaagtcggtcctagtcatcgatcgccgcgatcacatcgccggcaacatctataccgaggacgtcgagggcatccaggtccaccgctacggtgcgcatatcttccacacctccatgaaggacgtctgggactacgtaaaccgcttcgccgagttcaacaactacgtcaactcgccggtcgccaacttccacggcaacatgtacaacatgcccttcaacatgaataccttcgccaagatgtggccgggcgtcgtcacgccggccgacgccaaggccaagatcgccgagcaggtggccgccgagaacatcggcgagccgcagaacctcgaggagcaagcgctgtcgctcgtcggccgtgacatcttcgagacgctcgtgaagggttacactgagaagcagtggggccgcgactgcaaggacctgcccgccagcatcatcaagcgcctcccctgccgttttacctacgacaacaactacttcaacgaccgctaccagggcatccccatgggcggttacaccaagatggtcgccaacatgctcgagggcatcgaggtgcgctgcggcgtggagtacaaggagctggccgccgccgagccagatatcgccgccaagacgatctactgcggccccatcgacgcgttctacgacttcaagctgggcacgctggagtaccgcagcctgcgcttcgagaccgagacgctcgacgaggccgaccatcagggcgtggccgtggtcaactacaccgagcgcgaggtcccctacacccgcatcatcgagcacaagcactttgagttcggcacgcaggacaagaccgtcatcacgcgcgagtacccggcggactggaagcccggcgacgagccctactaccccatcaacgacgccaagaacgaggccctgtacaggcagtacgaggagctggcggcgcaggagggcgacgtggtcttcgccggtcgcctgggcggttacaagtactacgacatggacaaggccatcgccgcagccttcgagctcgtccgcaacgagctgggcgtggagcccacggaggcgtagggggctcaacgactcgagaccgacaaccaaattcgcaagaagcaataagcccggtgcagcgatgctacaccgggcttattgttgagggagcactgcacgcccacatgcccaaaaagcaaagacccggcattataccgggtctccaaaaactctctggtgctccatggcggattcgaaccgtcgaccttgggattagaagtcccctgctctatccaactgagctaatggagcataaagccgggcatccaagcgagtgcaagttcgcacggctaataaattatagcctacttgaactggtcgtggtacgccttgcagacctcatccacgggaccatccatgcgtagatcgcctttctcgatccaaacagcacgctggcaaatgcgttcaacctgctccatggagtgagaaacgaacaagaccgtgacgtcgccgctctcgataaagtgctgaatacggcgctcgcacttctgctggaaaaagacatcgccaacagaaagcgtctcatcgacgattaggatatcgggctcggtaatcgtagcgatggcaaaggcaatgcgcgcaaccatacccgaagagaagttcttcaagggcatgtcaacaaaatctttgagctcagcaaactcgatgatctcgtcaaaactagcgtcgataaactccttggtatagccaagcagcgcaccgttcagatagatgttctcccgagccgtaagctccgggtcaaaaccggcaccgagctcaatcagcggcgcaatattgccgtgaaccttaacctcaccttcgctgggctccaaaacgccagcgatgatcttgagcatcgtagacttgccggaaccgttagtaccaacaaggccaacgacctcgccacgatgcacatcaaacgaaatgtgcttaagagcgcggaattcctcaaagaacagctcatgctttgcgagcttaataaaatactccttgaggtttgtcagggactcggacgccatgttgaaaatcatggtgacgtctttaacctcaacagcaaggggctgcttgctgtaatcaatagcagattcagtcatgaacagcactccttagatgtagagaataaacttgtgctcggtcttatggaacacggtgtagccaacgacaagggcgacaaccgcccaagcaacacaaaggctaaaagtaagcgcagaaggcatggtgttaaacaggaaaatatcgcgcataaactggagatagttgtacatgggatttacaaccaccagcacttgaatccaatgtgccatctggctaataaagtcggtcgtccagaaaatcggcgtcagatacatccaggccgtgataacaacggtccacaggtgcataacatcgcggaaaaaaaccgccagcgccgacagcatcatgcccaagcccatgcagaagcacataagcaacagcagacaaaccggcagcagaattaaatgccaggtggggagcacgtggaaccaaagcataaccaaggcgacggcaaccaaagagaaggcgaagttaacaagtgagaacagcaccttctgcaccggaaagacccaacggtgcaccttaaccttcttaagcagtgaggaagcccaaatgatggacataagagcttgattcgtcgactcggacatgacagagaacgtcacgttaccgacaatcaagtaaagcggatacatttcgggcgtaatcgagccattgcgaccttgcgcgaagatagtcgagaatacaatcgacataacaaccatcatcagcagcgggttaagaacagaccatgccacgcccaagacgctacgacggtatttaatcttaaaatctttcgtgacaagttgcttaagaatgaacctgtccttttcaaaatcatttttagcgtgagaggccggtttagccaccgccttctgactctctacgttgtcagccacagaccatctccttgtctcgtaaaacataacagtggaaagtatagccctccagcgcaggcgataacccaccgcaacaaatctggagaactaacccatatctaatcaaaggggcaggcgataggtatactttcgaccagttgagtcattagaggaggtcctacatggactattcgaataccgccgtcataatcccctgctacaacgaagcgctgacgattggcaaggttgccgacgattttcatcgagagttgcccggcgcagttgtctatgtttacgacaacaactcgtccgacgacacttcgcaaatcgccaagcagcacggggctacggtgcgccatgagcccaggcagggcaaaggtaacgtatgtcgccaaatgttccgtgatgtcgatgctgaatgctatctaatggttgatggagacgacacttaccccgccgaggcggcaaaggcgctttgcgagcccatccttaacggcgaagccgatatgaccgttggcgaccgtctctctaacggcacctacgcaaaagaaaacaaccgcgcatttcacggatttggcaacaatctcgttcgcaccatgatcaaatggatatacggctacagctttgacgacgttatgacaggctacagagctatgagcaaacctttcgtaaagacctttcccatcttaagtgagggcttccagatcgaaaccgagctctccatccacgccgtcgaccaccgctggcgaattaaagacgtgccggtggagtatcgcgatcggcccgcaggctccgagtccaagcttaataccgttagcgacggcattaaggtcatcgcaatgatcggcacgctctttaaagactatcgtccgctcaagttctttacccttatagcgctcatcttcgccatcataggccttgctctcggaattccaattgttgcggagtacttccaaaccggcttagtcccccgcttccccacggccatacttgcggcctcattcatgttcctgtgtgggttgagtctagcaacgggactaatcctcgactcagttgcaaaagtcgaaagaaaacaatgggagctacaagcctataaaacctattcaaaataagaagggggtccggaaataatccggacccccttcttatcaaagccccaagtacttttcccaaaactctcgcgaagtcatgtacggcatggcatttttccatgcccccctgacgctcctgccttctttgcgatagcgcgccatcagctcgcgctctcggcagcgaacgctcttgaaccgcgctcggtccatcgtgcgaaccgatcccttctcgcgggtcggatcaagaaagaccagcgtcttgcagcgcgtcgagttgccctcaagcgtacagctgccgttctttactacatagccaggtttcccgcacagcagcgcatcgggaagataatgcttgtcgtaaggaatagatctccaatacttcataaacttcgaaggatggaattccagattagcattagcgagcacttgcttcgtaaccccggccttgcgtagaagctcagggtccatctcggaaacaggaatcagcttttcgtttagcttacccttaccgatcatagttgcagcgccatcaagcttctggagatactcagggccgcgcagatagtcctcaaagccatcaagaataaactcggcagcctgataatccatatcgcgcaaattctgacgtacccctcgctgaatacgaaggacaaacatcttctcatcagcacaatcatcgagagcaatcatggcaaagaagttgcggaaatattgataacaatccaccgaagccctgaaacgcccctcaaagcttgcatgccacacacaaatgcaattcatggtcatgtagacgggcttattgcgcatgccaaactcaacgtcgtcacagcggataaagaaaggcatgggaagaccgttcttttcgatagccttcaccggaatacagctataccaccaggctccgtaagcctggtcaacctcgacgtttgtgcgttcattttcgaggatgtcggccagcttgccgacattcagatcatcttttacgcgacgataagcaccggtagtcgccacatacgagacatcctcaaactgacgagtagggtcctccattgagagcatggcgccgttaataaaggcatccttatatttgcccttcgcaagagagaggagattgaacgtacgaatcaaactctcgggcatgatggagacatcgtcatccatcaaaatgatatgtgtgaactgatcaggagtttcagtggccgccatcattcctcgtgcaaagcctcccgagccacccgtgttgggattcgggagcacggtgactagcccatcggaaagtgatgcagaatcgagcgtctgcccattgtcgacgacaaacatgtggaagtggtcgcgaatcggaccgtcctctttggagatgcccgctttaacgagttcaatattcggaagaatgtactgctcattcttaaatgtggtagtagaaagaacaagattgatcgggttaattgagtcctcaggaacatcagtcagataagaagcgttcaagaggtctacggaatagccctcatcactctcaatcctaaaaccgattaagtcgtagccggttgtatcgacatcaatatcgataacgcaaggatcaacttcatcgccatcaaaaggattcgatttaagctcgacaggattcagctcgttagatctcactccatgaacgacaacccggcctctgccaaataaagccatatgcaagacgacgctgtcaacagacgcatactgatgccatttgccagcagataagccatttacatacgtcagaaagtcaacgtttccattgatatgaagtgaatgaatgtcgtcattatacgaagcatcaccagagagcacgcgatagtagagttcgggaaaatcctttgcatgcttttcaactttaagtacaacattcgcaagtttaaactgcatttcaaataccttaatcaaagccattgtaactactaattacattcgacgacaaactttgccatcgcggagcgaacatcaggatcagacaaaacatcctttgcaaaatgatcatgcccgcagatgtccataggcatgtaaggccatccaggataacaggcgtcagcgaccttttccgctttcgcaggaaccgaaaaagagaaaccgccaaacggatgctttcttacgggaagaatatcgttgcgatcccaaattatttttcgcttaggggcatcaaaaacgttatcaatcgcgtatgcaaaatcggcatgaggctcatcggtcaacaaaccaagtgcatgagccttttcgttaaatgaatcgaatacgctctggacaagatcaatctccgcagaagaaacaactgttctctgagcttccaagtcaacatccccgcactgcacgctaagaccactgtcgggatgaaccatccaaggattatctttccaaaaactaaactcatgctcatttttgtcaaagaaatccataagctcaattctgagttgcctaagtcgatcgttcgcgcgcttggaattctcggccgcacggtcgtaaatcgaaatgtccacaaaacaaggtataagcgaattagttgaacaaaagcgaacttgacggcactttacaaaccagtcatatacaagagtgatttgatattcagggtcgtcttttaaagcggcagtgagcttatccacatcggacctaagcatgcagatatcaatatcgtcgtcccaaggaataaaacccgatcgagacaaggtgccaacaagagaaccataagaaagccagtattgaatattattggcagcacaaatcgcgtctagcttactcatcaacaccgcgtttgcctgctgcatcaatcgaatatcaccctcggcgtcgggtaatgcatcaaagattttgcaacggagctcaaaaggggtgagatcggggtacgcacgtcgcgctaacaattcaaagcgaagcctcatttgttctgacagactttgttggcgttgcttgagcaattcaatttctggaaatagccgagtatcgaatttgtaattgatattcatattgataccgttatcggcctgctcaatacgggcgaaaacctcgtcaaaacgacggtccatatcctcatgcatagcatgcaacgatcgggatgagccagggaggatctttttaatagtagaaagcaaggacatggcttaaccttcgcaacgacaaacaatggacgaagcacaattactcatatgatacaaaagaatgagtgggtcccaccttgaaacccactcacatgaagactactccgacgcctctttcaaatactgtttccagaaatcgatcgaagtaaagacatctctatacgaagcgtattcggtataaatcttatctttgttacgcttgaattccttctcggctttacgaaaacgactccaaacctctttgaatcgcttcttatccatatgtctaatggcaccctttttattaggcatatctaccacaataagcgtgtcaacatccctgattttacctgcgggataaacccatcccgcagcatcaataacagcaaccctaccgttacgtttagcggagtcgttaacaaaacggtggccattaatggtcagataatccttaaatgcctgcagcctagacctgtcgcccccaaggctcagattgccaaaagtcagttgcgtcaagtcgacacccaattctagcgcctgagggatgagctgctcgatgggaatcaattgttccctttcacgatttgccgccataaaacgggattcagcgacaggatgagaaatccactccggacctctcaaaaaatcttcaagaccttttacggcaagagcagcttcatcgtaattaaatttcttcaagtcgagctcaacttcacgacgaatctcataaagaaaatcagagagaggcgcagcgccagttgtcgcctgactgattagcgtatttcggcttacctgataacgctccacggcagcactatacttaaacttaaaggaattatgccaaacgcaaataccattcatggacatgaacttgggcttgcagcgaagcgcgtactcggcgtcatccgaacgaacaaataaaggcaaaggcagcccctcgcgctcaatcgttgcggtaggtataacgcaataccaccagccagcatactgttgggcagtgtcctcataaaggccagttggggccttatatatctcggtctcaacgacatcatgaagtgaggtcatatagcctgcaggcttaaggggagaaaaagttcccttagcagtaaagaaccctaaatcctcggtacgcaaattgggctcttccaagctcatcatggcacccgataaaaaggcctcagcatattcttctttgagaagagagagcaggttgaaagtgcggataaaactctcgggaagaacctcgacatcatcgtccatcaggagaacatgagtcgctttaggattctgctcaagtgactcaatcatcccccgagcaaaaccaccagacccgccaacattaggatttggatgaacagtaacacgcgatgaatccaggtttgcactattcagcgaacggccattatcaataatgtgtacgtggaaatgatcagcaatctcttcatcagaatcaataatgttcttttgtaaaagagatacgttacggacaatatagtcttcttttttaaacgtagtagttgcaagcgctagctcaactggatgaatatccagttcttcacaatcgcaataataatacgcattccgaatattaacagggccttcagtactgatattaaaagcgtgcagaatctctccctcacaaagggagagttcgatttcagctgtactccattcatcggatcgttgcaaactaaccgcagagccatcaattgtagaaggaatccaagaataattatttgcatacgtctgctgaagcgttaaggcggagccgcaatactcgatatgaagataaaacgcctttgcagtagtgtattttcgccacttattaatggatagcgcattaaaatatgttgtgaaatcaacattggtcgatttcatgatttcaatagcgtcattcgaagttggaataacgagaccctccgttgccctatagcaaagcaatggatactgcaacatcgcatcagatccgttaaaaatcaaatttgcaagtttaaaatgcattgaaaaccatccaaaaaaattcctggtgcaacttggcaaaatggcataaatgcccatggcattgtctgcattctcactgattttaagaatgcaaacaatgtactaaaggcatctaatcaaaatgaagttttagctcttcctcccagtcgggcatatggaacccaaccgactcgagcctggacaggtcgagcgcggagtggaccgggcgcggggcgatggggccctcggcgccggcgtagtagtctgcggtcgataccggcacgaccctgtcgccgttgccgttggcggcctcgaagacggctcgggcgatgtccgcccagctcttcacggcgccggagccggtgcagtcgtaggtgccgtagggggccttcgcgtccagcacgtggaagatggcctccgccatgtcgcgcgtgaaggtcaggcggcccagctggtcgtcgacgacggtgaccctctcgagcccgtcctcggggtcggcgacgcggtcggacaggcccttcatcgtcttgacgaagttgtgcccctcgccgatgacccaggagctgcgcatgatgtagtggcgcgggcaccccgccacggcgatgtcgccggcggccttggtctggccgtagacggaaagcgggctggggggctcgtcctctgtgtggacctcggccgtgccgtcgaagacgtagtcggaggagacatgcacgagggtgatcccgtgctcagagcaggtgcgggcgagcagcgccggcccggtcgcgttggccttccaggcggtcacgcggccctcgggggtctccgctttgtccacggccgtgtaggcgccgcagttgatcacggtgccgtagagcgaccagtcgtactgcgcgtaggccgccgggtcggacatgtcgaaggtgtcgatgtcgcagaagtcgaagtccttggcgacgccgcgctcctcggccagctcgcgcaccgcgcggcccagctggccgttgcagcctgtgacgagggtgcgcctcggcgccatggggatgacgtccttcagcatcgggtggttgaggtcggcctcggagacggtggcctcggccagcgggatcggccactcgatggcgagctcggggtcggcgaggttcacgaaggtgtaggtcctcttcagctccagcgaccagtgggcgtccaccaggtaggtgtaggcggtgccgtcctccagggcctggaaggagttgcccacgccgcgcgggacgtagatggccctggacgggtcgagcgtgcaggtgaacaccttgccgaaggtctcgctgccctcgcgaaggtcgacccaggcgccgaagaccgagccgcgggccaccgagatgaacttgtcccagggctcggcgtggatgccgcgggtgacgccgcggctgtcgttgtaggagacgttgttctggacgacgcggaggtccgggatgcccagggcggtcatcttggcgcgctgccagttctccttgaaccagccgcgcgagtcgccgtggacggccaggtcgacgaccttgaggcccccgatgccggtctccgtgacggagaggtccttctcgaatgcgatgtctgccatgtctctcccctcctactggccctgcgcgcggtagcgggcctcggtggcctccttggccgggcgccaccaggactcgttggccacgtaccagtcgatcgtctgcttcaggccctcggcgaagtcggtgtgggccggcctccagccgagctcgcgctgcagcttggtggagtcgatggcgtagcggcggtcgtggccggggcggtcggcgacccagtcgaagtcctcggggtcgcggcccatggccgtaagtatcatgcgcagcacggtgatgttgtccctctcgccatttgcgccgatgaggtaggtctcccccatgcggcccttggtgaggatgtcccagacggccgaggagtggtcctcggtgtggatccagtcgcggacgttctcgccgcggccgtagagcttggggcggacgccgtcgacgatgttcgtgatctgcctggggatgaacttctccacgtgctggtaggggccgtagttgttggagcagttggagatcgtggcgcgaaggccgtaggtgcgggtccaggcgcggacgagcatgtcggagctggccttggtcgagctgtacggggaggacgggcggtagggcgtctcctcggtgaacttggccgggtcgtcgagcgccaggtcgccgtagacctcgtcggtggagacgtggtggtagcggacgccgtgcttgcggacggcctccagaaggcggaaggtgccctccacgttggtgcgcaggaacggctccgggtcggcgatggagttgtcgttgtgggactccgcggcgtagtgcacgatggcgtcgtggcccggcaccagctcatcgagcagcccggcgtcgcagatgtcgcccacgacgagctcgacgcggtcggccggcagcccggcgatgttctcggggttgccggcgtaggtcagcttgtccaggacggtgacgtgcacgtcggggtggttgttgaccacgtagtggacgaagttgctgccgatgaagccgcagccgcccgtgacgatgatgttcctgggctcgaagagctcttcagacatgtttctatctcccattggatcggattagtactcgcgcgggctgttgacgatctcgccggcggcgaccttcttcaggtgccggccgtagaccgacttgccgtaggccctcgcggcctcctccagctcggcggtcgtgatccagccgttctcccaggcgatctcctcggggaccgagaccggaaggtcctgggagtgctccacggcgcggacgaactccgcggcctcgtgcaggctctccatggtgccggtgtccagccacgcgtagccgcggccgagggtcacgaccgacagcgtcccctcctccaggtacatccggttgaggtcggtgatctccagctccccgcgggccgacggcttgacctcatgcgccttggcggccacgtcgcccgggtagaagtacaggccggtgacggcgtaggagctcttgggctcggctggcttctcctcgatggagacggccctcccctcgccgtcgaactccacgacgccgaagcgctcggggtcgtccacgtggtagccgaagaccgtggcgcggcccgactccgcgttctggacggcgcgcgtcaggtggcgcgacaggccgttgccgtagaagatgttgtcgccgagcaccagggcgcacggctcgccgttaatgaactcctcgccgatggtgaaggcctgcgccaggccgtccggcgagggctgctcggcgtaggacaggttcacgccgtaacgcgagccgtccccgagcaggcgctcgaagttggggaggtcggtcggggtggagatgaccaggatgtcccggatgcccgccagcatgagggtggacagcgggtagtagatcatgggcttgtcgtagaccggcagcagctgcttggaggtcacgagcgtgagcgggtacaggcgcgtgccggacccgccggcgaggatgatgcctttcattcaatcacttccaaagtcagtgaacggaaaaataaatccgtttagcaatgttcctgattgagagcgacaatttacgagcggttaaatcaaccgacgatatattgataccatcgagtgaacagattgctcgcacaaaatcaaactcatcgcgtttcaattgctcttttttatccttaaaaagtgagttcgtagtagattcgttgcacactctaaaataggaataaattgagtctagatagcagacatcactattaagtgatagacgaatccaatactcccaatcaggggagtaacacaaagaatcattaaagggtccaaccttttgccagcaatctctacgaaacatgacattagaaggctctccatagatattatgagttcgaaatgtcttgcgggcaaaatcagagccttttaaaaccatatcccgcttaaaaggtctcctcttcattgtaatggcaccattcgagtcaataacacatgaagcgctgaagcagagagagcactttggattagcatccagtgctgcaacctcagactcaagagccccgggtaacaaaatatcatcctgaaagaggaaatgaatatactcgccagaagatttctcaatggcattattccagtttccaacaagaccgagattactggcgtttctaaataccttaattcgagaatccgttagcttggaaacaatctcaaatgttccatcagttgactgatcatcgaaaattaataattcgaaatcgcggaaagactggcttaacaccgaatcaattgccttcaaaatgtacttagcaccattaaaacaaggcatcaacacactaactttaggcatccttgtcctccttatcggacaaaaattcctcaataaaatagcgaggacgatgcttcgtctccatataagtctttccaacgtactcgccgatgacacccaaagccaaaagttgaagtccgccaagacaccaaattgacataataatgcttgtccagccaacttgtacatcgccaataaaatgaccaataaaaagatatacaagtgcaaataaactaaaaatagaaatgattaaaccggtgagagtaattatcctaatcggtttagtactaaaagacgttataccttcaaaagcaaatgacagcattttaccgagcgtgtatttagattcgccggcaaaccgtttccctcgcgaataatacacgcagcaagatttgaaaccaactaaaggaaccaaaccacgaagaaatagattaacctcacggaattgagacaatgcaagaacagcacgcttggacatcaatctatagtcagcatggttataaacagcatcgacacccaacgaagactgtaagcgataaaaagactgtgcggtaaaacgttttagaaaggaatcactagaacgatcatttcgtacaccatatacaacttcatagccttcgcgagctcttgaaaccatttcatcaagcgcattgatatcatcttgtaaatcagcgtccatcgatgctattaaatcagcaaactccgctgccttgtgtaacccagaaagtaaagccttctgatggccacaattcctagagagcttaagtccacagaataaggaattagactgatgaagactttcgatgatctcccaagtcttatcggatgacccatcgtcaactaacaaaaccttactgttcgcattaatctgagacaattttactaaagtggaaaacttctcaaaaagccttttagaggtttcccgcaaaacgctctcctcgttataacaaggaaccacgagatagagaatcggcaatatgtccatctttgtcatgcaagcacctatcacttaaatgcccaatacttacttaaaatataattaagaggataagttacaaacaagttaagcagtggaccaagaatagaagaaattccaagcacactaacccaaaagtacaaaaggatgttgttgataatcaatccagtaaaagcactcgaagcaagtagcttggaaaaacttgaaataagtgaactcaaatccgatctctcattatcaaaaacatatttattgttccaatagaaggaattgatgacaccagcaaaatatgaaactatattggcgacaatatagttcactccaataaaaaggagtgccgcgtaaactaagtaagaaacgattgtatttgaaagtccaacaatcgaaaacttcagaaattgaatcaccgaatctcgtttcattaaagacccttttcctactgttatctataaaggacataaacaaaacaagaggttccatcatcgatttgagtatatccgggcagttttttaaaaccactatatcctagttcatctttcagttgagaaagaacctcttcttcgcagtcgtgattattcatgtaaacaaccagatcatcagaatcaatataatttctatcgcaaaaactgctaatagctttctgatcaggaatcagcgcatgaatgcgagacaatttggcaacttctaatagcttcgcagtgagctgatagtaatcataagagacaaagagccccgttgaacccgcgtacttctctactgcggcttcattgtcagcagatttcggatataaatacaaagcattggaagaaaagaaaacagaatctgcagcaataattgcgcaaacaaatacagcagaaactaaaatagtgccccgaaaattgaaatcagtattatttctatagcgaatttgcaaatatctaaatagatacaagaacattccaaatccaaataacagtaatcctggatatgccaagcatatgtatcttgacgaagtaaaaggagatacatagcaagctgtgacgtaaaaaacaagggatgaattaaataataaaactatataaatcgactcaggatgctcacgattaatttttttattccatagcaagtagaaacaaagggcaattgacaaacagaagctggcaatcaaaagaagccttgatccgaagaacaaatcaacggacgacgaacctagaaattgccaaattcgtccaagtaataccattacccctgattgcgatgaggccgattcgacatagtgattcccaaacatgttgcttaatgctggaggaaatatgataaatgacagacaaaccgataagacaatcgtgactccatatttaaaggagaacatccatccttttcttgcccaaaaataaatagtaaaaaaacaggaaacaaaaaagagataaatatagaaatagaagtgagttaaaaaccccaataaagaaataacaaataggcggaaataaaccgatcgattggcgaaagcaacattaaacatatcgtataacgcatcaagaaatgctagggcaagtgtcaccaataacagatacattcgaatgtaggtcactagatttaacgctatgggactgaaagcccaaagtgccattaaaattagagcgactggcttactctgaaacactttgtaagaaagcttaaataaaaatactaaactgagtgaatagaaacatagattaggaaccaagccaaaccatttgctaaattcattcggaaacagtgagcaaacggtatgaataatgaaaaaatagagaggaggatgtgcgtcattactcagattatataaaaccgaatcaaaccgaaacacatgccctgtatcaactgtcaaataagactgaatgaacgtaggatccatccagttggcatccatattgttttcccaaaaaatatgtggaaaataaaaactattcgagagaccgaaagtccacagctcgtcaacatgaaaccctgttttcaaattgcaataataaaatgcgactaataacgcagtcacaaacattacagcaaataatacgccataagacttgcatcgttttgcacatgaattcataaacgagtccctaaattaattagtagctaaactaaaggagtttacgaaaaatcataaactccttcaagattaaactaatacagttggactaaaccactgaattactgcaatagcggatagatgatagacttgcatcgcttacaatttatcaaccaacttaacctcaatcgcttccatatgtagggcctctccagttgtacccgcgcactcgcccgatttaacccaatcgagccaacccttgctttgcacatgagcactatagacgacgtcatagtgcttggcgagatctcccgtcagttttatttcaacggcctcaacagcaagagacttccccgtagtaccggcaaccttgccattcttgacccacttttgccagccgatattctgaacgtgagctcgatattcgatgttgcctgaatacccaaggtcgggtctgctgatcgtcaacgcctcaacagctaggttacgaccagttgtaccagcggtcgagccttcgtaaaccggctgctgccaaccaaggtttgaaacatgagccctgattgtaaacgttctctgaatagaaggttgacttgtatccccaggagcgggcgaacccttttcaactataacgacctgatatgcctcgagcctcaaaccaaaaccggtcgttccggcaacctgatcattacaggcccaaccgagccagcccttatcctgaacatgggctcggtagtaaacgtcatagcgatttgccatctcgccagtaaggcgaatttgaatagcctggacagacttgctttgccccgtagtaccggagacttctccctctttcgcataatcttgccaaccgtaatcggaaacatgcgtcctgtactccaagccaccatcgtagggagcattctgcaggttaagagtaatggcctcgacagcttttgactgaccaacggtaccagaagcatttccacccttggaggccgattgccagccgtcattcgaaacatgcgaagttgccaacacgtcaagagggcctcgtgacaccttaacaacgtcgtagcccgactcgcccttcttgaaataagtcagagcaccgctattgtgcgaatagatcgcaaagtcgtaatttgccgaagcaagtatggaatccgaaaactctacgagatagcaagaatctcccagtttgcaaagggatctgatagcagcatccgtgtcttcggtaatcggagaagcaaaccaatccataatcgaataatcgatgacggcacccggcttcaaggcctcggccttcgtggaattccaaagtccaccagcagcatcggcactggccgagttatacgtactagacccataaccagaaagaccgatctccggattaaagaagagaatcagctctgcagcaacggaagaatcgacatcggtaatgccaagacggtcaagctgttcctgcttttggggatacatacccgtcggtgtgtttggatgccccttgtaataatacaaatagtcatcgccatagataacttcggtcaaattggcatagtcgtcaaaattctgctcgtaagaaacgtacgttccaagcagcatcatcacctttttgccctgttgagtcgctgcatcaaaataaccatcgttaaagttgtacagggccttaaacgcttggactgtatcctctcccctattctgcaggctcgtaagcatgctcgaaacgttcatcttcttaacgttaggatcggatgcgatcttattcgcaaaggcattatcgtcaccactcgtaaacagattcgttcgagtcatccaccactgagtgccgggctcaatactcagcacggcatacatagaatcccagtgatcgtgataatcgctatacgactttgagacctcaccggtttcgtattccttattctttgcagcgttccatagagcaatcagctccgcttgcttagaatctggatccttaacgtcgaaggcctcgttggtaaagacatatgtggcagatccatcggacaacagccgaatgaagtattgaccagcgggaatcttattggcgtaaatcatcctatggatcaacgagcaggtgatgtcattgatatacagattgaactttgccttgggattgatcttgtagagcgcagcgacataatccgcgaacgcctgatagctcgaactggaagcattctcctcatgagtcaggtacggaagaccatacatcccggatggaagcgagttccagttataggcacttgggcgatcgagcattacgattgacggaatgctcgttccagcagaagaggtgctgatatcccagaaaaccagcgaatagagaacaacggggaaagaagcgctcaaaggagcaaggttgtactcgctcgcagaaatgccaattgactgatgatcctcatgaacgatatttccattcttcaaataatgcaacgtaacgtcaaacggaccataatcgctaaaatcaatttcactggagctagagcccagatctccgagtgcaatcgtgcttgagacggaacgggtgaccctccctccatacgacatggagcctgcaacctttatcgaatcagcgatgccgagtcgttttatatcctcgacctgcggaatattcagggttactttagtcgtctccccaacctgagaaagagagcaattaaagacatacgggacataggcaccagcggtatcgccaggcgccgcgtcacccttctttacaatgacgatctgtattgcttcaacggcataagaccaaccggtggttccagcagtcgacccatttgaggtccatccaagccagccgaaattagaagcatgaacgcgataatacaggtcataagaagctgccctgtcacccgtcagcttgagctcgacggcttcaatctgaaggccctttcccgtcgtgccggagacagctccattagaaacccaatcctgccagccttcattttgaacatgagagcggtattcgataccaaggtcctctgaattagggagggaaaccctgagcgcctcaagcctacgagactggcctgttgtgccagagatcgagccattcgatgtaaacgtcggctcccagccaatgcctgaaatgtgagatttatagttgacatccgggaccgcctctttgggctccatggcaacatcaatcgaaggcgccgtttcatcggctacagcagcagtttgatccgaggggtcggattgggtctctgggacggattcatattcgttggaaccaacattttgatctgcccaacaagccaaagggctcaaaagcagcatcgacatgaagcaggaaatcagaacaataaatgctctaaattgccttttcaaaagaatcgcctcctagatagacagtcttcaataaccatactatcgggagtaggcttcattaatgccaccaattaggtgaacgaagaaaaaggagccttgtccaacggcaagggccctttcccgttgccaagactacggcaacaggaaagggccctctaacaagctctcgtcgcttacgagaatggctagtagattaccaccttggtagcaaggggcacgttattccaaatccatttagcgcgatcgatgggcaaacgcacgcagccttgtgaaatatgcattcccattcggctgtccatgggattaaaagttccctggaagtacggtattgaatggaacaggtagtccccataaaactgcgtgtagtagtagcaggtatacccatgtccaaacgagtagcccttgccggtgacggtatactcacccgtaggcgttggagtactaggggcgccggtagagcaagtccagtattgagcgtaactccacgacccgcgctgtccacgaaaaactccaaggcggcatgcttgcctgtcaaccataatgagccagcttgtattgctcgaatatctattagcccgattaagcatagtcatcatatctgccggcaacaaaggctggtcagtaaacggacgcgcagtagaaccgggagcaccagcgcccttgggaacaatcttcacttgaacagactcgactctgcagcctatcctagacgtacccgcaggctgcccatttgaggtccagtcgagccacccaaagtcttggcaatatgctcgataccaaacatcaaagtagttcgataaatcaccggttaacctaatctttagagcctcgatacgctttgcacagcctactgtgccagcgacattcccattagaagtccagccttgccagcccacatcctgcacatgggcggagtactcaataccgcccgatacactacttgagacattcaacttcagtgcctcaatagcaagcgacctaccagttgtgccagcaacaccaccgttgccaacgggattcatccaaccgagcgtggcgacatgcgcctggagcgttagagctggagccgagataaatgcgggtgcagacgatgcaccaggatttccgcccttcgcgacaagctttatttggacagcctctatctggatatttaacccggtagttccagcggaatcgccgttcttggcccaacccaaccaaccataaccagccgaatgaactcgatagaaaatgtcatactgattcgccaggggaccatttatgcgcagttcaagagcctgaatggccaacccttgtccaacggtcccaacataaccggcagaccgccattcctgccaaccaatattggcaacatgggctcgtgcctcaataagagagccatcatccacaccggccagcgacacattcagagcttgaagcgaaagcgattttcccgttgtgccggcatcctgcccatctaaaacagatggagaccacccacgattagcggaatgagcctgatatacaacatgagtgcaatcggcggaagtatcggaaacaaacgctccgtccgttactccgggcgcgccactgcctttaccgataatctttacttcgacagccttaaggaatgaacccggtatcgttgcccccgcatccgcgccattacacgcccaaccaagccatccttttttggagtcaaagcaccgataccaaacgtcataggcattagacaaatcaccagtaagagtcaatctcacagccttcaaagttcggccatcatttttagagttaagcgcagcaccgtcagaaacaactccgctccatccggcaaattcatagcagcctgaataaccaattgaacctgaagtctcttgattatcaaacgaaatagaaagcgaggttaagggttcagagccgctctcggaacccattaaaatcgttttaccctgcacagtgcccaaactattgccattaaggccatacgaactgccattcagaacatccgtagctccaataaaatgattcgctgtatcgccaggagcagagcagcccttttcgaccaacataacttgaataccctgaatggcggcacccttccccaccgagcccgcaggagacccattggacgtccagcccaaccatccgcccaatttggaagcatacacacggtaccaaatgtcgtaagttgcagatatctcgtcgttcagcttaaactgaacggcctcaatggaccgagactgcccggtcgtgccaacagtacctgaagaccagctttgccaaccaatgccagagacgtgcgcgcgagaggaaatagagcctccgtggccataccaattaacactaagcgacagtgcctcgattgcatttcttgagtcaatgacccccgatgtctttccgtccgcgacaacacccatccatccaacattggagacatgagatcgataggaaacggaaggcggttcctgagaatggtccctaaaggcatcgccccgcgctggcgcatcttgagcattttttgggagcacctttatctgaatagcttcgatctgataagcatagccctgtgttccagcaggctcaccatttgaggcccagccaagccaaccaacatttgcagaatgaacgcgataccaaatgtcatacgattcagaaagaccgcccgacaaagatagcttgatcgcctcgatggctcgcgactgtccaactgttccagatgtctgcccgttacccaccagctgagactcccagccgatcccggaaatatgagattggaccgaaatgctgtcactccccaaaggggtgccatcttgtgaaagcagattgatcttgagtgcttcaacgcgcttagcacgacctgttgtgccagccgtcattccatttgaaacgggagcttgccagccaatatcctgtacatgagtctggtatgaaacggagccaaagacagcggatgcaacattttcgggtttcggcgaatcagtcgcattggaagcagactcgctagaaacggatgagggagaatcattgtctgacacagtcggctgctcgacttcaaccccctgctgttcgtcatttaagacgaagtcctcgtcttccgagctgccggcggcattaacggaataatcagtagattccggctgcaccggtaaagaatcagcccagacagaaaggggcgtcagaagacactgaagaatcagtaatggcgtcattgccgttgctagcagtcgttgcgtctttttcattcgactcccccatcaatcgaccatctttagcatcattatttatcgtttcggcaattgtattaataacgaaaacgtgaatggcacttaaatagaaacgaacggaccgttgcaaaacggcccgttcgttttaactagagtaactgctaaaacctgtgcgaaggcatgactttcgatcagctatgcaagcggcacgttgtcataccaaccccactttggcttatatgaggtggaataataatccaaccagtacgccatatcgagcgtcctgatctgaccgacattatccataacctggttattgccaatatagagacatacgtgaccgtaaatgctgcccatgcgggtatgcgtatgcgaaggaacggcaatgaccattccgactttcagctgagaataatcggtgaatttacaataatcccagtagtaatcgcaggcatctgtatggacgttcctaaatccggcacgctcgtagatatctgcaatccactcggagcacaatcccgggccaggagacggtacctgtcgggcaagatctacaatcttcttctgcatgggatttacaaacgcagaaggctgcccaagcaaacacggcgaaacggtactcccgggggcattggcgcccttccttgtaagtcgaacttggacagcttggacatgcgacccatagccagtgctaccggcaacggcaccatttttagtccaaccaagccagccgacattatcgacatggaccctataccaaacatcaaaataggttgccaagtcaccagaaagagaaattttaatagcctcaaccgaattagtttcagcagtagacgaaagctgctccccgtttgtcttgccagaagtccagcctacattcgaaagatgcagttgatatttaatcccgccggcaacagatgaagtagttttagccgaaaacccggtgatggaaattccctgaccagttgtaccggacacctctccggccgagacagaattctgccaagcgcctttcacctgagaggaatatgtcaccgaaggtatttcaagatgggaatatcccgatgtatcaggatgggaagcacccttcttaatgagcttaatctgaacagcctcgagagagcacgacataccagtggtgccggcctcctcgccgtccttggcccaggccatccagccgatgttggaggcgagttccgcacgagccggagagcacttaatgtgctctccgtgcgagcaggactgcccgagcagggaatcttacattccgcgccgcccgggcagacgatccagttaagacacgcccgctacttgatcttggtcgtgcccggtgccaggttggggtcggtctcgttggcctcggtctggaagtgctcggtgtacacgttcttgccgtcgcggaacatctcgtagtactgcatcttggcgtaatcctcgcgtgccttggtggcggctgcggcaacggcgtcgtcgccggtgacgttggaggagagcgcccagcgcagactggcatcctcgtagcccaccgagttgatggcgggcagcgactcgcgcagcgtcatgtgcgccttctggtagtcggtcagcggggcgccgatcagctgcataagctgcgtggacaggtagttggtggacaggtcgtcgacctcgctcgtctggtcgcagccggcaacgtcgtagttggcccagatgatgtagtcggtctgccacagacgttcctggtgcgtggcgtcgtcctcgccggtaaaccacttatcgttgaacttggaggggaagaacggctggtggtcgccccagaacaccacgaccaccttgcggtcgagcttgctcagggcgttgaggaagtaacgcagcgcttggtcggactgctcgatgcacgagacatactcgtcaacatcggagagcgtgccgtcctcgacggtcttagcgtccaggtcggtcgtgtcgatgttcaggtgcatctgcttgtcgaccggcagcagacccgtgtcgtagcccgagtggttctgcatggtcacatcgaagataaactgcggatcggcgttctggtcgagcagctcaagaatcttgtcgtaggttgcctggtcggtcaccatgccgcgcagggtatcggcgccttggaaatcgttgatggacaggaactggtcaaagccaaagtccttgtagacgttctcgcggttccagttggtcgcgtggttggggtgcatggccgtggtggaatagccgagcgatttgaactgctctgccagattcccggtcgtttccatgttgtagatggtgtaggggtacacgcccgagcccaggttggccatggagttgccggtcataaactcaaactcggtattggccgtgccgccgccgtaggcgctcacgtagagctttccgcggctgaggcagttggacaggttcttaaagtactgcggaccttcgtagccggcgcgcatgttctggtagatcgacaaatccgagaacgtctcgttcatgatagcgatgaccgtgggcttctcgctgtcgaactgctcctttgcggcggcgcgctcgtcgctcttggccgcgtcggatttgtcgtaggccttggcgtactttttgagcgtggccttggcgtcatcgacagaatagtcggcgggtttgggcggcttgatggactgtgccgcgctaataaaggcaggcagatagccctcgcgccagtagctctcgagcggacgccaggtgtagacggtgatgccgagggtattgtagtagtcgatgagcgtgacatgcgcggtcacgccgcccaggcacagcaccgccacgagcaggttggtgagcaacatgcgcttggcgttggcggcgcccttctgacggtgcggcgcgaccaggccggcgtactcgcacagcagcatggcgatggcggtaaagcccatggatagcacgcagaacagcgagatcgagaaggtgtagccggtgccggcgactgcggcggcggtggagatggccgaaaggtcgcccggctggatgggcatggatttaaacgtgatgacaaagaactcggcaatgcccaggacaaagagggcaaaggccaggaccgcgggagctgcgccgtggcgctggaataggaagaacaagccagtcatgagtgtggcgatgatggcccactcgagcaggatgcacagggggtagacccaggtaaagtcgtggttggacgagacctccatgcccagcagcgcaaagacgccggcgagcagcaggcacaaaacggcggcgacgagcggtttgcccacaaaggtgccgcgtaggcgggcgagcttgccggtgggggcgggggcgtcggtcgaggcgaacgcaaagacgcgcggggcgatgcggtcgcgggcgatgctcgcccaggcgcaaccggtgagaatggcattggtcaggatgagcatcacaaaggcgagcggctcgttttgggcgacgaggccaatggcgccccagacggtcaagaagagctggaacaggccgaaggagacgctccatccaagagcgcttttggcgacggcgcccgactgagcgcgaatagccttggcctcgcgcaaaacaaggtagacggtcgccgcaagaccgatcagcgagatagcggctgcgaacatgctgagactcctcacaaacttaaaacctacgaaagcggggatttacccgattgttaccaagatatgcgcagcatttgagggctgcgcacaacaaccagccataataacgcgcgggtgtggcggtgttgcgcaatggagtgtcgacctgcgcgataatggacgggaattacacggaaagataaaggcttcttaaagaaatggcgaggatgaggcaatgaacgagcaggtttgcaagacggacgttgagtgctgcggcggtgccgtgggcgtggacgccggcggctatccggtcgaagctacgggcaatgcggtgctggacatcttggagcaccgttcttccacgcgtgcctttgcgcgcgatgatgacgatcgccccgtggcggtgaccgacgagcagcgcgcggcaatcctgcacgcggcgagtcgcgcgccgtcggcaggcgccatgatgatgtactccatcgtgagtatccgcgagcaggctacgctcgaccgcttggccgacctgtgcgaccaccagcccatgattgccaaggccccgtgggcacttatatttgtggtcgactacgccaagtggatcgatctgtttgagcatgtgggctgctttgagcccgagtttgtggagcgcacgggcaagcagccccgccgcgcgccgggtctgggcgactttgccatcgcggcgcaggatgctgtgatcgccgcgcaaaacgccgtggttgccgccgaggctctggggctggggagctgctacatcggcgacattgtggagaatgccgaggaggttgctgcgctgctcgatttgccgccctacaccatgccactgtcgatgcttatcatcggcacaccccgcaaggagcgcccggcgatcgcgcatcccgtggtgaacctggtgcacgaggagcactacagccgcgccgatgccgcgaccatggatgcgcaggtggccgagatggacgcgatgttccgtccgcatgcccgcgaggtgggcgagcgcgtggtggatatctacacccgcaagcacacgagtccctttatggccgagatgagccgctccatggagtggtggttcaaaaactggctcggcaagtaacggatgcgatgaatgtgacaaagggacagcccctttgtcacattgcatatcgccgcggtggcctaaaggccgcataaatgtttatttagctgggcaaacagtgccgtacaaccatgggtcgattacctataatcccttcgaacattaaagttgggaaggaaaccggcttatggaacaaaaggccaaggaggcagcctcgcacgctgcgattcctgtgagcatctcggcgatgctcgtcacgctgggcgtggtgtacggcgatatcggcaccagccccatgtatgtaaccaaggcgctcgttgccggcaacggcggcatcgggagcgtcacggaggagttcgtgctcggcgcgctctcccttgtcgtgtggacggttacgctgctgaccaccatcaagtacgtgctcatctcgctgcgcgccgacaaccacggcgagggcggtatcttcgccctgtacagcctggtcaagcgctgcggcaagtggctcatcatccctgccatgctgggcggtgccgcgctgcttgccgacggtatcctcacgcccgccgttaccgtgaccacggctatcgagggcctgcgcaccattcccgcggtccatgccgtgctgggcgatgaccagggtcgcgtcgtcgccatcacgcttgccatcatcatcgtgctcttcttggtgcaacgcatcggcacggccaagatcggtcacgcctttggccccatcatgacgctgtggttcctgttcctgggcggcacgggtctgttctttgtcttccagcatcccgccgtgctgctgtgcctcaacccggtgcgcggcatcgcctttttgctgagccccaacaaccacgcgggcatcatgattctgggcagctgctttctcgccaccaccggtgccgaggcgctctactccgacatgggccatgtgggccgcggcaacatctacgccacttggccgtttgttaagtgctgcctgctgctgtcctacatgggccagggcgcttggctcatcaacaacgccggcaacccggagctcatgggcattgccgacctcaacccgttctaccagatgctcgccccgggcctgcgtccgtttgccgtcggcctttccaccattgcggccatcatcgcctcgcaggcgctcatcaccggcgcgttctcgctggtgtccgaggctagccgcctggatctcatgccgcacatgcaggtcttctatccggccgagaccaagggccagctctacattcccatggtcaacaacgtcatgctcgtgggctgcatcatcgtggtgctgctgttccaaagctcggcgcacatggaggccgcctacggtcttgccatcacgctgaccatgatgtgcacgacgctgctgctgttcttctacctgcacgaggagcgcaagctcaaggtcgctccgtggatcttcgtcgtcttcttccttatgctcgagggcttcttctttgtgagctcgctcaccaagttcttccacggcggctacttcaccatcctcatggccgcgctcatcatgggcgtcatggtgtgctggtacaacggcaccgcggtcgagcagcgccagtttacgctgctgccgctgcgcagctatctgccgcagctcaagcgtctgcgcgacgacgaccgttacgagcgcatgagcgacaacatcgtgtacctgaccaaagatacccataccgactacatcgaccgcgacattgtctactcgattctggacaagcatcccaagcgcgcccgcgcctggtggttcgtcaacgtcgagaccatggacgagccgtatacgtttgcctattcggttgagacgttcgacaccgactacgtcttccgtgtgcatctgtacctgggctataaggtcaaccagcgcgtcaatgcctacctgcgccaggtcgttcaggaccttgccgccaccggcgagctgcccgcgcaaaagcacgactactcggtctacaaggacccgggcaacatcggtacgttcaagttcgtcatgatccgcaagctgctggcgcccgagagcgacgtggagcccagcgagcgcacggccatcacgctcaagtacatcattcgccgtgccgccggcacgcccgcgcgctggtacggcctggagaactccaacgtgagctttgagtacgtgccgctgttcaccaagttcaaggccgtgaacaagatgcagcgcctggctcccaacgagcggccgtaggcgccgacaggctgcatggagttggttttcgatggacaagattgaggccggggaggcaaacatggatacaaaggcgctcgatggccgcgaggcggtggtcgaaatggtgcgtgaggcgcgcgtcgacgccgccgaagatcggttctttacgaatcgtgcaaacatggacatggccgatcgcgtgatttcgatcgtggcactggtatttggagcggtgtgcgtgtgcgcactgctcgcgcacgtgctgtttgtctagcggctaccggtcgtagaaggctttacacttagaaccaccacgagggaaaaccaccacaaaggtgcctgtccccttcgtggtggtttttgtttttgagggaggggtgcggtgctgatggatgcccgtgcggacggcgatcttgccgagaacttttggtggcggcgcacgacgctgacgcaccgcggtcctctgtacgacatctgcgtgtcggcggggctgctgctggcggcgacgattgtgggcgcgctgctcgaccatccgggtctcgcgccgagcatcatgatcgtctatgtgttcgccgttcagctgtgcgcattctttacctggagtcgcctgtattgcttgctgagctcggctgccgccgtggcgctctacaacttcttgtttgtcgacccgcgctactcgctgtcgcttatcgaccgcggctatcccggcatgttcttcatcatgttcgtggtctcgcttgtgtcgagctcgattgcgttggccctgcgccgcgccttggcacaggctgccgccagcgaccgccgcacgcatatggtgctcgagaccaaccgcatgctgcagcggtgcgccgacgagcaacagatcgttcacgccatggcaacgcagctggcgcgtctttcgggctgtccggtcgtgtggtacagcgccgatgccgagggcgatgacctgctgccgcgtgcgacatacacggccgtgggcgatgccgcaccggtgcacgaactggcgccgcagatgccgccgcggctctcggcgtccgcttatgtgggaacgccgctcgatgccacttatggcggctcggcgttttatggcatctacctgacggttcgcacgggcgacggcttcgtgcgctcgagcgaccccgcctcggtggtgggcgtgctggctatcgttgccgaacccgacgtgctaacgcacgaggaacggacacttgccgatgccatcgtgagcgaaggcgagctggcgctcgatcgcgcccgcgccatggaggcccgcgaggaggcggcggtgctcgccaaaaacgagcagctgcgcgccaacctgctgcgctccatctcgcacgacctgcgcacaccgcttaccagtatttcgggtaatgccgacgtgctgctcgaccagggctcgaccggcaccgccgtgctcgatgcccagacgcgccgcggcctgcttctatccattcgctcggatgcgctgtggctcaacgccaccgtcgagaatctgctcgccatcaccaagctcgagggcggcggtatgcgtctgtcgactacgctcgagctcatggacgatatcgtcgaggaggcgctgcgccacgtgaaccctgccgtgcgcgagcacgaccttaaggtggtggcgtgcgatgagccggcgctcgtcaacgtcgatgcgcgcctgatggtgcagctggtggtcaatctggtgaacaacgccatcacctatacgcccgcgggctcgcatatcatgatttcgattagcgtcgacgatggacgcgtggcgtgctcggtggccgacgatggtccgggcatcgcatccgaggaccgcgagcggatctttgagtcgttctataccgccaaccatggtctggctgacagccaccgcagcgttggcctgggtctttcgctctgccgttccattgcgttggcgcatggcggtagcatagaggttgccgcggcggacccgcacggttcggtctttacgattgaacttcccgccgccgacgtttcgtttgataaggagtagcgctgtgccgaactctgccgtaaaaccgctcatcttggtcgttgaggacgaccccgccgtccgcaacctcatcgttgccgcgctcgaggcgcatggcctgcgccatatggccgtggagactgcccatgccgctattgctgccgcctcgtcgcaggcgccgagcatcgtgctgctcgatctgggcctgcccgatatggacggcgtcaaggtggtggagtcggtgcgcacgtggtcgggcatgccgattatcgtggtctcggcgcgcagcgaggacgcagataagatccgtgcgctcgatgccggtgccgacgactacctgaccaagccgttttcggtcgaggagctgctcgcgcgcatccgcaccacactccgtcgcctttcgtatgcgcagataggtgcgggttcgtccgagggcacgttcgataccggcgagctgcatatcgactttgatgccggcatcgccacgatggatggcgaagaactgcacctgacgcctatcgagtacaagctgctgtgcctgttggcgcacaatgccgacaaggtgctgacgcaccagtttatcctgcacgagatttggggcacggcgaccaagagcgacctggcgagcctgcgcgtcttcatgggcacgctgcgtaagaagatcgaatccgaccccgcgcatccgcgctacatccaaacccacgtaggcatcggctaccgtctagtcacccaaggctagcccgtcgcccacatccccatatgagttgcggtgaaatacggtctaaatttgcctaattctaggccaaacagtccatattccaccgcaactttgttatttccccttgggcttgctggcgtagaacttcttctttttgggcttgccggcgggggagggcttgctggcgccgtgcggcctgtcgttgccgtgcggcttgccattgccggcgtgcgcgggcgctgccgcgcggggcttgcgagcctcggggttgcgcagctcctcgacgcgctcggcaatttcctcggcactaaagccgacctcggccatggcgtcctcgatgggcaggcggcgcacgatatagcagtgatgcaccttctggttgcgcgcgaagtcctcggggatggtctgcgccgtaatgtcctgcagcaccacgcctgcgcgcgcgagcttgcgcgtctcggggcggaagccacgaaggttgcagctaaagatggcatggccgccctgcgtgagcaggcgcgatacgccggccaacagctcaacgtggtcgcgctggacatcccaggtgcggcggcccatcttggacgagttcgagaacgtgggcgggtcgacaaagatcaggtcccagcggttgcgcgtctggcgctggtcgcgaatccaggcgagcacgtcgtcgcgcacaaagtgatgctgcgggcccacaaagccgttctggcgcatgttgcgctcggcccagtccaggtaggtgttggaaaggtcgaccgtcaccgtctcctcaacgccgccgtcggccgcatagcaggtggcggtgccggtgtaggcaaacaggttgagaaaacggcgcgcctgcttggcgtgctcgcggaccaggttgcgggtgacgcggtgatccaggaagataccgacgtccaggtagtcgtcaaagttgacggcaaaggtaaggccaccctcttcgatgagcggcaggcgacgacgcgcgatattggcgtgctcgcccgagccgcccttgccggcgccctgcttgccgtactgcgaaccgccgcgcgaacgcatgcgggccttggcgtgcacgtgctcggccgggacatccaggatacgcggcgcgatggccaaaatgtcgagcatgcgggcctgggccagcgcggggtcgatggtcttgggcgcggcgtattcggcgatgacgagccagcggcccggggtctgcgggcagccctcgtacagatcgatggcggcggagtagtcgggcaggtcggcgtcgtagacgcggtagcagctcgcgccctcgcgcttggcccacttgcggcgcaggcgggcgttcttgcgcagacggttggcgaactgctcggactcggggacgagcacgggcagcggcttgccgtcgcccaggtcgagcgtggcggcgggctcgggcacggcgggtgcggcgacggtctcgtcggcgccggcatccgcaatctcaccctcaacatccgcgctggtcgcggcttcaaacgccgccgcggcatggtcgagcgagggccacacctcgatagccgcttcctcgttattgggcatgacggcgatagagcgcgcgggctcggcgtggagcgcgcgggccataaggccgtcgcgggtgagcgcggcgaccggtgccgaggcgagctcgggtgcacggcgcagctcaccgatcagcgtcatggcgtcgtgcatgagcgacagcggcgtctcggtggtgtccgcgacgatggcggcgccggcgacaacgcccgcgtggtccagcacggtggtggacttggcggcgcaaaagtcgacaaagcgcttgtagccggcgcacttgaccatgcgctcggcggtcttgcgggcggcggggtcgatgtctacggcaacgatgcgcgcctggcgctcgcgtgctgcggtctcgcgctcgcgcgcctcggcaagtagctgatcccacagggcagcatcgtgcagctgccagccctcaaagccccagtgctcacgggcggcgcccggggcgcggtcggtcaggatgttcgcggcctccagcagcaggccgccgccggcgcacgaggcgtcgatcaacgtgggcagagcctcgttctcgtagtcgtcggccgtcagctcgcactcgcacagcgcggtccagccgatctgcgccagcaccagggcggcgtagtcggggcgtagcacgtgcgtgccctcgccggcgcgggtcgccgcgggcggcagacgcttgaacagcgggtcgcctgaaaggtccaggctgatgctcgcgcgacgttggcgcagcgaaagcagcagatgaacgtcgggatcggcggcatcgacgtcggcgcggcgacccgtggcctcggccaggcggtcgcacagcgcgtccttggcgcgcagagccgagaagcgcgtgttgcgcagctgctcggtcacgccgcgggcggtgatggcgatggtggctccggggcggacgatgctctcccaggcgatgtcgtaaacgccgtcgtacagctcatcggcatcctgcgcctcaaagcgcccgactaccacgaacacgcggctcgccaggcgcgaccacaggcacgcgcgatagccctgctcaagctcgccctcaaacgtagcgcggcccttcaggcggcggacatgcgaaagcccgaggcgtttaagctcatcggcgagtgcggactcaaagccctcggggcagcttgcgtaaaattccatgggtgacctctctggttgcgtcgctccattatatgatggatgcttcgtttgcccttatcctcgaaaggaacccatatgattgatgcgtgctccttgatttccattttcattgcaacagcctcaggactcggggcctcgcacaggctcccgccgccttacagaactgaaagctgggcgtagggcaaatccatggcacgtgacctgcgattgctcgaccatagatggcgtaatcgaggctaagggagggcatcatgcgcaaggcaaacgagagctggttctggcacgcgaacgacatggcggtggcgggcgacatgaacctcgtggtccgcgtcctgtgggtcgcgctcatcgtaggcatcggcgtcgcgacgatggccacgctctggatcgtcacgaggtagcgcgccacgaacggatgacgaggcgcgcggcgaatgccacgctggcggaaccctagcctcgctgctggacaatctgttcgatgagcttcgcgacggagtcctcggctgcgtccccgatcaggtgatgggccgcggccttcgcctctggcatcgcgcccgcgactgcgtaggagttcggcaccttttcgaggagcgtcacgtcgttttccgagtctccgataaaagcgacctcgtccagcgtgaccccaaggctgccgagaagcgcgtcgagtccgtttaccttgctccagccagctggaacaacatcgaggaagaatgggacgggcgaggggaaatcaagctctgggcaggcttccttgcatcgactccgaacgacttccgtcggggcggagctgacgttgacgaagatgccggcggtgatgacgtcacggttcgtgggcacgtctccgagcgccatgtctcttccggagtccttaacgatttctagggcgaattcgtcgccaggctcgacggcgcagaggaactgctcgcagcgcatgcctgtctcatcgacatcggcgactagccagagtgacgtccccgcgtaggggcgtacggcgctatcgagcttgacgagggcctccgtcgagagcgtctttttgaatacgagttcgccgctggagaagaccttctttccgttggccatgatgccggtcgagaaacagcgcgcgtcgccgtcaaaggcatcggccaggtcggcgtagtcgcggccgcttgcggggccgaacgcgatgcccgcatcaagcgccgaaagaattgcgctgtgcgtgcgctccgatacgacccttgagccaaacggcagcagggtcccgtccatgtctgcgaggatgagctttatcaaggggtcctcccgtttcggtctgggcgtcggtgcgccggtgtgcgtcgtcctagctgtattgcctgtctcccaagagattcttcgagatgatcctgttaagctctaccgggtcatcccagcaagaggtcaggaagaggaacagcagctcgatgacgaagttgatcgagctgtgcgagaaggcgacctcggttccggtgatggcctgatctcgcgagatggctcggatgatatacgtggcacgcttcgcgagcggcgtatccgggttgtctgtgatcatgatgatgggggtgttcgaatcctcggcagagtcgaatatgttgacgaggcgcttcgagtatccggacgtcgaaatgacgagcaggatgtcattctccttgaggttggttgcggcggagaccatggcatcggtggtgctggggcaaaacgccctgactccaacctgtgagagcttgaacgccgcgtttacgcccatgctaatcgagttgccgacgcccgcaatcaggacgaggttggcgttgtggagcagattgacgactgccgaaaagtcatcggagtcaatgagcgaggcggtttgggagagctccttgaccttgtgagacaggacgtacttaatggagccctcgacgtcgtccagagtaaccttgccgcccgtggccttttcctcgccggaggccctgctgatggatatgccgagcgccagacgcatgtccgaataggttcggtagtcaagcgtccttgcgaacctcgaaacagacgccggtgacgtaccggtttctgcggcgagttcgcggacggtcatcgttgcgacgtccgacgggtggtcgagcacatacgttgcgattgccttctccgaggaggataggctgctcatgaccgcgcagatgtggctgagcacatctcctgtcttatccatggttactccttggccctagtttgctttgtatcttaggtcaagagaggtgaaaataaagcaaaatgtttcataagcggtgaaatagcgtttcaccgctgatttcctaccgttcacggtaaatcggtgcttccccggcgcaatctcatcttgagctgctatcttatgagccgtgaaacaacggcatgaaaacgatgaaacaacagaacattgttccaacgcctcacaacttcgtttcacgctagatggcgaatcacttcgaagcccagacaggcacccggcgagcaagaagggagaagcacgatgcacaacgtcaggacaaacgcaagcatgacttcgctgttcttcgcgaacgtcctctactgggtctgcgcgggcgtgtactcgccgttcctctccgctcactacacgagcctcggcctcagcgcagctcagaccggcatcctcctcgcggcgaccccggtgtgtgcgctcgccatccagccgctctggtcgacgatcgccgacaagctcgggcgccgccgcgcagtcatcgtgatcctctgccttgcggcggcggtactcgctccgctgtattacctggcgtcgacgttcgtcccggtccttctcgtaacctttgcgttctcggcgtttttctcggggcttctgcccctgagcgactccctcgtcatcgagctcgcggatcgctctggcctggacttttctcgcattcgcatgggtggtactatcggctatgccatcgtcgtcctgatcgtcggtcggctgctcgacatggctcctcaaatccagttcgcggtggtctctgccgcgctggtggtcttcgcggctcacgtgtggcgcctccccgaggcgggaattcgcgccaatgccgcggacgatcccaaggtctcccacggaaagggcctcctctcgctcatatgacccaatccgctgtcaagagccacaatggccccgccgaccgctcgagccggagagcacttaatgtgctctccgtgcgagcaggactgtccgagcaggcaaccttatacctttcggacagccgcggaccaacggtcgttaagccccgctacgacagcgcaacgccgccaagccagccccagcgcacgccagagcccgtaccgtagaagctaataaacgaatcaagcgacttagacgtaatggcaccctcgttgctcataacgatgccgccgccaacgtagatgcccacgtggccgtagatcaggcccggagcaccagtgccgctgtgcgaggagtcggccacgatcatgccaacctgcagcgccgagcgatcggagctgtagcaccaggcgttgaacatgtcgcacgcgttgccgccaaagtagcccacgccggcattacggaagacgttggtaacccaagcagcgcaccagccctgaccaggcgaaggcgtggagtagcatgcgttgacgacagcctgctgcttgcccgagccgcccgtctgctgcggagtgccaccggcatacgagccgccacccgagctcgaaccgcccgaagaagaaccagtattcgcagaggctgcggcagccgcagccgccttcctggcagcctcctcggcctgggcggcagcgaggatctcggaatcacgctgggccatgagctccttgacatcgtcggaaagaccgttcagcacggtctggacctcttgctgcttggcctgcatatcctgcatctgggccgtctgctgatccttgagtttctccaggttggccttttgtgcttcgagctcggtcttctgcgcgtcgagctcagcctgaatcgtctggatatcctcgatggcatcgcggtcgctcttgttgatcttctcgacgtagtgcgcgttggcgacgagttcctcaaacgagccagaggccagcagcagcgacaggatgttcgtaccgccggacttgtagctggcggccacgcgatcggaaaggtcgttgcgcttcttcttgagctcggccttcttttcatcgatctgggcctgcgtgtcgtcaatcttgccctggacattctcgatgtcgttgagggtctgggcattcttgttggccagcgccgcatactcatttgcgatgctgtcgagctgggcctgaacctcgtcgagctgggcctgggcggcattcaatttatcggtggtttctttggaagcctccgccgcatgggcgcgagtgggcaggccaaaaagaactgccgcagaagcggcgccgaacagggccttaagggcagtgcggcgcgagagctcctgggaaaggatggaatcgctgtttggtgacatatgtactccgttacatgcttatttatatgtcgctcaactcatacatattagcgtacatatggcgcgtcccaacgatttccacgaacggcaggaaactacaaggtcggcggctcgtaagcaattgtcaaatttgaggtaacaattaagcaagctcttatatgagtacgttaacataatcctctgcttttcctacagtgcaccatttgggcgtccccgcctgcgctatactcccctctagaagtgttcctgattcgataggagactacatgtccaaagcactcgaccccaaagacacctgcgtcctcgttaccggtggcgccggctttatcggctcgcacaccgtcgttcagctgctcgagggtggctaccaggtcgtcatcgtcgatgatctctccaactccagcgccgtcgccgtcgaccgcgtcaagaccatcgtgggcgacggggccgccaagaacctcaccttctacgaggccaacgtgctcgaccgcgatgcgatgaacaagatcttcgatacccatcagatcgaccgtgtcatccactttgccggctttaaggccgtcggcgagtcggtgagcaagcccgtcgagtactaccacaacaacatcgagaacaccctggtgctcatcgacgtcatgcgcaaccatggctgcaagtccatcatcttctcgagctcctcgaccgtctacggcgacccggacaacccgcccgtcaccgaggaagaccccaagaagcccgcaaccaacccctatggctggaccaagtggatgatcgagcagatccttatggacgtccacaccgccgaccccgagtgggacgtcgtgctgctccgttacttcaaccccatcggcgctcatccgtcgggcctgatcggcgaggaccccaagggcatccccaacaacctggtgccctatgtcgcccaggtcgccgtgggcaagctcgaggccgttcaggtctttggcaacgactaccccacccccgacggcaccggcgtgcgcgactacatccacgtgtgcgatctggcctctggtcacgttgccgcccttaactggatgaacggcaagaccggcgtcgagatctttaacctgggcaccggcaccggcacctcggtactcgaggtcgtcgccgccttctccaaggcttgtggcaaggagctgccctacgtgatccgcgagcgccgcgccggcgacatcgctgccaactggtgcgatgcctccaaggccgagcgcatgatgggctggaaggcccagtacgacatcgcggacatgtgccgcgatagctggaactggcagagccacaaccccaacggcttcaccgacgccgagtagcaaaaacctacataccgttcttgccccgatctcacgttgtgaggtcggggctttttcatggcatgtagccattcgccgaaaatcgaccaacttttttatcttgcctgtacatgtttaaacaacatgttttacaataggcgtatcgaatcagaacatcggaggcggactgcacacccatcggcaggccgaccccacaacaagaaggttggtgagcgcattcatggagcgtgcaagcggcgtcctcatgcccgtctcatctctgcccggaccatacggaatcggcggctttggctggaatgcctacgacttcgtcgattttctcgcctcgtgcaaacaacattactggcagattctgccccttacgacgaccagctatggcgattcgccttatcagtcgttctcggcccgcgcaggcaaccccaactttatcgactttgccgagcttatcgaggcagggtatctggagcagcgcgatatcgatggcgtgtatctgggatccgaccccagcaatgtcgactacggtgctatctttggcggccgccgtcagattctcgaccgcgccgccgagcgctttgctgccgacaagccggccgatttcgatgactttatccaggccaacgaggactggctcatcccctactgtgagttcatgaccgtcaaagaggagtgcggtctcaaggcgttttgggagtggcccgcggagctccgcacccgcggcgaggcttccgccaaggtctgcgccgaccatccggcgcgtatgctctaccaccagatgacgcagtacttcttcgatcgccagtggagccgcctcaaggcctatgccaacgagcgcgacattctcatcatcggcgacctgcccatctatgtctcgcgtgactccgtcgagatgtgggcgacacctgagctctttaagatcgacgccgccggcaatcccgtgagcgtcgccggcacgccgcccgaccagttctcggccaccggccagtactggggcaaccccatctacgactgggacgccatggaggccgacggcttctcctggtgggagggccgcattcgcgccgccctcgacatgtacgacgtcatccgcctggatcacttccgcggcttcgaggcctattgggaggtgccgttctcctcgcctgattcgtcctacggttcgtggacgcagggtcccggcctcaagctcttcaagacactcgaggaaaagctcggcacgctgcccatcatcgccgaggacctgggcttcctcacccccggcgtcatcgatatgcgcgacaactcgggcttccccggcatgaagatcctgcagtttgcctttgagggcaccaactcgtactacctgccgcacaactacattgccaacaccgtcgcctacgtgggcactcacgacaacgagacggcacgcggctggtttgaaggaacggctaccccgcgtcagcgcgagcagacagccctgtacacccatcagcaggccggcgaacccatcgccgacgcgctcaaccgaaccatcgcagccagcgtgagcgacacgtgcgtctacaccatgcaggacctgctcaacttgggcaacgaggcgcgcatcaacacccctgccacgctgggcggcaactggacctggcgcatgctcgacggcgccatcacccgcgagctcgagcacaaactcaccgactggaccgagacctacttccgcatcccgtcggaagccgaaatcgagcttcctcaataggagctaccgcgcccgacccctccccaccgtgcggacgcgcttgcttacccgcgcgaggccaccccaatcccctcgcgcgggattcttatgaattgcagacatgtaatcaacccattacaggaggaaacatgccccaaattaacctcatggaactcgccgagcagtcttttggcacctcgctcgagcagctcgacgaccgtcgcatttacaagctgctggtcaaactcgtgcaggagcgctccgccgcctgcccgctcaacaacggcaagaaaaagctctattacatttccgccgaatttttgatcggcaagctgctcatcaacaacatgatcgacctcggcatctacgacgaggttaaggaccagctcaccgccacaggccacgacctcaacaagatcgaggagttcgaggtcgagccgtcgctcggcaacggcggcctgggccgcctggccgcatgcttcctggattccatcgccacgctgggcttgaccggcgatggcgtgggcctcaactatcactacggcctgttccgtcagcgctttgtcgacaaccagcagaaggccgtccccgacgagtggctcggtgagcaggacatcctagtcgacgacgaccgctcctacaccgtcgagttcggtgattttgccgttacctccaagctcgtcaacatcgacgtgcccggttacggccagcccaccaagaaccgtctgcgcctgttcgacctggcgagcgtcgacgacggcctggtccccggcagctccatcgacttcgacaagacagagatcgccaagaacctcaccttgttcctctaccccgacgattccgacgagcagggccgcctgcttcgcatctaccaggaatacttcatggtgagcaacgccgcccagctcctgatcgacgaggccatcgagcgcggcagcaacctgcacgatctggccgactacgccgtggtccaaattaacgacacgcaccccaccatggtcatccccgagctcattcgcttgctcaccaccgagcatggcatcgagtttgacgaggccgtgaccatcgtacgctccatggtcgcctacactaaccacacgattcttgccgaggcgctcgagaagtggccgctcgtcagcctgcagaaggtctcccctgccatcgccgacattatcgtcaagctcgatgagatcgcgaaggccgagcacgatgacccgcgcgtcgccgtcatcgacgaatacgacaccgtccacatggcccacatggacatccactttggcttctccatcaatggcgtagccgccctccacaccaagatcttggaggacaccgagcttcatccattctacgagatctatcccgagaagttctccaacaagaccaacggcatcaccttccgccgttggatccatggagccaaccccgcgctcgccagcctgctcgacgatgtaatcggcaccgactggcgcagcaccggcgatctgagcaaactcgccaagttcgccgacgacaaggacgttcttgagcgcttggccgccaccaaggtcgaggccaaggccatcatgcgccagttcatggcgctcgagcagggcgtgaccattccctccaacgccatcatcgacgtccaggtcaagcgcatccacgagtacaagcgtcagcagatgctcgcgctctacatcatctggaagtacttcgatatcaagaacggcaacaggcctaagcaccccgtcaccatcatctttggcggcaaggcggcgcctgcctacactatcgcgcaggacatcatccatctgatcctgacgctgtcgcagtggattgcaaacgaccccgacgtggctccctacctgcaggttgtcatgatcgagaactacaacgtcaccgccgccgagcgcgtgatccccgccgctgacatctccgagcagatcagcctggcctccaaggaggcgagcggcacctccaacatgaagttcatgctcaacggcgccctaaccctgtgcacgctcgacggtgccaacgtggagattgccgagctcgtgggcgacgagaacatctatacctttggtgcctcgtccaaacaggtcgagcagctctacgccgacggcacctacaacgccggtgcgctctaccgcaagcccggcattaaactgctggtggacttcatcaccaacccggcctttatggcaaccggcaacgccgagcgcctgcagcgcctgcacgacgacattaagggcaaggactggtttatggccctgctcgacattgaggagtacatccagaccaaggagcgcgtgctggccgactacgaggaccaggacgcctggatgcgcaaggcgctcatcaatatcgccaacgccggcaccttctcgtccgaccgtacgatctcccagtacaacgacgagatctggcacctgagctagctcattccccttacccatcctcttgagaaacggagtcgtggcaacacggctccgttttttgtgcccgcacgttaccctgtgatccgactcggccaaacaatctcgatccgtagcaattactcaaccaaaacggtcccagccgttacagattgagacataccggcccctcccctcgggtttatctcaatctgtaacatctagcaggtgaaattcgcctttggtgttacagattaagatgaaatggttagctcagcggaaccgtctcgatctgtaacatctaacgtccgaaatcggccctatccgttacagatcgagacaaacgaccggtcagacagtcccaacacaaagaaaggctcccctctcgcccagtggacgggaggggagccttatatgtgaccgcggcaaaaggatggcaaagccgcagtcgcccaaagggagggcctggatgcaccgggcctagataaggttcttgccagacaccttatcgaagagatgagtcgcgttcttctcgaacttgaaccagatggggtcgccagccttgagcgcgcccttggcctcaaggtcgacgacggggataatcaggacaaactggccgtcgggagcggtcacgtgtacatgctcggtcgagcccatgagctcggtcacctcgacggtgccctggagcgcaccctcctcgcccttgtcggcaagcaggatctgctcggggcgcacgccggccgtaatctccttcacatcgccgccatcccagttgagggcgagttgagcgcaggtctcgggggcgagcgccacgttcatgtcctcggtcttgacggtaaagccgttgcccgaacgcaccagctgggcatcgaagaagttcatctgcggcacgccgataaagccggcgacgaagatgttcgcggggtggttgaagacctcctgcggcgtggcgatctgctggacgacgccatccttcatgaccacgatgcggtcgccgagggtcatggcctcggtctggtcgtgggtaacgtaaatgaaggtacccttgatctcgtgacgcagcttgatgagctcggcacgcatctggttacggagcttggcgtccaggttggacagcggctcgtccatcaggaagaccttggggtcacgcacgatggcgcggccgatggcgacacgctggcgctgaccgccggagagcgccttgggcttacggtcgaggtactcggtaatacccaggatctcggcagcggagcgaaccttgcgatcgatctcgtctttggggaccttcttgagctcgagcgtaaacgccatgttctcgtacaccgtcatgttggggtacagggcgtagctctggaacaccatggcgatgtcgcgatccttgggagcgacgtcgttgacgcgcttgccgtcgatgagcacgtcacccgaggtgatgtcctccaggccggcaaccatgcgcatcgtcgtggacttaccgcagccagaggggccgacgaggacgatgaactcctggtcgtgcacggtaaggttaaagtcctctaccgcaagcacgccgtcctcggtaaccttgaggttgtgcttcttctcctcggtcttctttttgccaaagaagcccttctttttggactcgttgttgggatacaccttctgaacatgtttgagaacgatctcggccatgtctttacctttcgatacgcggcgccacgctgaggggcgccgcagaaacttgcaaaacagttacggcatcagcccttgacggcacctgccaccacaccgtcaatgatgtacttctggcagaagatgtacatgatgacgatggggataacgaccatcatgatgcaggccatcatggggccgagctcaacatggccatagccgccgcggaagtactggatcaagataggaatggtcttgtacttggtggagtcaagcgtaaggtaaggcagcaggtagtcgttccagacccacatggtctcgaggatgccaaccgaaagataggtgggcttcatgatggggagaacgatcttaaagaacacctggacggggttgcagccatcgatcatggccgcctcttcgatctcgagcgggatgttcttgacaaagccggcgaacataaagaccgcgagacccgcgccaaagcccaggtagatgaagcagatgttaaacggcgtgttaaagccgatgcggtccgcgaggttggacagcgtgaacatgagcatctggaagggcacgaccatcgagaagacgaacaggtaatagaagaagttcgagatcttgttattgacgcgcaccacgtaccaagcgcacatggagcagcacaccaggatcagtacgaccgacgtgaccgtgatgatgagcgagtacatgaacgccgaggcaaagccctgctcgttcagagcgtgcacgtagtttgcaaggccgttgaacgtctcgggcgtaagcagatcgaacgccgtagtcgtgctgattgcggtccctttcttaaaggaattgagcgcaatcatgaacacggggtagatccacgcgagcgacaggatcgtaaagaaaatcgagaggacgcggttgatagctttatcgcgtttcattactgctgcacctccttggacctcgtggccttaagctgaatcatggaaatagcgacgaccaggatgcagaagataactgccttggcctggccaatgccctgccatgcgatgccagcgcgcgaatagaacgtgttgtagatgttcagggcgagcatctcggtggagtgcgcgggggcgccaccggtaagggcgagattctggtcgaacagcttaaagccgttggtgatggacaggaacaggcagatggtgatcgtcggcatcaggttggggatcttaaccttccagaacgtctgccatgccgtagcaccgtcgaccttggcggcctcgatgtagtcggacggaatggactgcagaccggcgatgtagatgatcatcatgtaaccgacctgctgccacagggtcaggacgataagaccccagaagccggcagcggagttaagggcgatgaggtcggcgccgatattggaaagcaggcagttgatcagaatctgccagatgtagcccagcacgatgccgccgatcaggttaggcataaagaagatcgtacggaagatgttggtgcccttgagcgccttgcgggtgagcgcctgggcgatagcgagggcgatcacattgatgagcaccgtcgacaggaaggcaaacgccacggtaaagaagaacgacgtggagaactgcggatcggacagtgcgcgcacatagttctcgataccgacaaaatgtgtgttgttgatagtaataaactggcagaacgagagatagaatccctggataaaggggattacgaacccgatcataaacgccaggcacgtgggcagcataaagagcggccaccagcgcttgagtgctttgcccatagaagggtcctttcaatatgcagggggcgggcaaaccaccgtctgcccgccccctgccgctaatcagatagcttgggcagcaattgcttactcggaagcagccttctcggtcttccagccgtcgacgaaggcgttcttaacgccgtcccacttggtgttgtcggcagcataggcgatcagagcctgcttgaggttcttcttccactcctcagaggggatgtagacgaagtcccaagcgacggtcttcttgccgtccttggccatggcaacggcctgctgcgagaaaatgttgttggtgtccttggcgctcttgaacggggcggtcagacccatcttgtcagcgatgatgctggtagcggtgtcagaggtgacgcaccaatacatgaagtcctcggtggccttctgggcatcctcggaagcctgggagctgacgcaccagtagttctcgccgccggagcacaggccctggttctcctcgccgtcgacaccgatgtagatgggcatcatgccaatctggtcgtcggtcatgccagccttggtgaggtcagcgtaggcccaagagccgttctgatagaagacggccttgccggttgcgaactcgttggtggcatcgtcgccggtcttggaggcaagctgcgaaggatcgcaggtggagtcggtgatgtacaggtcgaagatctgcttaaagttgtcgagatactcgcccttgatctcgtcgtcctcctggttgtgctccttctcgaactcgtagtagagcgggaggttggcgaggtgggtggtgtagcgccagctggaggagtcgtccatgccggcggaggtgaaggcaccgtcaacgccgagctcgtccttgcgggcctggatgtcgtcggcgcaagccttcagcttgtcgaaggagtcgatgtcctcggccttgtagccggccttctcgaggagctccttgttgtagataatgccgtagctctcctggacccagtcgatgcccagatccttgccgtcggactgcagagccagggagtcgtcgatgagctcgccgcggaccttggtgtcggacaggtcggcgcagtagtccttccagttcttaagaccggtggggccgttgacctggaacagcgtcggagcggagctcttggacatctcgacttgagcttctcctcgtaggtattggaggcggcggtcacgatcttgacctcgacgcccttctcctccttgtacgccttggcgatctccttccactccttgtcgacctcgggcttgaattggaggaagtagacctcggcagcgtcaccagaagcagaggagccggagccggcggagccgccgcagcccacgagacccagaccaagaaccgcagccgcggaaccagcgaagcccaggaactgccttctgctcatttcgttcttcattacaatccaccctttcacaccgtggcgacaccctttgtcgccgccttcggagattggcttggggactgagccccttttgctaatttgtacaatacgctttttcgctagttgtttgaacaactattaccagagcggtagaaaaacctcggtgaacggtaatttcaacttttcgcttgacaagttttgtataaacaattatatgttattggatgcagacaaaacgcccggtcaagccgatatgacgtcggcctgaccgggcgttttcgctttgagggcataagcctcgccagacggcgagcctgccgcctatcgcttggagttgacgcggtagtggaagatctcgggatgcgtacgggcgtgcgtgacctcgaacaagatgccatccgaggtgtacgactggctttccatgacggcgacgcagttgtattttccaaggtccaagtagctgcagtcctcatcgttggcgagctcgacgctcaccgtacgacgacttgccatcactttgaccccgcgcttgtgctccaggtaatcgtagatggacttctccgcaatctcgggcgtaagccccttggcgatcgactccaaaaagtagccgtggtcaacctggcgggcgctaccgttaagactgcggacacgcaccacgcgaatcagctcctcgcccaccttaaaacccagacggcgggaaagctgctcggtgcaaatcagatgttcaaaggacttcacgtccgtcgacgcgacggcattgttgcgctttgcgaactcgccaaacgactcgacttcctcgagcgcaccgagcatatcggtctcacctttgagccaaatgacacgcacgcccttgccgtgaatgggttgcacgtacatctcgtcggcaagcatggaaagtgctcgacggacggtattgcgggtacacccgaactccgcggtcagctcggcctcggtcggcagcatctcctggaatgcataggttccgttgataatgcgcgaacgaatctcgcggtaaattccttcgtaaatggcttttggcattgtttcacctctaatgaatacgtacggctaggcacgatagcatttcttggggttgttcaaaccgcctatcggtaaagcgccaataattaaccgttggcggtcgctctcatacccagaccccggtcatgtaaaaaccgtcagcgaagccgcttcgccagtcctctacaattaacgattgtttaaacgttttacccacgcaagcgtgcggccgtctggaaggacaaaacatgctgcagaaaatccaacgttttggcggagccatgtttgcgcccgccatgctgttttccatatcgggccttatggtcggcatctccgccctcgccacgaccgcagacattgtcggcgaccttgccgtatacggaacgccttggtacttcttctggaccatcgtccagcgcggatcgtggacggtctttaggcgccttccgctcctgtttgccatagccctacccattggcctcgcccaaaagcaaccggcgcgctgctgcctcgaggcgctcgtggcatattttgcctactgcttctttttgagcgagatcatcaagatcagcggtgacaacctgggtcttatgtacccctcatcccttgctcccgccaccggcatcaccgtcatcgacggcatcaagaccctcgacaccggcatcatcggaccgctggcggtttcaaccatcgtcgttgccatccatgaccgcttctacgatgccaaggtgcccgattggcttggcacgttctccggctcctcgctggtctacctcatcagctttttcgctgttctcggcctcgccatcgtctcggcaatcgccgttccctttatatatggagcgaccgatacgttgcgccatgcgcttgcgggagtcggcaccttaggcgtgggcctcttcgtgtttttggagcgtgccctcgaacccttcggcctgcaccacctgctctacatgccgatctactacgacaacctggtcgtaaacgaaggcgtctacgccacgtggaccaacctgcttcccatcctttcccacagcacgcgcccccttaaggaacttgctccttgggctggctttaccgccaccggctgggtcaagctctttggcttgcccgccatcgccgcggcgttctacaccaccgcaaaacccgatcgcagggccggccttaaggtcatcctgctgcctgccatcgtcacctcggtggtctgcggcgtcaccgaaccgctcgagttcctctttatgttcacctatccggggctcttcgtgctctatgccgccttatcgtcctgccttgccatggccatgaatttctttggcatcgtgggcattttctcgggcggccttatggaaatggcggccttcaactttatcccgctcatgcgcacgcacgccggtgcctaccttatggcactcggtattgggcttgcctttagcgtcatctttttcctgagcttccgcggtatcatcctagccctcgaccttaaaaccccggggcgcgaggaccatggcgccaatcgcgccgccgacaaacagtcagcaaagagcatggaggacaaaggggactctttcgatgatgattcagccaatgcgcaggcaaacctcgatcacctgcttgccgagcacgtcgtcgagcttttgggtggcgttggcaacatcgtgggcgcaaccaactgcgccacacgcctgcgcgtggaggtcgtcgatccctctatcgtcgcggacaatgcatcgtttgtcgcagccggtgccaagggcctcatcatcaccggcaaaaccgcccaggtgatcatcggcatctccgttttgcgcattaaggagcacttcgatcagatcatggggctcgagccgggctttgcccccgaagcgccccatcccgtgcccggtgacactcttcaaaagcctgcaaatatctgcttctttgatatcgacggaacgcttgcctggcaagacccccgcgtggcccaggagctccccgaggacgaacgggacctctcgccctaccccaacgaagcggtctcgcaggccatccgcgattttgtcgccaacggcaacatggcatttatctgcacagggcgcacgttgagttgcatccatcccaaactgctcgagctgccctggaccggcatcgtctgccttgcgggcggctatgtcgagctcgacggacaggcgattcgcgatctggcgatgactcccggcatgttgcaacgccttatcccttatcttgagcagtcgggcgaggtcatccgctttgaaggccttaacggcgtcgtgcgcatgagcgccgacgcacccgacgctcctgggtacgcacgcaccgtgggagatgccgtaacgcagttgcagcactacggcgcctacaagatcttgatgtccacgccgctcgccaaccgcattgctcgggacaaggagcttgagccgctgctgtgcttcaacgagctcgagctcgatgtaacggagatatcgcctcgcgaatgcaccaagcgcgagggcatccagtccgtactcgacgccctcgaccccaaccacggaaccgtatacggcatcggcgatgccagcaatgacatcacgttgatgaatgccgtcgatgttggcatcgcgatgggcaacgcgcccgactatctcaaaaaacgcgcggactacattaccgactcggtcgatcacgacggtgtcgtcacggcgctcaagcactttagacttatctaggtatgttccatcaagcgtgccctgttgtcccaaatcactaaaaatgccgtgcagatagccccaatgtggcaatatggtgtctgcataatgcaacgatgcaacctccgaaagaatgcgagcgcccgtgtccagtccgtttaccagctttttagcccagcacttcgaccagatcaacgactatctggccacgttctttgacggacaggcgacctctgccgatatcgagcgctacctgtacgcgccgctctcggcgtttacggccaacgccggcaagcgccaccgcccgctcatttgtatgctcgccgccaccgctgtgggcggtagctttgaaagcgcccgcagcgccgcagctgccatcgagcatttccagtcgggtgcactcatccacgatgacatcgccgacaacgggcagctgcgccgtggcaaaccctgcatgcatcttaccgagggcacggggcttgccatcaactgcggcgatctggcgctcaccatggtcaccaagacggttctcgacgaccccacgcttgcgcccgacgttaagctgcgcgtgctccatgagctcaccgagatgattgtccgcaccattgagggtcaggcactcgacctgggctgggttcgcgacgggcgctttgacatctcggttgacgactatctggacatggcgacgcacaagaccgcgttttacagcggggccacgccgcttgccgccggagccattatcggtggcggcagcgaggagcaggtcgaggcgttgcgcatttttggcctgcacaccggccttgccttccaaatccaagacgacctgctcaaccttgtcggtaccaaggaagccgccaacaaggacttccgcaccgacatcaccgagggcaagcgtacgctcgtcgccgtgcacgccctgtccgataaacgccaccacgatgaggtcgaggcaatcctctcctcgggcaccgaagaccccgcgcagctcgcacgagccgtggagatcttccaggggagtggctcgattgactacgcgcacgcctacgccttggacctgaccgctaaggctaaggccgccatcgaggatgtgcagctcgacccgcatgcgcgcgagttgttcctctctatggcagatttctttgtggagcgccttaactagcgggggttacaaaacctgtcggcagcgcatttgagcacaagttgctacactgttgagagcatgtttatgcatcccttcgagttgtctatccgacagacgctcaaatagtacgaatggtacgccgaaaggggttcgttcatggaacctattacaacgggcatgcaaggagcagccgtcgaggacgttcagtcccgccttctgcagctcggctacacaattgatgccaccgaggtcgccgacaagcactttggcactaccaccgagcaggctgttggcacctttaggctcgacagcggccttgccgccggtcacgccgtcgatatcccctgctggagtgcgctggtcgacgcctcgtacaaactgggcgaccgcaccctctatctgcgtatgcccaatttccacggtgccgacgtgcaggccttgcagcgcgcgctcaacgttttgggctttgcctgcggcgaggacgacggctactttggcccgcataccgaagccgccctgcagcagttccaggaaaacgtcggcctgtttgccgacggcatggccttccaggacacctacgcctacatcaaccgcctgcaccacgtgtgggagggcaagccctcggttaccgaagctgagtcgcgtatcggttttgcccgcgcggccaacgtgctcgagcggttccagattgccgttatcggcgaggaccccatcgcgcgcagcgttgcatcgcgcatgtggaatatcgccacggcaacgaccgacaacagcggcatgatgctctgcgattccgaggttccgaccgatgttgacctggtgctcgagatcgcaagcgatgagctgcccgctgacgcagcgccgcgtgccacgattgccctcgccgaatgccacaacctggcccagcgcatccgcaccgccaatgttgccgcccagcaaaagcccgcacgcattcgcatcgaactcacgggcatgacgcgctacaacggcaccttcaccgcaagcgacgcccaaacgctcgccgtacgcctactcgatggcgtttgcgatgccctcgcagattaggtaaactagacgagttgcttttgtgcaacacccacattgggacgtagttcaacggtagaactccggtttttggtgccggctgttgggggttcgaatccctccgtcccagccaaagaaacaaagcgccctgagcccatagcggcccagggcgctttcttgtgggcaagcggagggattcgaacccgccagggtgcggagctgaggaaacgcgaagcgttttccagcgaagcacgcaaggagcgaagcgacgcagcggggcgcggccgccgaccaggcggacgcggaatccctccgtcccacaccagccaagagcccctcacgtcaagcaaatcgagccaacgccgccaagcggagggatccgaacccgcaaggatgcggagcgacgcagcggcgcgcggccgccgcaggcagacgcggcgtcggcacttagggacgttcctaaagtgccggctcgggactattttcgaggaccctccgaaggactgtggccaaaaaacggcaaatatgagtactgttaccgttgtagctacattattttcgttaataaaagaagatcttaatgagatttattcgcatcaaggtcttcctttaatgaacacttgaggagatacggcagcttatctgctcgatcgacacgtcaaatcaccttaaatgtggtcaaagttactgctactaaaagagtatcagtactcatatttgatgttttttggccacggctctttatagacaccctgtacagcgacggtggtagattttggaacgtttccgtcagccccgttccgaaaagcgagccgcatgcaacaaccaagccacgacaggccccgggagagcggggacaccggcttaggtttatcgcgagttccgcacgaacaggaggccacttaatgtggcctccgtcgtgacggtggtgccgccctcggaggccgagggggtgtcccagccctgccagccgatgccacttacattggcgttaatttgcacagagccgtcttcaacaggattcaagatgccgaccttaagatcctccactgatttagactgccccgttgtgccagctgtagatccgtcgcgcttgctgctcatccagccaatattcgagacatgtgcctcatactgaatatgcatcttgctgtcgtctacgttcagaagagaaccgttgaagcagtagttcatgtcacagcgtccgttaacgcccgggacattgccgctgcttgaatactgccagaaactgtagctgccagcataatcgcaacgccaattatattgagcgacccaatgatcataaccgctcaacgacggagaattcaggtagttgttaagccagttaaggttcgcatagatacccgacttaaagccaacggcctccatacggttgcaaaaagcctgcgcaatctgagtgagcttatccttgctgaaatccggatcttgcaagatatagttatcctcaagatcataataaatgggaagcgacggatgatggccaacgagccaagcaagtgtcctgtcggcctctttattggcatcctctacagaacgggcgtaggagtaataatacacgccataaggaataccgaggcgctcacattcagcagcatttctttcaaaagaatcgtcaggttttccgtaaacaggtccaactttgagaatggcaaaatcaatccccgcggccttaaccttattccaatcaacggttccttggtgattgctgacgtcgatgccgcgcgcaacagcgccattgggcaaagagtcgtcagttaaagacttggcatcgatgtcgccgttgccgccttcgataagcacgccattttcataacgccaagagttctgttccaaagagtcgacatcaaaggaatccgccccaacggaatcatcagccgaagcctcaccgttagaatcgtcaatatcagactctacagcatcaattccaggctgatcgctggaagcagagtccacactctcatcaggacgagcagcatttgcagcgtcaccataccattcggtttgaccttgggaatccgaagcatcgtcctgtgttccctgggaaatttcatcttgggatacgcgctcttcagacgcttgagatgtcgattgcgagatagcgccaggttcagctgacagcgcatatgcacagtaaggctgagcgacttgcgaccaaatcattactagcgcgcaagccaaaaccgcatacgcttttagacgtttcatgtatatcccccaagataacagctgaatacagcaacacaatcaacggttatattaccgcacttcatagaacacattttgagcttggaaaagcaatgcccccgacacaaaaagaggcgctcctattacggagcgcctcaataggctctatgcaaaaggtcttgcggcaccgatcacacgaccgggagcgttaaccgaacgttcggtaactccaattcccggccacgaatcgataattcgaccgttaccgatatagattccaatatgaccctggtagtaggccacatctcccctctgcatggcagaggtgctaaccggcataaacgtgttgttgcgataccagttcatagagttatacgtctgctcaggcagccaacgatggttataggggttataccaacccatatccatgccagtcgcatacaaacattgcagcactaatcccgaacaatcaaccgcatcccccggccaagaagaccaaggctcgatataacgcgttccgatatattcacgtgcacgctggataaaggcgttgatgcaatcctgtcgcgaagcgttataaggaattcgagaaggcgtgacatacgtgaagtaaccggtgcaatacgaaggaagctgtacgctattgcaactaacctttggataagagccaggggtctgatatcccatatatcgataggtctcaaaatacgaatcagacgtagagcctggtgcggaagcgcccttagggacaatctttacctgtaaggcctgaacaggaatgccaagcttcgtggtgcccgccgatgatccatttttggtccagccaagccaaccataatttgacacatggacgcgataccaaacatcaaagtaatcagaaacatcgccagtcaagttaatcttcacagcctggatttgctgtccttggccaacagttcccgatgtagccccatctgaaacagcggactgccaaccgatattggatacgtgggcagaatacgatataccgccactcatggagctatcagaaagcgacagctgcatggcctccatggcacggttctgtccaaccgttccagcaacactgccattgccaacaggcacttgccagccaagaccggagcaatttgccttagcagatagcccgggaagttgaatcaacgcatcatggtcttgaacgggggcgtcggacgaacccttggcaaccaacttaatttgaattgcctcggcctgcttagacagcccaacggtgccagctgcggcgtcatttttagcccagccaagccagccatagtctgcagcatgaatacggtagtaaatatcgtattttgaagcgtcgttcccggtcagccttaatttgaccgcctgaattgcgaggcccttgccaacagtgccagcataggaagcacccgagacgtatggctgccagccgatattcgcaacatgtgccgacacttcaactgaggcatcgatgccctgagttgcaacatacaaagcctgcagggagcgggacttgcccgtctggccagcggtttcaccgttgccaacgggagccagccagcccgcagaagcaacgtgcgcctgagatacaagaccgattccaggcgtttcgataaatgcattggcagaggagccaggcgaagactgacccttatttacaagtgcaacatcgatgccgcacaaaccggaagaaccaccagaaacgccacatgcctgaccatttgacgcccagccagtccagccattaccggaatcgcatactcgataccagatgtcataattggcagcgagttgaccgctcaacgacatttttatcgcttttatgggtgcgccggataccgccttggcagcgccaccatccgatgaagaagcgccccagcctgaatacccatccataacggaataagaaatagacccgttatcagtttgaccggcaacgctcagggcaatagagttcagcagtttagcacccttgcctccgatcgtggccttttgaccagaagaggagccaagactctccccagaaacggccgatccggaaaccgtaacagcatctggatcgccgataaagaccttggccgaggaaccgggcgccgctccgcctttctccacgagaaccactttgaccgcttcgatagccctgcccttaccggcagaaccagcggcagcaccattgcaggcccaatcgagccagccaatacctgacacatgagcgcaataccagatgtcatatttatctgccgcctcgccggtcaagcgaatctggacggcctcgaggcgctgagactttccggtcgtgccgcagtgccccttagaccactgctgccagccaacattcgagacatgaccacgaagctcaatagaacccgagtggccataccagccaagctgggcttcgagggcctccatgggaaggcccctgccagttgtcccagcaacagatccgccacctacgggagacatccagccaatattcgatgtatgcgaacggatggcaatcgaagcgggatcatcgctacggttcttaaaaggacaggtagtgtcgcccggggcggggtcgcccttgggcaggaccgcgacctggacggcctggagcccgccgaaccatgttaagcagccgggcagatcttcttgaagagctcgatgacgtcgtcgagcgtcgcctcgcgcgggttacccgggaagcaagcgtcggccatggcgtccttggccaggacctcgatctcgtcagccttcatggcctcgcagacgtgcgggatgttcacgtcagcggaaagctgcttgacggcggcgatagcggcgtcggcagcctcgtcggtgctcatgcccgtggtgtcaacgcccatggcaacggcaaccttggccaggcgctcggcgcaaaccggcttgttgaactccatggcgatcggcagcagcatggcgcaagcgacgccgtgcggggtgtcgtagtgagcggacagggtgtgagccatggcgtgatcgatgcccaggccgacattggagaagcccatgccggcgacatactggccaagggccatgccctcgcggccggagccgggctggccggacttggcctcggcgacggagtcacgcaggttctcgctgatcagcttaatagcctcaaagtggaacatgtcggagagctcccaagcgcccttggtggtgtagccctcaatggcgtgggtcagagcgtccatgccggtggaggcggtcagaccggcgggcatggaagccatcatatcggggtcgacgacggcgacctcgggggcgtcgttggtgtcgacgcacacgaacttgcggaccttctcggggtcggtgatgacgtagttgatggtcacctcggcagcggtaccggcggtcgtcggcacagcgatggtgaacacggcgtggttcttagtgggagcaacgccctcgaggctgcggacatcggcgaactcggggttgttgatgatgatgccgatagccttggcggtgtccatggaggagccgccaccgatggtcacgatagcgtcagcctcggcggccttgaaggcctcgacgccgtccttgacgttctggatggtggggttgggcttaatctcggagtagaggctccaagcgatgccggcggcgtcaagctcgtcggtcaccttagcggtaacgccaaacttgaccaggtcggggtcggagcagacgaagatcttcttgtagccgcgacgctggagctcgccggggatctccttgatggcgccggaaccatgataagagatggtattgagaacgaaacgattagccattgatagcctcccatcgtgtgcggggcacccattacgccccacgctatgaatcccatcctaacgcttttgaaacaaaaaacacgtgagaacgtcaaaattgttaaagcgtttcaacagaagatgaaaaataatgcggcaaagggacagcccctttgccgcattcggttactttcgacagccctctttccaagcctcggctgcaaccttccagcgaaaacgcaagtcgcgctcgcggtcgatgaacatgatggcaaacgcaacaaacagcagcacgctcgccaccgcaatggcgtacaggcccatgcgttcaatacaccagttgcccaacacggcgccaaacacaaaggtaaagatcacgccaaagtacagcaggccgttttccaaaaagccgcgcctgtgggtgatgatgtaatcgtccacgttttgcagcgcgttgcgcaagttgccgatgcacatggtcgtggcgatgccgtgaccgtggatcttgcggaagctctcgacttgcataccacaggcaaacgaagtgaggcagttggcgagcaggttgaaatcgccaccgggaataaaactcacgcccagcaagatgacggcttcaaagaacaccgtcacctgacgccagtgaatcacactgccaaaccgctcgtgaaccaagtcggcaagcataatgcccacggcaaacgacaccacggggaagaaatagcgtcccgccagcgcccagttgccctccgagatgcttacacccacgagcaggatgttgcccgtctgagcgtttgcgaaaacatggtcgcgcccaatgtacgaataaacgtccataaagccaccggcgagcgccaagatgatgcccagctcaatagactccgatatctgcttggcacgctgcatcgtcgtgcatcctccttgttgacgactccctcgtgcgttggcggacatatagccgccgttcatactgtaacccattgacaatatagcgtgcgcgcgagacgagttccccaacgcgcagatacacagtctggaaacaaacagcgggcgcggcgccggcacccgcatcgacgcgccaatccgccagctcatgtactccaccagtctttttagccccgtcccaaaaagactggttacaattacgtgcagcatacaaacaccgggagggatcgtggcaaaaaagcctcagcacgctcagaacaaccagcgcagtcagcagggcaaacagggccagcagcaaaagcgcggcggcaaggcgcaggccacggtcgcccgcaccaagcattcccaagcgacgcccgcccgcccctggcgcccgggccgcgacaaattcctccccgtcagtcgcgccgacatggatgcgcgcggctgggaccagtgcgactttgtctacatctgcggcgacgcctacgtggaccatcccagctttggcatggccatcatcagccgcgtcctcgacgcgcacggctacaaggtgggcatcatctgccagcccgactggaccgatcctgccagcatcaccgtgctcggcgagcctcgcctgggctttttggtcagtgccggtaacatggactccatggtcaaccactattcggtgaccaagcaccgccgccacaccgacgcctatacccccggcggcgaggagggccaccgtcccaaccgagccgtcacggtctacggcaacctcatccgccagacgttcaaggacgcccccatcattatcggcggcatcgaggcgagcctgcgtcgcctggcccactacgactattggcaggacaagctcaagcgctcggtactgctcgactcgggcgccgacatcctcatctacggcatgggcgagcacgcgattgtcgagatcgccgacgcgctcgacgcgggacttcccgtcgatcagatcacctatatcaacggcaccgtttaccgcacaggctcgctcgacgaggtctacgattacgacctgctgcccagctgggacgaccttgccgccgataggctcaactacgcgcgtagctttaacgtgcagcagcagaacatggaccccatcaccgggcatcgcctggtagagccctatcccaacagcgtctatgtggtgcagaacccgccgtcggcgacgttaacgaccgatgagatggacgaggtggccgagctcccctacgcacgcgattggcaccccgattacgacgcggcgggcggcgtaccggcctttgccgagatcaagttttcgatcagctccaaccgcgggtgctttggcgagtgctcgttttgcgccctcaccttccaccagggccgcgtattgcagatgcgcagccacgactcgatcatgcgcgaggccgagctgctcacgcgcgatcccgagtttaagggctatatcaacgatgtgggcggaccgacggcaaactttagccgccctgcctgcgacaaacagctcaagcacggcgtgtgcaagaacaagcgctgcctgtggccgagcgtatgcaagaacatggtggtcgacgagagcggctacacgcagttgctgcgcgacctgcgccagctgccgggcgtcaagaaggtcttcgtccgcagcggcatccgctttgactacaccatggccgacgcctcggacgagtttttgcgtgagctgctggagcaccatgtctcgggccagctgcgcgtggcacccgagcacgtgagcgacgcggtgttgtccgtgatgggcaagccgagccgcgccgtctacgacgcgttctgccgtaaatttgaacgcctgaaccgcgaatacggactcaaacagtacgtagtgccgtacctaatctcgagccatcccggctcaacgatgaaggaagcagtggaccttgccgaggccgtgcgcgacatgggctacatgcccgaacaggtgcaggacttctaccccaccccgtccaccatgtcaacgtgcatgtactacaccggcgtggatccgcgcaccatgcagccgatctacgtggcgcgcgacccgcacgagaaggccatgcagcgtgcgctcatccagtatcgcaagcccgagaactacaagctcgtgcgcgaggcgctggaaaaggccggccgccgcgatctgattggctacaccaagcattgtctgattcgccccgtgccgccacgcccgggcgagacgtctgctggcggcgggcatggcaccggcaagaagggcggcaaaccgcatggcggcgccggcaagggacccaaaggcagcaaggggcacggcggcatgtcgcgcgcacagaacactgccggtcgcaatcgcgcggcccagggacggcagggcgccaacggaggcgggcgtcgcaactagggcagcggtgcgctcgctgcgtccattccacacgcgtggcgcagcgagcgcattgcctcaacgaggatgacgccggcaatagcgaccgtgactaccgcgtcgagcggcgtgttcacaaaccatagcaggcccatgaggtacgagccggcattaaaggcaaagtgcaacaggatcgtgtagcggagctttccggtcgtcacgagcacccagccaaaaatgaggccggcggcacccgcgtagcaaccctgcacccaattcatgtgcataaaaccgaagattgccgcctgcagcacaatcgccgcggcgataccccacgtgcttggggccgcccagggcaccatggcgccgtcctgcgcgctcgcacgacgccggcgcttccaaagtgggcggcactgcggattaaacgctcggagcgaaaactcaaaaataatgccgcgcaccagcaactcttcacaaaatggggcgccgagcaccgtagtcaggacggcgagatagctggtgtcgcccatgcctgtttcctcgacaagctcgctgtagtcggccgcggcatcgggcagcagcgacagcacggcgtcggtcacgtagccaacgaccacctgcagggccaggccaatcacgataacgcaggcgatgcgtttccacgctccacgcgctcccccgccgagcggatgtgcgctttgccggcgtgccataaacgaacgcggccacagataacgccaccacagcagcgccatcaaaaacgatgccgtctgcgcgacggcctgaaaccattgaatatcgaggttgtcgatcggaaagcccgtcagcgccgacacgatgtccagcaccgagaacaaaaccacgctcagggcaatatcggcagcaacgacgccaaaacaggcaagcgcccaaatcaacgcattgagcatgccaccctcctcaaaaccgttccctagttctaccacaactcggcagggagctgatcccatggggacggaggaaaacggatcatttattgacgaggatcgggcgcagtgccaaaagccccgttgggcgagatgtcgaacgggaaggtgccacagcgattgaacgcggcgatgaacatgcggatggcgttggacggcgtggtgcccacgagctgggttgccgccgcgaaggccgccttttcctcgggcaagaccttcgcgactacaggggtcatgtgttctgccatggcgcttcctttttgaaacgacggtagtgcggatagatgcgggccacgcggctgggcgacgggctgtgaaggcaacccgattggcccgcatctggagtttgtttctactgcgttggtattacttggtaatcctaagtattaccccgcagatagaataccatacccaaccctatggagacggagaaaaaacggatcattttgttgctgagtaagtatttagagcgtgatgatgtccgagatattgagagcctgagcgtcgacggcatcgtgcgtagcaagcaacagcatgcggccgtcgagcaagtcgagcacaacctcggcgcatgcgtcgcgcgcagcggtatctaggccggtaaagggctcgtctagaatgaccgcgccgccggagcacagcagggcacgggcgatctcaacgcgccggcgctgcccacccgaaagctcggccacgcaagtatgcacatcaattcccggcaccagcaggcgcagcaaggccgcggcactcgaagcatccacgcgcgcatcggcgcacaccagcacgttatcgagcgccgaggcatcctcgaccaagcgcgcatcctgaaacaccatcgagcacggcgcgcactcccccgccgccagcgcaagcagcgtcgacttgcccgcgcccgaggcgcccatcacgcagatgcgcccgccagcaggcacgttgagcaccaggccgtccagcgccggcgcccacggcgcgcgatcgcctacggcaagcgcaagctccgccgcagtaccatcgcatgcaacgcccgcacgcccgcgcagcccatgcccatgcgtccgcacggccgcacgccacgccacgggtcccgaagcctgcagcagccacaccagcacccgctcacacgcccacgaggcggcaacgaccagcacggtccatgccagcaggtcagccgtctcaatcaatagctttgcctgatagatgcgctcgcccacggtacccaccgccatgccgataagctcggccgccacgccggctttccagcccatgccaatcacagccagggcgcacgaaagcacaaacggcaggaccacgcgccaggtatgggcgcaaaacagtcgccagccccgtacgccatgcaggcggaacatccgctctagcggcttatcgacctgcgccagcccctcgaccagcgaaaaatacacgcccggcagcgccatcaaaaacaccgcggcgatgctcacgcgcgccgaccccagccaaatgagcagcagaaccaccacgcaggcgaccggtgtcgccttcacaaacgacagcgccggagccaccaggcgggcaaacgtccgcgaccgtgacgaaaccccagcaagcacgccaccacataccgcggcaagcgccagtccgcccagaatccgcgcgcccgatcccgccaaaattgcccaggtgccgccatcgcacaccaggcgcaacagcgccaccacaacggcacccggccccggcaagatcagcggctgcgccaccagcgccgccaccagcatccacgcggcaagccaaaaggcggcgacggcacctgctgccgccaccgccttcatacgctctgtcatgtgtcgagcaaacgcacgcacgggctactccatgtagtagaaatcgtcagccggaagtttaccacccacggcgctcgcgtccgcgtcggccagcacctgcaggtacccgccaagcgccgtcttcatatccttgcccgtctggcacacgagcatgcacccgggaatcgctttctcggcaatcttggcgttgtccacgatgccggcatcgaccacggcctgtgcccagtccgccggtgccgcgttgacagccttaacactcgcctcgtggcagctcaagaactctgccacggcctcgggatgctcctcggcaaacgcgcggcgcaccacggtcacgcccgtcagcaggcgcgagcccgtgtcgtccgccagctcgtcccacacatcggtcaggctcaccggcgccgacagcttgccctcgctcttggcgatggccgccgtcttaaacggctcgggcagcacgcccacggcggacgggtcggcaagcagcgccgaaagcacctcggtgggctcgctcttaaactcgagcgtcacctggccggtcaggcccgcacgctccagcaggtagttcatcacatactccggcgtggtgcccttgcccgtcatgtagacggtgcggcccgccaggtcaccaaacgaggtcacgtccacgtcgcccgtcaccacgttcagcacgcccagcgtgttgatgtcgatgacctgcaccgcgccctcggtcttgttgtagagcacgctcgccacgttggccaggaccagggcgatatcgacatcgccctgaatgaccttgggtacgatctcgtcggcggcggtgttgatcgcaaagtcgaactcattgtccatctcgccgtttgcggcctggtccataaactgcaccagaccgatcgaggtcgggcccttgagcgaggcgacgtgcacctcaaccggctcggcagcggcaccgtcagcgacagacccggcagccgagcccgcgacagacccggcaccggcagccccgccgccacagcccgcgagcgcaagcgacagggcacccgcggcgagcgccgaggcaaacccccggcgcgacatctcaacatcaaacgcgcgcatcgctagcacgtcccttcgttgggcatcgtccatgcgtgatggtcggtatgcagcagctcctcggccagcggcgagagcggctcgcccaagaactcgcggtagcatgcctggacatcggggttctcgtgcgagaagcgaatgtccgcagcggcatccaggccccacagcacctggccgcgctcggccgccagttcgcagccgtcgtggatgggctggccgccgccaccgacgcagccgcccgggcacgccatgacctcgacgaagtcatagctcacgcgaccgtcgcgaatcgcgtcgagcagacgggcggcgttgcccagcccgtgcgccacggcgatgcgcaccttggtgccatcgatatcggcaacggcttccttccagccgtcgagccctcgcacgtcggtaaagaagtcggcgtcggggttcttgcccgtcaccaggcaataggccgagcgcacggcggcctccatcacgccgcccgtggcgccaaagatcacgcccgcgcccgtgccaaagcccagcggcgtgtcgagcggctcctcgacgagcgtgtccacgctcacgtggttcgcgcggatcatgcgcaccatctcgcgcaccgtcagcgcaacgtccacgtcgggcgcgccgccctcgcccaccatgctcggcagcgcgcactcggccttcttggccgtgcacggcatcacggacgccacaaacaggcgctcgggctccacgcccagcaccttggcgtaataggtcttggcgatggcgccgaacatctgctgcggcgacttggacgtggacaggctgtcgacaaactcggggtaacgtgccttcacaaagcgcacccagcccgggcagcagctcgtgaacatgggccaaccgcggctgtcgccctcgcccttagcggccttacccaggcgctcgagcagctcggagccctcctccataatggtgaggtcggccgagaaatcggtgtcgaacacgtactcaaagcccacgcggcgcagcgcgcaagccaggcgctcaacggttgcttcctcgcgcggaataccgagctcctcgccccaggcgctgcgcacggcaggcgcgatctgcaccagcacgatcttgtcgggattagcgagcgcatcaaacacggtctcagtatcgtcgcgctcgcgcagcgcgcccgtcgggcaatgcgtaatgcactggccgcacgcgacgcaatcggtcttgccgatcggcgcgcgcccgcgggtacccacggcggtatgcgtggcgcggttggtcaggtcccaaatccctaggccctgcacgctctcgcacaccttgatgcagcgcatgcatttaatgcacttgtcgttttcgcggatgatgggaaaatcgaaatcccagccctcgcccgccaaatgcctttgatacggcagatagaaaatgcccgggtcgttggcgatggtctgcaggttgcagttgccgctgcgcacgcagctcgtgcactgcgaatcgtgctgggacagcagcagctgcacgttggtgcgacgggcctcgcgggccttggggctgttggtgtggaccaccatgccgtcgagcacgtagttgttgcaggcggcaaccagctggtcgcagccctcaacctcgaccacgcacacgcggcagccaccgatctcgtttagatcgcgcaggtagcacagggtgggaatctggatgccgacggacttggccgcatccaggatcgtggtgtgctcgggtaccacgacttcgcagttatcgataatgagcctgaccatgttgtgcgctccgttttcgctgttgtcgccgacagtggttttgttgagctctaccattccaggttcctccctccgcggaacgcgccaaagccaaagtggtcgcaacgcaggcagcggcttgcctcctggcgcgcctcctgctcggtgagaccctgctcgaccagattccaatcgtgaatacgctcgccggcctcgcgctcacccagctcgcagcggccgcactcgtgcttgcccttaaactggacggtcggcagctccacgtcgagcttaatcttgtggtcaaagcccaggtagcggtcgatatttgccgaagcaacgcggccggcgttgatggcccggatgacggtggcggggccggtctggcagtcgccgccgctaaagaggccatcgaagttaggcacggcgccatccgaatcggtgaccacgcagccccacttacaggcaatgcccatgtcctcaaacggcttggaatcgatgccctggccaatggccacgaacacgcgctcgcagggaatgacgcactcgggcgtcgcggcggcacgcggggccggacgaccgcgacggggctcgccgataatctgcggttgcacgcgcaggccgctcacgcgtccgtcctcgcccgtctcaataccgagcggggctgtgagctccaaaacctcgcaaccctcggcctgggcgccggcaatctcggcgtcctgagccgtcatatcgcagatgcgacggcggtagacgatgctcactttttcggcaccgcagcgcacggcagagcgcgccacgtccatggccacgttgccgccgccgatgacgcacacgcgctggccgctcaggtcgggcagctcgtcgtctccaatggcgcgcagcatcttgacggccgactccacgccgggcgcctcttcgcccgggaggccgagtttcttgtcgctgtgggcaccaatggccaggtagacggcatcgaactcgtcacgcagacgggcaagctcctcgccgttgacggagtggtcgagctgaacgtcgataccggcgctcaagatccagtcgatctcggcctgcaggcgctcgcgcggcaggcggtagctgggaatgccgtagcgcagcatgccgcccaggtggtggcgctgctcaaagatggtcaccttgtggcccatcacggccaggtagtaagcgcaagaaagaccggccgggccgccgccgatcacggcgacgcgcttgccggtgttgtccaccacatgcggcttgtggtcgttgaggtcgctatgctcaacggcaaaacgcttgagagcgaggatgttcatggggtcgtcgaccatgccgcggcggcagtgcatctcgcagggatgctcgcacaccaggccgcagacgagcggcagcggattgttcttgcggatgaccttgacggcgtcggcatagcggccggcctcgaccagcgaaatgtacccaggaatgtcgacgtgcgccgggcagcccgaaacgcacgggacgcgggcctcgcggtcaaagccgcaggagtgctcgcggatgtgatgctcaaaatcgtcgcggaagccgcgaatggccgtgagtgccatggcgccagcttcgtagccgatggcgcagtcgctcgaaaggtagatggtgcgggcggtgcgctcaatcaagttgagcgtggactcgtcggcgcggccctcgagcacatcggcgagcaggtcgctcagcgcgctcaggcccacgcggcagggcgtgcacttgccgcagctctgggtggagcacagattgacgagcgctgccgtaaactcaacggggcacggggcgagcgaactcaccgccagacgacgtccgagcgcatcgtgcaggtcatccatgacggcctgagcgtggctgcgttccattacgtgcagtcgagccataagatcccctctcacatggcagcccggaggcgaggccgggcgaagttgctacacgcacaacactgacctaaaaagttgttaggtctccacgcagttcggcaggcggtatgaaatgtcaccctcggcggtgaaatagaacattaccgcagataaatgccatatttgataaaacgcgttaccaaatgacaatgccccgcccacgcaatcacgtggacggggcattgctccaggtatgcggccagcgaccctgttgcttttacttaagctcgggccagtaacccttgttggcctcgatcatgtcgtcgagaacctccttggcgaccttcatcgaaggcacggtcttgttcagcgtaaaggccttgagcgccttctcgtaagaaccctcgatcgtagcctcgaccacgagcttctcggagttcagctgctgcatcatgaggccctgctggaacagaggaatgttgtcgcggctgatgacctcggggccattcttgccaatgtaggcaggcagctcgaccatagcgtcgtagggcatgttggggatagcgcccttgttctcgcaaatgaccaggaagcgctgcttggtgtcgttcttcagagcgatagccagatcggcaatccagtcgccgtggctgcccgcatagaacgtgctctcgtcgatctcgcccgtcttctcgtagtggtcgatgccgtcgaagaggttcttctcacgcgtctcctcaacctcgttagcacgggtgcgctcggggttggaatgctcgacgaactccttctgctgcaggtagtagttcagatacgtgttgggcaggtactccgggaagcactccatgatctcgtactcgcccttccagacgtagtaccagctgcccttggtgtggcgattctgctcggggtgctcgtcagtggcctcctcgggcttctttgccatgagcgagcccatgcccttgaggtaggagtcgggcagcaggatctggtgctccttgatgtactcgcgcagctgcgggagcacctcctcgcccttgtggcggatcgaggtgaaccaaccaaagtggttgaggccaaagtaatcgtactcgacatccttcttgtcgatatcgagcgcggcgcaaaccacgtcgatgatcgcgatcggcatgtcgcagatgttgatgatgcgagcgttgggacgcagcacgcggcagccctcggaaacgatggcggcagggttggagtagttgagaatccagtagtccttcttggcgtacttctcaacgtcatcgatcagctcgaccatggggaagatggtgcgcatgccgtaggcaaggccgccgcagccgcaagtctcctgaccaacgcagccgtgacgcagcggaatcttctcgtcctgctcgcgcatggcatagccgcccacgcgcatctgggcaaacacgaagctcgcgtcggtaaaagccgtctttttgtcggtggtcaccgtgagcttgatgtccaggccgaggtcctcgtgcaaaatccagtccacgagcacgccgatcttgcgctggcgctcctcgttgatgtcgtacaggcgaatctcgtcaacgtcgagctcgtccttgcgcagggcgatggacttgacgatgccgggggtaaaggtggatccgccaccacacagagtaatgatcattgtttactgctccttctcaattgcgttttcgaccttgtcgcgcatctcggcgaccttcatgccaaagatgatctggatattgttgccgttgcggttgatgccgctgttgggcacgtggttgatgaggttctcatcgatgaggtccgggttcttaacgttcacgcgaagacgcgtaaagcagttctcgagctcctcgatgttgtccttgccgccaagacctgcgaccagatcggcaatgcccgcatcgacgccctctgcgggagccgcggcaacagcgccctgcttcaccgcgacagacgcggcggcctcgccctcggcaacggactcggcgagctcggactcctcctcgcgaccaggcgtgtggaggttgagcttcttaataaggaaggtgaagaggaagaagtacagagcggcgttgacgactccaagcaccagcatcatcggccagttggtcttgtcgacaccgaggaccaggttggaaaccacgatgttgatgatgccgcctgcagtcgaagcgggcacggagaggaccttgagcagaaccaggaagataccggaaagaaccgagtgaacgacaaagagcacgggagcggcaaagacaaagaggaagtccatgggctcggtgacacaggagagcacggcggtgatgatcagcgggatgataacggccttggtcttatccttgttccccttgtaagcggtgaagataaaggcgagaccgataccgatgtagggccacaggttgttgaaggtgtagctgttgaagtaggtgctatcagagaagggctggcccgtcattgccatctcggcgacacggatgggataggcgccggcgataacctgatcacccagcgtcagggtgccacccacatcggagaactggaacggggtgtagatgaggtggtgcagaccggtgggaacgagcagcttgttgagcatgccgtagataaacagaccgatgttgcccgactccttaatgatgccggcaacggaggagatggcgccctggaccggaggccaaacgatgcagaagccagcgcccatgatccaggaaatgatgatcatgatcaggaacgggaagcgaacgcccgagaacatcgaaagagcaatggggaactgcttgttcgagtacttgttgaacacggcaccggtgatgcaaccaagaatgatgccgccaaacacgccggtatcgagcacctgaatgcccataacggtgctctggccggttccggtaaggccgagcatgccgctcgcttcggcaagagagccggtggcgttgagcacgatgttattggcctgaaggaacaggaagaacgacatcagggcgatcagcgaagcatggcccttgttcttctttgccatggcgccggcgatgcccacgcagaacagaatcgagaggttgttgatgataaacatcagcgactgatagacaacggcgcccacaagctggaacggaccggagcccagtacggggaccaaagcgcagatggtcttgttggtcagaatgatgcccacgatgagcaggatgccggcaaccgagagatacatcatcggctggactatcgacttcgcgaacacctccaacggcgctttgaaattgaacttcttttttgcggtcatagcggtactccccttccttttccgcaaattaagacagatgtgccctagacaagaccgtgagccttgccttatatcaatcgatgtgtgggcacgttatgcctagagaccaggttctccaagcaggttaacaatgtgatatgcgagataactcttctcggcatcggtaacgacaacgttataggtagacgacaagtgggcggctatggcgtccgcgcacgagaatgcacacggatacgccgtttcatcgattcggaacagcgcgtctccgttgatttgcccggccgtaggatcgagcgctcgctgtgcgaaaaactgcaggtgacgaacgaaacgttcgtaaggcagcgaggtgtcatcgagggtcgtagcatagcgctcggaaacaatcgcgagcacgtcgcgaacaagctggaccgaaacaatcaaacgatcggagcgttgcggcatggtggcgttgacgatatgcagcgtaatgaaaccctgctcttcttcgctcatctggatgcccatatactccttgataatctgcagcgcacggcccgcaagtgcatactccttgcgatagaactgctggatctcgagcagcaacggattctcacaggagacgcccttgcgctcgcgctccaaagcaaggctgatatggtctgcgagagcaatgaggatcttatcgttgatgtcgacattgagctctcggcgaagcatctgaacgatgtcctcggaaatcacgaggttgacggtggggatggactccaaaagatgtgccaagcggtcaatcgtacgcgaatcctgagaagttccctcctgcaacgcgtaggtcttttcgaccgatgcctcatcgatggcatcgccggcatgacggccaaagcagaggcctcgaccgatgacgatgagctcggagccatcgtccgaagtgaccattgcgacgttgttgttaaaaactcgcttgataaccacggtacccaccataagaatttactcggaaagccagatgacaggctctttaacagcaacagggccggaagcatgctcacgaagagtcgagctctccgagcgctcgcacacgataacgaagaccgtgggatcgaagccggcagcgcgaaccacgtcgaaatcgacctcgacgaggggctggcccgcgtcgacatggtcaccctgggcaacaagcgcatggaagcccttgccctcaagcttaacagtgtcgattccgatgtgcagcatcacctgagcagagctgtcgtcggacatgatgcccagcgcgtgctcagtcggaaacagcgccgcaacggtaccggaaacaggagcgcacacgcatccctcgttggggatcacggcaacgccgtcgcccacggcacgactgctaaaagcggggtcattggtattttctagattaacaagctcgccggaaacaggggcgagaatctcgaactcggaagtcgcagtcgcctgcttgtccgagccacccataaggcgagaaaagaaacccatggtggcatgtcccttcataaatatagcccaaccaaaatcaaccgaatgcatccatagagacacacccgttcaaagactttggttaggcccacgtccgaggggactcggtaaccttccgcatttcttttacgggggttattgtagacaagcccaaagccggaacaatcattatgaccggcgaacggtattttttctccgataaacggtatttaggcggcacttagggacgttcctttcccgccggcacccaggggcactcctcactctggtgcattggggacaggtttgtttgcaccaggttggtgcagattaacccggccccattgcaccaatttcgtatgcgctagatgaagagctcgcattccttccgcacgacgcaaaccttgctcaacatctgggaaacagcggatagcttgttgggatcaagcttgcgagcgcctcgcggacatacggcgatgcagcgcatgcaggagatgcacgcctcgccagctgctcgcttggggtcgcccttgtcgatagcacaaacggggcacgccgcggcgcatgcaccgcaggaggcgcaatcctctgttgcctcgggtgccatacggcgacctccagcttgtttataaggacgattgccggggatagagggctcggacgcatcctcagccaacagcttttgctgaatttgttgcgcaaactctgcgagctgcgccgcatcctgcgcatccggtcgcccagcagcaaactgacgagcaacggaatgctcagcaatagcagaaacagctgcaaccaccctaaatccggcgcgcttcgcaacgtcctccagctctacgagcgtgtcctcaaacgcgcggtttccgtatacacaaaccaaaacagcccgagccccgttgccgcgcaccatgcccaaccggtcagccaccacagccgggattctaccggcatacgccggcacagagattgcggccacgtcgtcctcagtcatcgagacagcgctgaaatctagcccgttatcggtcaaatcgacggtaacggtattcttgtccagtgccccggccacaaggccagacaccttccgcgttccgcccgtcggactaaacacaatttcgaatacgctcatcgaggcaccctccccctacgcctggcaacgcgtcaagccgtttttacattcagacagagtatacggcgcataagggagctccccgttttggtgcgccaggcaccccaatgcacccaccctacgctgtctgcctcttcgttttgtataaattacggtacagaatgtatatatttacgggataccgccgtgttctcctgaggtaccccatcctggcccgtgcaaaaaacggagtattctgcaacgtgaccgcgccagcaccgccgcgggcgagcaaaactgtagggcgttgcgtcatttagggttccgacatagcgagaatgacgtacctttgcttcgaaaaacggcgaaatctaactcaaaacgctcatagggggtatctgaaggccaccgttggcaataccgaatcgtatgcagccagctagagctgctgaatactccaaaaaatgcacggcacaccccatgggacccattgccgcatggcaggaaacaggcccacggcatcttctagatgcattcccgaggaaatcacatttgaactagcgatcggatacggcaaacaaaaagggccccgagcgtagttgctcggggcccttggttcacctcgctttttagtgggcgatgcgtatgctatttgcgcttgccgccgccgtcaccggggcggcgggagctgctaccgcgcttgccaccacgactattgccatagctgccacggttatcgcgaccgccggcacgaccgccgcgggagccggcctggctgccgccacgcccgccacgatagccgccacggcgctcctcgcgggtgtcgtcgtagttgcgccagtcatcgcgacgatcgcggctggcacgcggatcacgacgatcgcgcgactcaccagagcggtgagcgccgctgcggtggccgttgccacgagcgccctcgcgacgctcaccgccacgaccaccgcgctcgtcaaagcgcttgccgccacgggactcaccgccgcgggcacctcgctcaccgcgaccctcgccgccgcgacgctcatcacggccactacgctcgtcatcgcgaccggaacgacgacggtcgcccgagccgcgcttgccaccgcgcgaaccgcggccctcgtcctcgcgctcaacacggcgacggccaccgcgatcctcatcctcgcggcggcggcgatgtgcctcgccctggaactgcttggcacgacgctcggcacggttaccgcgcgcaggctgctcagcggcaccagcaccgccgcgctcctcggcagccacctcgcgggctacgctttccacagcctcgtccacgcgagcctgaacgccctcgcgcacgcgggtcttgccgccacgtttgagacggctcggacgctcaccgtcgccgcgacgctcatcgcgaccgcggttggaacgaccggccacatcgccgtaatcgtcgccgttgcgcttgccgtcgcgacgcgcctgctcaagcttcttcttgctcttggacttgccgcgcttggtcttcttcttcaccttaaaggccgcagggtcgcgctcgggatcaaccgcaggcgggttgggacccacatgcaggtcgccggcctcgtagatgtcggcggtcttgtccatgagcttctcgatctcgtagaactcatcgacgtcctgctcggtcacaaacgtaatggcccagcccagctcgccggcacggcccgtacggccaatacggtggatgtagtcggtcggctcagccggcacgtcaaagttcacgacgtagcgcacgtcgctgatgtcgatgccgcgggcgagcacgtcggttgccaccagcacgtcaacggtaccgtcgcggaaggccgaaagggcacgctcgcgctgggcctggctgcggttgccgtgaatcgcagcggccttgatgcccttgcgctcaaggcgacggcagcagctgtcggcacggtgcttggtacgcataaagacgatggtgcgctccgggccctccttcttgaggaactcgggcagcaggttgttcttggcctcgatggacaccgggaacacaaactggtcgacggtgtcggcggtcgacgtggcgggcgcgatctccacgcgggccgggtcgctcaccaggtcggtgatctcgcccacggcctcctcgtcgagggtcgccgagaacagcagcgtctggcgctcggccggcgtctcgcgcacaatgcggcggacggcgggcaaaaagcccatgtcgagcatgcggtcggcctcgtcgagcaccaagaccttgacctcgttcagatgacaggcgtcctgctcgatcaggtcgaccagacgacccggcgtggcgaccaggatgtcgcagccgtacttgagcgccgcggtctggggcttgtagctcacgccgcccacgacggtcacggcaacatggccggtgacgtcggcgatcttgctcgcgacctcgtcgatttgctgggcaagctcgcgcgtaggggtgatgacgagcatcaccgggccgcggccgttgccctcgggctttttagcaccgcgacgacggttgcggccgccgcgttcgcgcacgggtttgggaggagcgatgtgctccagtttgttcatggtcggcagcaagaaggcggccgtcttgccggtgccggtctgggcggcggcaagcaggtcgcggccctcgagcaccacggggatcgagccggcctgcacgggcgtcggcgccgtgtagcccaggttctcgatggcacgaagcatctcgtccgaaaggcccagctcgtcaaaggcgggcaggctctcggtagcggactcgacggcctgggcagcattggcctcatcggcggcatcgaaggcagcctgggtcatggcctcacgggtctcgtccaggatctcggcgtcggtgacgtcggatacagaattacgcatatgttgttgttccttatctgcacgcgcaatgggcacggcatgcggccgcgcgggcgtgcttggtagtgcgctaatacatacaaaaacgggtgcgcacagagaggacgttgctcagcacgctggcgatcgctttggcagccctgtcacgcgccgtccagacgcagcagctctaagcgatggagcagattcgccacgggttagtatacccgtactccgtatgcccccacgtaaaccacagatgacgaggcggacgcggcgggcccggctgattgtctcaatctgtaacggctgcaaagcaaaaccggccctaaatgttacagaacaagacagagggggatttccgtccagtccaaaccaaatctctcagtcttcctgcaatttcgaacatgtggcctataatgttgctttggttacgctatatattgcgcagccatttaatacgtcgcccaccgggggccattaattcctatcgccatattggctaggaagcaatcaaaggaggtatccgtggcagcagagacgccttgctcggtcctctataacgatattcgctcgttcggcggtcttaaacatctcgagatcgcccgaatgctcatcaatggaaactcttatctcggcagtaccctgctcgagaaatgctcttccaaccgctcgtatctcacccgttacatcgtccatcgcaagcctgaccagtgcgcgccctccatctacagcgactttaccgtcaccacgctcaacctttccgcggcaatctgcagcaagctcggcggcggcgagtccgcctatcgggcaatcgccgagcactatcgcggtccggccgccaacgaaatgatgtcggctctcgccagctacaaactggacagccgcctatatgcaaatgccctcaatcgcatcgacaactttgacggcaatgccgtgcgcgaaaagagcacgctcttcctgatgctctttgtggcgacgggcgcactcgccgatcccgctcagggcgtggcgaccgttgagcgcttttgcgatagcaagactggcgggcattttggcaccaccgagaccaccgtcggccgtggttttttgagcagcttggatcaaccgcgtgccgtcgcccccaacctcggcttgcttaggacgcacgccggaaacagcgttgacatgcagatccaccccctgacgcgtgacccgcgcggcacggtaattgggtccttgcccaaaacctcgcccagcatcaccgatgtgggcgccgacgcatcgcgcgagcatctccgcatttggctcgaaggcggacactggtacgcccagggccttgggtcgaccaacggcacagtgctcgaatcgggcgcgggcgacggcgatatcgtaatcgagccgccgcgcgaccaacgcgagcccggcaaagtctatcccccggtggaaatcgaaaacagcgacaggctccatctgggtctctacacgacattccttgtcattgtggactagcgcggacggcgatcgaaagacgggcgccgtccgtctttcgtcttctaccttctgcgtcgtaaacgacaatactcagcggtatacgtgggcagtgtggctatcatggtactttaccgatatccacactgcccacgtatacgcgcagcaacccatgctagacaaaggaacgccatggatactaccgatagcgcctatggcgacaaactcatccgtcttgacacgttcgacaccgccgtggcggtcgaccccagcgccgaggacgacgccaagcgtcggtttatgacgcttattctccagacggcccaccgcaacaacggcaacatcgggcacgtgctgcgcgcgaccaacacgagcggcgaggtctttgccgtcaagctgctcaaggacaacgccatcctttccggccaagcccccgaccgctccgccgagcaatcggccgcgcacctggccaacaccgccgcactgttcgaggagtaccgtcatctgtgtaccgtctcgcacctgcgcggatttccgcgcgtctatggctacggatcgtgcgagaacgacccgctcatcctcatggagtgggtcgagggcacctcgctcaagcaggcgctgcccttgcttccgcacgacgcctcgggcgggctgaccacccagatggtcgccgccgtcggaaacgccgtacttcgcgcgctcttgatgacccaaggcctcgtgaatccggtcatccatcgcgacctgtcgcctgccaatatcatgttccgcaccaccagccgaacgctcgagcagcagattgccgattgctcctttgacccctgcctcatcgacatgggctccgcgaccatggccctcggcgacgacacgatcacccggcgcgccgacatctggcgctttgccacgcccgcatacgccgcgcccgaaatgctcacgcaggatatcgaaggcatcgcggcccttcgccgctcgcccgcgatcgacgtctatgcgctttcgagcattctgtaccagctctacagcggtcgcaaaccgttcgatgtcgagtcgacgggtgccgcggcgaccggctcgttctacctcataaagaccaagaccaagccggcgccgctcgagccgcgctgcgagggcgacaaagcgctcgtccagatcatcatgaaaggcatctcggtcgaacagggcgatcgccctaccgagcagcagatgctcgaggtgctctcgacatacctccccgctgcagaatctgaggaccgcgagggtgcaggagacgaggccgcaattgatatcgattctggcacgcaccttaaggtcgacgtcgccggcgagcgcgcacgagagatcctggagcaggcccggcacgacgccatgacccgccgtcgctttattatcggcggcgtcgttgcggtcgttgcgggactcggcgtcgttggcgcggcaacccatggcttcggcatccccgactacctggacggcatccgcggttcgcttgacgactacacttgggaccagctgcaggagatttcgctcaagattaaggccgccgagacccgtagcgaggcacgcgagattgccaagcgctaccacctgctcgacgctgatgggcatatcccctatccgtgcaccaagcgtgtcacgctcaccagcggactacaggttggcgcgcagcttgtgggcatccgccacgatgagcttctggacgggacgggcaaggccgggctgacgtttatgttcgacgcgggtattgccgagcgcaacgctacggctgaaccgccgagcgccggctgggcagattgcgagctgcggggatggctcaacggcgacggccttaagctgctacccaacgagttgcgcgcgctcattaaaggggtcaagaaggtctcgaacaatgtgggcgccgccaacagtgcatcgtgtctgagcgagttgcccgcaaccctttggctgcccgccatggtcgagctgtgcggtacgcaaccgcccgattcgtttgccgagggctatcactacctggcagacatctacaacggcgagggcaaggagtatcagctcttccgcgagctcaaggtgagcccgtattccacgaacgagacgatggtccgccagtggaagggcaaggacacctgttggtgggagcgcacggtgagccccgacacatcggagagtggaggcacactctatttgaatcgcgtgggacacgacggcgacgtctttacgtacgcaacgcctgcggaaaagccaaacaagcgaacctgcgtgatccccgggttctgtatctaggcggcgggcgtcttgccgtgacgagacccctccccggcaattgtctcaatctgtaacactagctcggcagatacaggtctagatgttacagaacgagacaaaaccccaaccctgcgagacaacatctcaatctgtaacagtaaggggtcaaaaaccggtccagatgttacagatcgagatgtttgagttgaccgcggacggtctgtctcgatctgtaacatctagcaggcaaaacggtccccagatgttacagattgagacattagactggctacggtccgccgaactggctgtcacctcgaccaataacagaatgtcatacattttcatctccattagacacccccagggggtatgggtgtatagtatcggcaggttaacaattccaataccgaaccacggaaaggagaagccatggctcaagataagttcgatgtgggcggcatgacgtgcgccgcatgccaagcgcacgtggaccgtgccgtgagcaagctcgacggcgtccaaagcgtcgcggtcaacctgctcgccggttccatgatggtcgactatgaccccacgcaggtctcccccgacgatatctgcaccgccgtcgaccgcgcgggctactcggcctcacccgtcgatgcgggcgacggtaccgacggctcaaacggcagcacgcaagtcaggtccggcaccgcccatatggagtcgcccaccaaaaagctggaggcagccgcctccgccatgcgcacccgcctcatcatctcgatcatcttcctcatcccgttgttctacataggcatggggcacatgctcggctggccgctgcccggcatcttcaccgaccatacgcacagcatgacgctcgcgcttaccgagctcgtcctgctcatccccatcgtctacgtcaacgacgcgtactttatcaacggcttcaagtcgctcgtgcacggcgcgcccaccatggacgcgctcatcgccgtcggcgccaccgcgtccatcgcctggtcgctctacgccatgtttatcatggccgaccagctggccgccgggcaggtccacgaggccatgatgacgggcatggacaatctgtattttgagagcgccggcacgattctgtcgctcgtcaccgtgggcaaatacctcgagacgcgcagcaagtccaagaccggcggcgccatcgaggcgctgatcgacctggcgcccaagaccgcgaccgtcgtggccgaggacggcaccgagaccaccgtcgacgtcgacgccatcctgcccgaccaagtgctgcgcgtgcgccccggcgagtccatccccgttgacggcgtggtgctcgagggcgcctcggctgtggacgaaagtgcgctgaccggcgagtccatccccgtggaaaagaccgccggcgacaccgtcaacgccgccacggtcaaccgcactggatcgttcaccttccgcgccacgcgcgtgggcgccgacacatcgctcgccaagattatccagcttgtggaggacgccaacgccaccaaggcgcccatcgcacgcatggccgataaggttgccggtgtgtttgtgcccgtggtgtttgcgatctcgaccgtgacctttgtggcatggctggcgctgaccggcagtgtgaacgaggcgctcacctccgccgtcgccgtgctggtaatcagctgcccgtgtgcgctagggctggccacgcccgtcgccattatggtcggcaccggcaagggcgccgaaatgggcattctgtttaagagcgccgaggcgctggagagcctgcgcagcgtgggcaccgtggtgctcgacaagacgggtaccgtcacccgcggcaagccggctgtgaccgatatcgtggcggcgacgcgcgccgacgggacacccgccatgagcgagaaggcactactcaagcttgccgccgcgctggaacatcaaagtgaacatccgctggccgaggcgattatggccgagtgcgagacacgcggaatcgtcgcgcgcatggtcgaggactttgccgccgtgcccggccgtggcgtcacggcgtgcgaaggtcaaaacgccatcgccgccggcaacgtgcgcttgatgaacgagctgggggtcgccgtacccgctggcctcgccgagcaatttgccgccgagggcaaaacgccgctgttctttgccaaaaacggtgagcttgccggcaccattgccgtggccgacgaggttaaggagacaagcgccgaggccattaccgcgctgcgctcactcggcgtcgacgtgcgcatgctcaccggcgacaaccgcgtgacggctgaggccatcgcccgccgcgtggggctcaccagcgagcaggtcatcgctgacgtcctccccgccgacaaggagcgccacgtgcgcgagctgcaggacgcgggaggcaaggtcgccatggtgggcgacggcatcaatgactcccccgccctggcgcgcgccgatgtgggccttgccatcggcaccggcgccgacatcgccaaggagggtgccgacgtggttctcatgcgaagcgacctcatggacgtcgcccgtgccatcgagctctcgcgcgccacgatccgcaacattaagcaggacctgttctgggcgctgttctacaacggcatcggcatcccgctggccgcaggcgtgttcttccccctcaccggctggcagctctcgcccatgttcggcgccgcggccatgagcctgtcgagcgtgtgcgtcgtgtccaatgccttgcgtctgaaatcctttaagccaaagacggcacgctgatgcacccgaccttgcccctcaaaccgtcgctcgcgtacccaagtacgcttcgctcctctttcggggcaatctcgggcacctcagcgtgcctttaagatgactctgttcacgactaaactgtcagataacctcaatcgataaggagtacacccatgaactacatcattaagacgtccggtcttatgtgcggccactgcgacgctactgtcgagaccgcgctgctcaacgtggttggcgtgaccgatgccgatgccgatcacgagacccagaccgtccaggttgagtgcgccgacaccgtaaccgccgagcagctcgccgccgccgtcgaaggcgccggcgagaagttccacgccctgtccgtgaccgccgcctaacaactgccgcctgccccctgtcagttgcggtgaaatacggactgttgagccgccctaggcctttaaacagtccgtatttcaccgcaactgacagggggtatccggaagatcgaccagaaacgaggactcgccatgatggcagatcacaaatcggtgacccgtatgctcaagacggcgcgcgggcagatcgacggcatcctgcggatggtcgaggaggaccgctactgcgtcgacatctccacgcagctcatggccacgcaggcactcatcgcgcgcatcaacgccgatgtgctcaaggcccatatcgagggctgcgtcgcctcggccatcgaatcgggcgacgaggagctcaaggccgccaagctcgccgaaatcgaacgcgtcgtcgacaaactcgccaagtaattggtgcaaggggggtcaggtttctttgcaccatcttggtgcattggggacagacttgcgccgccactggtgcatcggggacaggtacgtttgcaccaccttggtgcagattaacctgtcccccatgcaccaaatggggtataaaggcgtgcagcatatcgaatgagaggcagtttgcatggataactttatgaaaggtcgcaacggcgccgacgaactcaccatcgtgctcggctttttcggcatcatcctcgcgatgatcgggtcgctcgcacatttccagtggctcagttggatcgccatcgctgtcatcgtgatcggcgtgctgcgtggcctgtccaagaacgtcgatgcccgccgcaaggagaacgaggcctttgtcgccgcgaccgcgaacgtccccggtctgggcaagttcgtcgccagcctgggcggcggcgttgcagcggccagcacctcacgcgcggccggcaccagtaaggaagactttgagcgcgccaagcgcacggctaagaagatgtggaagggtcgcaagaccacggcctacctcaagtgccccaactgcggccagatgctctccgtccccaagggcaagggcaagattcgcgtcacctgccccaagtgccacgccaagatggaaacccgctcctagccactgcgcgtgagacaaattaatcaggtttgtttattctaaatcttaagcatttgttcgataaaaagccgaggcctcgtgttgagaccccggctttttgcatgcggcaacagaatgtgacaaagggacagtccctttgtcacatcactgcgtcgcacgcttacgccacgccgtcgcgggcgagttcctcggccagtgcctcggcaggcatggccatgatcgcgtcgagctcggtgtcaacctcggaaatgtgcttgaccttcagcttgcgcaccagctcgccgcggcacatcacgtgcatcggctcgcgcagggccgccaggtcatccagaggattctcgcgcgccaccaggatatcggccgccttgccgcactcgatcgtgccggtctcgtcgcccaggcccagcagctcggcattgacctgcgtggccgtgtgcagcgcaaaggcattgctcacgccgacgtacttggcaaagtacgccacctcgcgccacatgtcgtactgcgtcacgaacgggcagctcgagtccgtgcccaggcccaccttaacgccagcttccagtgcggcgcgggcgctctcgacaatgcccgagcacacgatgtcaccgttcttcttttgcgtatcggtcgaatgggtcttctccggatcgagcagtacaaacggcaacgccggactgatcgtgcaggtcacgctcggtgcgcgcccctcgagctgcgtacccgcggcgccgcgatacaggtccaagatctcgggcgtcatcggagcgccatgctcgatcgtgtcgacgccggcctgaagcgcggcctttacgccctcagtgctctcgacatgggccataaccggaaggccaacctcgtgtgccgctttgcacgccgccgcggcgacatcgaccggcatgcgcagcacgccaggctctcccacttcggtcgcatcgaacacgccgcccgtcacgaacaacttgatgacgtcggcaccgcgcgcatacaggtcgcgtacctgctcggctgcctcggcgggactattggctacctgcgcgaacaagcctgcgccatgaccgcccggcaccgtgacgcccgtgcccggcgcgacaagacgcggaccctgatacttgccggcgtcgatggcgttgcgcacggcgatgtcggcaaacagcggatcgcccgcaccgcgtaccgtggtcacgccgcttgccagctgctgctgggcactgcccttgaggatatggcggacgatggcgcggcccacgggattatcgagctttttcatgagcgatcctgcatcgcctgccgagaccggcttgcccgagccgcacagatgcacgtgcatattgatgaggcccggcatgaggtacgcaccggccaggtcgataacctcggcacccgcaggcgcctgcgccacggcactcgggccagtccaggtgatgacaccatgctcaacggccacggccatatcgggctgcggctccatatgctccaagccatccagaatagtcgcattgataaacaacgtgggacgatcggcagtcgccatatcgggctcctccccctcaattaacatgaacatttgttcattatcacctagtccagcagggttgctgcagacatatcggctaacggagaaaggaggggaatatgagggaggacgggagtcgatgcagcccttccccagcggtgcctacaaaacatctcaatctgtaacagaagaaccgtctttgagcctccagatgttacagaacaagatctttcggtcgcatacccaccctttatctcaatctgtaacagatagaccggttttcagcagctagatgttacagattgagacattcggtcgaggccgcacttgttcatctcaatctgtaacaattacgggcccaaacagccccaagatgttacagaccgagacaaaccctctcagcgcccataccactgacgcttccattccttagccagatccgcctgttgcggaatacccgccagcctcatcttctcgaccagcttccccgggtctttgagttcgttaaacgtaaaccgaagcaccttatgcccgagcattgtcagatgggactcccgttgacgttctgccacgaatgggtcgaccgactcccggccctcgccgttctgcaaggtgtacttcccctttccgtcgagctcgccgatgacacacgtcccgttctcgagccgccaaaaatagtcgacgcgaaacacctggctcggatcgagcgggtcgcgaaactccacctgcagctccggaaccggaaaaccgtacgcaataaagaacgctcggaaccgagactcgccgccgttttcggacagcccgtccgcatacgacgcaatcacctgtgccctgcgataccctcgcctgccctcgcaatcggcgcggaggcgctcgcacaaacccccacgtgatacgcctttcgcccgcagtgcagaatcggcaatcgccaacccgtaggaaaacggcgcacgcagcagacaatcctccaccgtgcgccaaaacggcgtcactcgcacgccgtcgacgcgctcaagcgcacccgccatctgtggacgcaacaacctgcacccgctgctcaacgtcaccgaacagcaagtcttaacaaggaaacgcggcccgagcagatcattcggcacctccagaccccacaaaagcgccgcgtcatagccccaaaacgcccaatcgggatgaaattccgcaagccctctgatagtcctcagtgctcgctccgctggcgtcaatgcatcccaatcatgctgaaaacagaacaggtacggctcgggttccgcgatatcgtcggttccaacatggcgccgcagccacatgagctcggtattgtcatgcgttgcgagcagcgcaccttgcttggccgtctccgtgagccgcgcgagcatcctattccgcgccaacgtgttgcgagtcgcatgtttgtgtttgagaacggtattagacactttcatcaccaccacgtcagacaaatggaccatcgccgctgttgcctccgctggcaaatgtcttgatctgtaacaggaagacaatctttgagcctctagttgttacagaacaagatctttcggcagccgccaaccttccgtctcaatctgtaacagcaaggtcgacttttagcctgtagatgttacagatcgagacattcccccaaccaggtgccaaacgtctcgatctgtaacagttagacgttctccagggccctaaacgttacagatttagacaaatcagcagcgcccaagcattcgtctcgatctgtaacaggtagaccggttttttgtccctaaacgttacagatcgagacaaatagacacgcggcggcgctgcgacagcccatcccctactcccactcctgctcgtagatgttgagggactttacgtagcgcccctgggcgcccatgatgtcgcggaccagacgcaagaagaaactgatgcacgaggtgtcaaagccatcctgcaggtcctccggatgcaccgcaccaggcccatcgaccgccgtgtcactcaggcgtgcgatgtcatacagatagagttgtcccgccgtcagccagacatcgtcgacgcaggcgaggcgcaccgcaatcgctccgtcgctccaatgctccttttgcacgatatgcggatcgtagacatcaaagcgacggtcggtgcgcgtgtccttcagcacgaccatgccggacgcaggattcttgtccaaaatgccaaagcgcgagaaatactgcgtgtcgcgtacctgctcgagccgcttgagcgaggcaggcgaaagcgatgccggcggctcgtcaacatatagctcgagcagcgttttgccatggcgataggggcgctcaaacagcagccaatcggtaaacgccatgttgtaggccatgatttcgttttgagaaggttcctcgcaatagctgagccacgggtcgacgataatctcgaactgctcgcgcgccggctccaggaattgaaacttccgcagcatccaaaaatgggccatgtcggcaatatcgttgccgacggcttcagccagctctgctcggtcaaaagcgtggtcagtcatggcatcctcctcaaactgatggatctcaatttgagcttacgaggagggtgggcagccatgaccagcacgggcaaaataggcctccgactgcaaaccagatgctgaccaaacacttgacgaaaagcttgaccgaaaatgcgcaccgcaacaaaaccgcaggtaaacatagacggccaacccgcccttttgagccaaatgcccgcagccaccacagaaacaacagttgaccacagcccaagaagtcgacaaatgaacacccgtacgtcgacaaacaagcaaatcactcgcaaatccgcaaggagtgtccccgaatgccgacagaaaaggaacgtccccaactgccggcacttagggacgttccttttgtgccggcagtttgggacagcccttgccgattcgattgttgagtatctccgtgactactttacagctccagcgcctgggcgacctcggctgcgcaggccagggcatcggccatggcactcaccacgagcgagctgccgttgcgggcgtcgccggccacatacaccggcgtggcatcggcggcgacaccgtccgtgcgagccgcgaggtgcgagccctcgacagccatcacgggcagcggacggccagcggtggcgacaggcacgcgaacagcgtcgaacacgccatgctcgggaccggtaaagccgcaggcgatgagcaccagctgcgccggcacctcgtgctcggagcctacaatgcgctctggctttcctgccgaccagtccagatcgaccacgcgcagacccgcggccgcacccttcttgtccaacagcacctcgagcgtatccacgccccaggcacgcatctcgccgcccatcgcggcgatagcctcctgctggccgtagtcggtcttcttcacgttgggccactgtggccaagggttactcgctgtgcgcttatcgggcgccgccggcaagaactcaaactggcgcacgctgcgcgcaccttggcgcaccgcggtacccacgcagtcgttgccggtatcaccgccgccaatgaccacgacatccagaccgcgcgcgtcaatggcgggctcgccgccgtcgagcaccgagacggtcgatgccgtcaggtagtccacggcgtataccacacccggggcatcgatgttcgcagccgaaagcccacgcggggcacgggcgccggcagccaccacgacggcgtcaaagtcgtcgagcttggcggcaaccttaggatcgctcacgtcggcgttcagctcaaacacaatgcccagctcacgcatgagcgccacgcggcgctcgaccacggacttctcgagcttcatgttgggaataccgtacatgagcaggccacccggtcggtcgtcgcgctcaaacaccgtcacgcgggccccgcggcgagcgagctcccacgcggccaccagaccggcagggccggagcccaccacggcaaccgtgggcgcgccctcccccgccggctcaaagcggcgcgggccgccgttggcccactcgtggtcgctgatcgcacgctcgttatcgtgaatcgtcgtgggctggccgtcgaccgagcccaagttgcacgcggcctcgcacagcgccgggcacacgcggctcgtgaactcgggcatgggtgaggtgagcgacagacgctcggccgcctcgtcccagcggccacgatacaccagctcgttccactcgggaatcaggttgtgcagcgggcagccactcgggcgcgccttgccaaagctcgcgcccatctggcaaaacgccacgccgcacatcatgcagcggctcgcctgagcacggcgcgcgtcgtcgtcgagctccacgtacagcggatcgaaatcgcgtctgcgctcctccacggggcgcagctcgtgggtcacgcgatcgatatcaagaaaagcaccgggcttacccatggcacttacgcctccttcttggtcgaagcaacagagctggcagccacggacgcagcacccgcaacatcgaagcgagcaacatccgcggcactcgcgcggccggtcacaatgtcaaacgccagctcctcggcctgcgcatgcgtcttgccgacggcctcggcggcggcgacaatcgccagcacgcgctcgtactcggtcggaatgaccttcacaaagtgcttgctcatcgtctcaaagctgtagagcaacttaatgccgcgcgggctctgcgtcgcgtccacgtgctcctggataagcttgcggatctgcaccagctcgtcggccgtcggggccttgagctcaacgctctcgtggttcacacgggcatcgagcgtgccgtactggtcaaagacataagccacgccacccgtcatgccggcagcgaagttctgcccgacctcgcccaggatgagcgccaggccacccgtcatgtactcgcaaccgtggttgccgcaaccctcgaccaccacggtggcaccggagttgcgtacgccaaagcgctggccggccagaccgttaatgaagccgcggccgctcgtagcgccaaagaacgcaacattgcccacgatgatgttctcgtcgaacttgtaggtcgcatgcgggttggggcgcaccgacacctcgccgcccgaaaggcccttgccaaagtagtcgttggcgtcaccgcacacgttgagcgtaatgccgcgtggcaggaacgcgccaaagctctgaccggccgaaccatcgcaatcgatggtgatggagccggcgggcaagccctcgggatgcgccttggtcaccgcgttgcccaggatggtgcccacgcaacggttgacgttggcgatatcggcgcggaagcgaatcgggcgcaggtgcgcgcgagcgtcggccgtgtagggcacaaacagcgtggagtcgagcgtcttgtcgagctcgctgtccgcggccatctggggcaggaagtgacggccgtcggcacccgggatgtgggcaccgaactcgcaggtcgcgcttgccagcacgggcgtcagatcgagcaggttagccttgcggttgcccgggacctcgatctggcgcaagcactcgggatggccgaccatctcgtcgacggtgcggaagcccaggctcgccatgacctcgcgcagttgctcggcaacaaagagcataaagtgctcgacgtgctcgggcttgccgcggaagccgcgacgcaggcggcagttttgcgtagcgatgccggccgggcaggtgtcctgctggcagtcgcgctgcatgaggcaacccatggagatgagcggcatggtcgcaaagccaaactcctcggcgcccagcaagcaggcgacggcaacgtcggtgccgtccatgagcttgccgtcggcctcgagcaccacgcgcgagcgcaggccgttttgcagcagcgtctgctgggcctcggcaaggccaagctccagcggcagacccgcatgccagatagagtcgcgcgcagcggcacccgagccgccattgtgaccgctgatcaagatcttgtcggcagcacccttggccacaccggtggcgatggtgccgacgccggcctcactgaccagcttgaccgacacgcgtgcgccggggttggcgttcttaaggtcgaagatgagctcggccaggtcctcgatagagtagatgtcgtggtgcggcggaggcgagatcaggccgatgccgggcgtggactgacggacctcggcgatccaggggtagaccttcttgccgggtaggtggccgccctcgccgggcttggcgccctgagccatcttgatctgaatctcgaaggcgctgcaaagatagcggctcgtcacgccaaagcgcgcacttgccacctgcttgattgcggagttcttggagtcgccgttggccaacggggtctcgcgacgtggatcctcgccgccctcgccggagttggagcggccgtgcaggcggttcatggcgatggccatgcactcgtgtgcctctttgctgatggaaccatacgacatggcgccggtgttaaagcggcggacgatgttgagcgcgggctccacctcgtcgagcgaaaccggcgtgcggccgctggcattaaagtcgagcaagtcgcgcaggcgcacggcacggccggtgcggtgcagacgggcgctgtactccttaaaggtgtcgtagctgtcctcgcggcaggcggtctgcagcaggtagacggtctgggggtcgatgaggtgttcctcgccgccgagcgggcgccacttggtcaggcccagcgtgggcagctgatcgggagccgggctcttaaggatagcgagcgcggcgtcgtagcgctcgttttgctcgcgctcaacgtcctcgacacccataccgcccacacggctcaccgtgccggcgaagtacgcgttgacgaactccggcgtaaagcccacggcctcgaagatctgcgccgaatggtagctctgcaccgtggagatgcccatcttggacatgatggagacgatgccggcagtcgcagccttgttgtagttggcgatgccctgctcgaccgtcacgtccagatcgccgcgcgccgccaagtcgcgaatgcacgcatgcgcgttgtacggatagatgccgctcgcggagtagcccaccagcgccgcaaagtcgtgcggagacacggcatcgccgcactccaccacgatatcggcaaaggtgcgcacgccggcgcggatcaggtggttgtgcacgcagcccacggcgagcagcgatggcacgggtacctcacccgcagcggcacgatcgctcaacaccacgatgttcacgccgtcgcggaccgcagcctcaacgtcctcggcaagctgcttgagcgcagcctgcagcgcgccctcgccggcgtcgcggcggtagacggcacggaagcgacgggtcttaaagcccacgcggtcgatggcgcagatacgctcgaactcctcctcgttgagcagcgggcgctccaagcgcaccagctggcaggccgtgcgggaatcctcgagcaggttgccgtggttgcccaggtagagcgtggtcgaagtcaccatgtgctcgcgcagggcatcaatcggcggattcgtaacctgggcgaacagctgatagaagtaatcgaagaacgaacgcgtcttcttggacaggcaggccagcggcgcgtcgatgcccatcgaggcaagcggcgccttgccctgctgggccatgggacgcacgacctcgtcgacatcatcccagtggtagccgagctttgccatacgcacggcggcgggcacctcggcatcctcggcaggcgttgccgcaacgggctcatcgagcgcgtcaacggtcagcgtctcctcggcaatccagtcgcggtagggcttttccttggcatagcgggcgcgcagctcatcgttgtagatcacgcggccgcgggcaaaatcgacctcgagcatctggcccggtcccagacagccgctcgtcaggatgttctcggggctcacctcgatggtgcccacctcgcttgccagcataaagcgaccgtcgcgcgtcacatagtagcgggcgggacgcaggccgttacggtcgagggcggcgcccagggtacggccatcggtaaaggcgatagcggcaggaccgtcccacgactccatgagcatggactggtaagcgtcgtaggcgcggcgctcctcactcaggctgtcgttgtggtcccacggctcgggcagcaacatggacgcggcacgcgtaagcgggcgaccgttcatgaccaaaaactcaagcacgttgtccaaaatcgccgagtcggaaccctcgcggttgatgatgggcatcacgcgctcaagatcgtgctgtaacacggggctgtacaggttgggttcgcgggcgcgaatccagttgacgttgcccttaagggtgttgatctcgccgttgtggatgataaagcggttgggatgcgcgcgctcccagctgggcgtggtgttggtggagtagcgcgagtggacgagcgccaccgccgtcttgacggcggcgtcgttgaggtcgatgaagaagcggcgcatctgtgtggcgaccagcatgcccttgtacacgatggtgcgcgagctcatggagcacacatagaagatcttgtcgcgcagggcaaactcggcatcggccttcttctcgatagtgcgacggcacacgtacaggcggcgctcgaaggcgtcacccgccggcgtatcgtcggggcggcccagaaaggcttgcagaatggtgggcatgcaggcgcgggccgtctcgcccaggtcgtgcgggtcgaccggcacctcgcgccaaaagagcagcggcacgccggcctcggcacagccttcctcaaacacgcggcgggcatcctctacgcccttgtcgtcctgcggaaagaacagcatggccacgccatagtcgccctctgccggcagaatctggccgcacttttgagcctctttacggaaaaagtgatgcggaacctggaacaggatgccggcaccgtcgccggtgttcttctcgagtcccgtgccgccgcggtgctccaagttgaccagaatggacagagcgtcgtccagaatctggtgatgacgctcgccgttgatatcggcaagcgcgccgatgccacacgcatcgtggtcgaattcggggcgataaaggccctgctgctgagcggaatctgcctgcatcgcgatcctcccctagatttttagacagtcagttgaataggcatactagaagcatcgccggcccgttgtgtttcccacccgtttcgaaacaatcgcgtaacgcacgcaacaaatggtctcccgggaacggcagggctgcgtattgtctcgatctgtaacacgaggagcccatttggacgtctaactgttacagattgagattttctgcaggacgggtgtcgtttgtctaaatctgtggtagcgcgcagagatgtggtgtaagaggcggggcatgccccgcctcttctctttaacccgcgaccccaaccttggcaaggttgtgctctaccaactgagccatgtccgcttgcgggttattaatttacgcgagttgcccaaaagacgcaagtacttttttcaaaaaagttgctcaatgcaagttcgcgcaggtaaataacgccaagtcaaggcgctatgcgcacaattccaatgctgagccaaacagcttcaccatccgaacgcgcgtgccggcgccatccgtacgacgggcaacttccacattatcgacgagcatgcgcataagcttgataccgcgtccgcgttcctcagatgcaaccggctcgctcgccccatcgatagaatagccagcgccccgatcaagcacctcgagcacaacgcggtccccataggcctgaaccgtcaggatgcagccaacaccgcccgcatggtcatatgcgttacccaatgcctcccccaacgccaatgctacgtcataacgttcatcacgcctcaggggaagtgattcgagaagctcggccacacggtgccgataatgcgggagattctcgatgcctcgttgcacttcgacactcttgctccatcgcggcaactctcccaccggaatggcgggaatcgactcacgcgccgggcccgcgacatgcaggatgtcgacaagtcgggcaatttccaaaaagcgaacgacctcatcggaggcgttaacgagcgaaagcaggccctctcgcctcatgagctctctggcgcgcgtaagcaaaaacgccaaacccgtcgagtcgataaagcccacggcctggcaattgatgacaacgcggcgcacgccccggtcgatcaaattatccaaccgtcggcgcagcacgggcaccgaggcgatgtcgacatcacccggtggcgtcaaaaccgctatgtcattccactcattcatacgaccatggttccccaaaagagctcgctcgatgcatacgtatctgcaaccgcgcagattttgcccgtcaaacgtcgcggcctacgatcgaccccgtaaaaattcaagggaaaccagcgcgatgtcatcgtccagcgccgactcggtaaagcggtcaagctcgcccaagaccttaccgcagattcccgatacgccttcacccgaaacggagagcagaagatcgcgcaggcgttgctcgccaaagaacgccccggagcgatcgcgcgcctcaatcgttccgtctgtatacataaacagcatgtcgccaggagcgaacataaaggcacctgtctcgtacaccatgctttcaaaggcaccgatcacgcccgattggcacccaaggagctccacttctccgcctcgggcttcaccgccaccaagcggcgtcgacgacggcctaatgaccatagtgggaggatgccccgcagagcaataggttgcgcgacccgctttaagatcgatcttggcgataaacgccgtcacaaacgtctcgaccctcgaaaagcccatgagcatgctattgagcgagcgtgccatacgggcaggccccgcaccctcccaggcataggccgtcagcgctgtcttgacgagcgccgacatcgacgccgcctcgattcccttgccggatacatcgcccaaaatcataacggcgcaatcgtcgggaagtcggacaagcgtatagaagtcaccgccgaccaacgcagaattcgttgccgataggtataccgaatcggttgcaatgcccggaacgtcaccaagcgaatttctcatgccaatctgaagcgtctgagcgatatgacgctcttcgcgcttttgagactcgccttcatagatcagctcaaagtcatgcgccagatgcaccaggtagtcgtattcaaggtcgtcaattggttcttggctgccatcgcggagcagcaatgcgcgcgtcgtcggtcccttggcaacgtcggcgggaacgattgcatcgttgttccgccgaccgccgccctccgaacgaacgcgtcccgcctcgaagccggaatcgacatagaggccctggcacggcaggccatgagccctcaaccatccgcccataggcatggattcgtcgacgcgggtcaagcgcacatgcttaagatcatcagcactcgcaccgcccagcaccgacggctcaaaaccatcggaagcgacccccaaacgcgcagccggtgcggtggtggaaaagaagagcgactccggatcgcccggcaacgccacacgactgccgccctcaaaatcgatgacataggcgtcaagactcgcgtcatattccacggggcagaaatgacaattgagcaccgcgcagatttccgtcgacaccgctcgcgaagcggcaacaggatcatcgagataggtaaacagttcgtcgcgcagcaaattgagtgagcgaccgagctccgccgtgcggcgcgaacgtaagctcgacgccatgccgaccagctgaatagacaggtaatcgcaaatgacctcgagcacgttaacgtcataggcaagtggcgcctgggggcgtttccagccaacttccaacacgccaaggacctgcgtgccgtaaaacacgggaagacagatctcgctgcgatacgggggcatatcctgcacgcgcagcaagtgcttggaacgattgtccaaatccatgaacatacccgaagcaacccggtcgccctcaaggtcctgctgaatcgacaggcgacaggcacgcgactcgcgaagcacgtaggtcggaatgcccgcgccgtacggcagaaattcgggcagatagctgtcctcaagctccttagaaacaccgcggagcttaaagccgccgctctcggaaaaatagatagccgcaccggaggcatcgagcgttccaacgagctgattcaaaacggtatcgagcaagctggggagctcatcggagcccacggtactcataatgaccgaaagggtacccgaaaggcgtttattcgccaccctaagctccgatagcgcacgtttgagctgacgatcgtgggaatactgctcttcgatgctgtgaagcgccaccaggacacgcggtgcacgacgtccaaagatacgcggaggcgtaacggaacctgcgcgaaccaagacgggaataaaagacccgtcgctcagcttgagcatcagctcgctctcggagccatcggtctcaaacggcagacgatgttcggtcgcgcgctcaaaggcagacgagtacagaacgtctttgacatcaccgctgatgacgtcagcgcgttcctcgcacatcaggtctagcaaacgattattcacatgcagaatggttccgtcgagctcacagatgatgacagcatcgctcgtgatctcgaccagttgggcaacgtctgcccactcgttgcgctcaagcgtttccatcgtggacctcaccgtctatcggtaacaaaaaagcctccgaagaggcttctcaaatgcgatggtgtcggaggcgggacttgaacccgcatgaccaaaaagcggtcactagcacctcaagctagcgcgtctgccaattccgccactccgacatgctatgttgttgattcgcggttcgttttgttggacccgcgcgttcaacgaggaagataataacctatgattcgagaactgtgcaagcacttttttgaaaaaagtttacgaatttgtaaatgcgcaggtagacggacctgttcgggccggaatgaggttgctttccaacgcgtcctcgggcatgcggcattattttgatccgcgcttcgcgctacaaaataatgccgccccctgcggaatgcgttggaaagcaacctcattccggccctaggagtaggtactccgggcacagttctcaaacatgttctggaggctgatgcaaatttagtggctcggctttgccgagcccttatataaggaggccggagctagagctccggcctcacacaatttcaaattagattaagtgagcgatcagggaatcgcaccccccccctgcagtggtaacacagggcccgtgttggacttagttttcagaacattccgcagaccaggaaacccccttatccgcagctccgaaggagcaggataagggggtttccatggtcgaggacgttctgaaaactaagtccagcacgggcccggacaaacaaccgactacaggtcgatgtgcgattccttgatcgggaacggctccgcgaagtgacaggcgcagcagtggcccggggcgacttccttaaactcaggcagcttctcggagcagatgccctgcgcgatcgggcagcgcgtgtggaaacggcagccggtcggcggatccagcggtgacggcggatcgccggcgaggataatgcgcttgcgggtcttctggatatcaggatcgggcaccggcacggcagacagcagcgactgcgtgtacggatggtgaggctcgctgtagagcgtcttccagtccgaaacctcgaccatcttgcccagatacataacggcaacgcgatcagaaatgtgctgcacgacggagaggtcgtgagcaatgaagagataagcagtaccgaacttatcctgaagctccttcagcaggttcaaaacctgggcctgaatggaaacgtcaagtgcagagacaggctcgtcgcagatgatcagcttgggcttcagagcgaacgcgcgggcaatgccgacacgctgacgctgaccgcccgagaactcgtgcggatagcggttgatgtgctcggggttcagaccgacgacgtccagcagctcgcggacgcgctcgatacgctcctccttggtacctacgccgtgaatggtcatgggctcggagacgatctcgccgatggtcatacgagggttcagcgaagcataaggatcctggaagataaactgcatctcgcgacgcatgtccttgatctcatgcttgctcatctcggcaacatctttgccctggaagaacaccttaccggcggtcggcttggtcaagcgcatgatggtgcgacccgtcgtggacttaccgcaaccagactcaccaaccagaccaaaggtctcgccaggataaatctcaaaagagatgtcatttacagcagagacgacacgcttggaaaaacgcttggcgaacatgccggactcagcggggaactccttagagaggtgctcgaccttcagcaacggagtacgctcgttggtatctgccattacgcctcgcctcccttcttggaatccttgcgcgtacgggatgtctcaggagcgttcttgagaaactcggggtcaccggagtagtggcatgcagagtaatgaccagactcggtgacaacgcgctcggggcgctgcttgcggcacttatcggtcgcatagggacaacgaggcgagaacacgcagccctcgggcaggttcatgagcgaaggcgggttgccgtgaatcggcgtaagcggcttcttctcttcgatggcctgctccgggatggagcggataaggccccaggtgtaggggtggcggctctcgtagaagatttcctcagcagtaccgaactcgacgggacgaccggcgtacataaccatgatcttatcggccatgtcggcgacgacgcccaggtcatgggtaatcatgatgatggcgttgccgttcttctcctgcatttcctgcataagctcaataatctgagcctggatggtaacgtccagagccgtcgtgggctcgtcggcaatcagaatatcgggatcgcaggcaagagccatagcaatcatgacgcgctgacgcataccgccagagaactggtgcggatactcattgacgcgcttctcgggctcgggaatgccaacgaggtccaaaagctcggtggcgcgcttgagcgcctcctgcttggagtagccacggtgcagacgaaggccctcgcccacctgcttgccgatcttatagaccgggttcaaggaggtcataggatcctggaagatcatcgcgatatcgttgccgcgaatgtgctgcatctcttcctcggtcatctcgaggatggagcggccgcgatagcgaacgtcaccgccctcgatctttcccggaggcatcgagataagacccatgatggtcatggcggtcacggacttaccggagccggactcaccgacgacgcccagggtctcgccgcgatcgagcgtgtaggagacaccgtcgacagcgcgaacaacgccatcctcggtgtggaaatacatcttaaggtcatcgacctcgagcagatgctggccctcgggaaccggctggtccttcaggtccacatagttcttgttcttcttcatccttatgcgtccttcatcttgacgtcgagggcgtcgcgcagaccgtcacccagcagggtgaaggcgagcaccgtcgagagaattgccagaccgggcatgatcatcatccagggagcagtcagaagatactgctgaccgtcctgaatcatggagccccacgaaggcgtaggcggaataacgcccatgccgaggaaggacagagcggactcggtcagaatggcgccaccaatgttcatggttgcgtagaccacgatagaggcgacggagttcgggaaaatgtgacgcacgacgatacgagcatcggatgcacccatcgcgcgcgcagcgtcaacatagtcgttttccttgaccgtcaggatcgcggatcggaagacgcgcgcaatagaaggccagccgagaataccgatggcgataaagacattctgaagaccacggccgataacggcgatcatggcgacgacgaacagcacgtacgggaacgctaggaagatatccgcaaagcgcatgatgatcgtatcccagattccaccgtagaaaccggccagagcacccatgaccagaccgatcaccgtggagatggcggtggccataatgccgacggacagcgaaacgcgtgcaccgtagataacgcggacgagaatgtcgcgaccaagggcgtcggtgccaaacggatgctcggcacacggagccagcaacgaagtctcggccatggtagtcgagtcggaagccgtcggcgacccgagccagggcttagcccacaggtcggcggtcagggcaaccacaacgacgatgatgatccagcaaacaccgataacggcgagcttgttcttacgaagacgcttaaaagcgtcgccccacagcgtgcgggacttagcgggagcagatgcggccttagtggcggtagcctgcccctgagactgagaatcagtttcctgcatgagacgtacctcccttaggccttatccgacggaccgccaaggcggatgcgcgggtcgaggaatgcatagctaatgtcgacgagcaggttgatcaccataacgacgacaacgatgagcgtaacgccgcccataacgatgggccagtcacgcatgctgatggcgcggtagacctcagagccgataccgggccagttaaagaccgtctcggtcaggatggcgcccgaaagcatgccaccgaagtcgacaccaatataggtaacgacggggatgagtgcattcttaagcgcatgcttgacgatgatcgcgcgattggagagacccttagcctttgccgtgcggatgtaatcctggttcatgacatcgagcagctgcgagcgcatgatgcgggcagcataggcggtcgaaaccgaagccagcgtaatggtcggaagcacatagtgcatccaatcctgatactgagagctggaaccgccggcacccgagatcggcatggagaatgcaccgcccgtggcgtccttgaggatgacgccaaagaacagctgcagcagcataccgagccagaaggcaggaacggcaacgaggatcgacgtggtcagcgttaccaaaatatcccagaaggagtaacgctttactgccgaaatgatacccgcaccgatacccatgattgcctcgagcacgatagcgcacgcggcgagtttaaccgtatacggatacttctgagcaaagatttccgcaaccggcagcttgcgctgatacgaattgcccagatcgccatgaagcaggccattcatgtaattcaagtattggtccacaagcgacgttggaacgggatcgccgttctcgtcaaggatcgcgttgccgtcctcgtccgcctggaccaggtgatagcgcacgcgaagttgaagctccacctcgggggacagagccttgtctccaccgatcagcttgatcggatctcccggcacgatgttctggagggcgaacagaatcagcgtaacgcccaaaaacaccgggatgaactgaagcacacgtttaacgatgtacttacccataccactcccctatctagggattaacctaaatgggatgccgatcgccagaccggcatcccaaaattaccatcagccagtttaccccaggttagggagaactgtatgtttcccatgaggtctacgtaaatacttgaccctcacggaagctgcaaactcttaggcgagctcagcggtacccagctcggcatgcttctgcggatcgacatagaggtgcttgatgcgatcggagccggcgatggtgtgcgtgtagaacatcaccgggatgaccgggcagtcggcagcgacaattgcgtcggcctcctgcatcttagcgacacgctcctcgtcgtcaaccgtagtgcgagcctcgttgaccttggcgtcgaactcggggttgttgtaaccagagcggttgtcgccaccgagggagtcggagtggaacagcggatacaggaagttgtccatgatcgggtagtcggcaatccagcccagacgaccgaactgatagttgaagttctggtactgctcgagcagcgcagaccactcaggagtatcggagacggcggtaacgccgaccttggcgaggtcgccgatgatggactccataatctccttgtggccaccgtcctggttgtaggaaagggtcacgttaatgccacgatcgccgttagcgccagcgggagcaaccttgtcgaggtactcgttggccttatcgacgtcgtaggcgcagaactcccatgcgccctccttgtagccatcgatgcccggaggaacaatgccgtcggcgggggtacgggtacccttgaagatggtcttgcagatggcctcacggttaatggccagggagatacccctgcgcaggtcggcgttgttgaacggctcggccgtggtgttgcaggtcaggtagtaggtggaaggctcggcgccgagcagcatgcgctcgccgtcgcccatagtgtagccgtccttggacacgccgcgatccttcttggcagcgtcgatctgagcaacgggaacgtcgcagatgtcaaggttaccggcctggaactccttgtaggcggtctccacgtccttgatgacctggaagtggatgccatcgatcttggccttgtcgccatagtaatcgtcgaacttcttgaggttgatctcctgaccatcctcccacttgccgtccatcatgaacgggccgttaccgaccggtgcaagatagaagctcttggcatcggactcggcgcactcgggaaccggggccagagccgggtgagaggcgacgaaggggaagtcggcgtaagcggaagacagcttaacgacgagggtctcatcgtcggggcaggtaacaccgctgagctcggtggcgttaccggcaagcaggtcgtcatagccctcgaccatggaaaggtgataggagacctcggaagggccgtactcggtagcgatggccgacttggtgttgaccagacgctcccaaccgagcttgaaggacttggaggtaacgtcgtcaccgttgtggaacttggccttcttgatcttgaaggtgaactcggtggcgtcgtcgttggcctcgaaggactcgcaagccagcggaacgatctcgcccttctcggcgtcataggcggtcagagcgtcaaagagctggtactcgacctgagtgccctggtcctcctggacattgtaggggtcgatgcagaccgggttgttgatgtagaagttcagcgtcgaaccggactcagaaccggaagcgtcgccacccttcttgccgcatgcggcaagaaaagccatggagctcgcagcaagggtgccgccaacaaaggcgcgacgacccataacgggctggtggaacatagaatcagccatgccatcctccttatgagataggacaaagaaatgttcagtcggacacatgtcgaaacaatccgatccgaaccatcaaaacgccgtccgctgctatggctggttatgcacaacggaccaacgttttgcaatacagtagcgcattttatacacaatttggggctaattccggttaacggtcgagaatttctttagttgggcgaagtatgtgaggatattttgactctgttacaaatatgtaaacaaaaagggtcccgcacttacgggaccctttttgaatatttatgcggctcgtgcttagtagccgacgatgccctgcgggaagaagaacatgcacagcacgacgcacacggcaaacacgacagccatgatgacggtcaggcggtcgaggttctgctccatgacgcccgtggcagagctggaattatacagcgagctagcgatcatatccgaaacgccggtgcccttaccggaatgcatcaggacgagaatcgtcagcgccacggcagagacagcccaaacgacaaacagaagaatctggaacggacccatagataagctccttaatagaagagtttaaactccagtactgtaccacaatcccccgctctcccctacctgccactcaaggacggggtggaaatggcagaaataccaaaaagggggttgtccggttgtggacaacccccttactagaaaacggtatttgttttctcttaggcctcggtggcgagcacgcgacccgtcatctcggcggaaggctcaataccagccatggtgagcatggtcggagcgatatcggaaagacggccgtcctcgataccggtgagcttggccttctcatcaacgatgatgaacggcacacggttggtggtgtgagccgtgaacggatgcttggaaccgtcggaagcaacgtcaaacatgtggtcggcgttgccgtggtcggcggtgatcagcgcaaagccacccttggcgagaatcgccgggacaaccttggacaaggcatcgtcaacagcctcgacggccttaacggcggcgtcgaagacaccggtgtgaccaaccatgtcgcagttcgcgaagttcacgatgtagaaatcagcgcgatcctcgttaatagcggcgacgagcttctcggtaacctcgggagcgctcatctcaggctgcagatcgtaggtagcgaccttgggggaagcgacgagcacgcgctcctcgccctccttgggctcctcgatgccaccgttgaggaagaacgtcacgtgggcgtacttctcggtctcggcggtgtgcagctgcttcaggccgttggcggcgataacgtcggccaggacgttctcggggaacgtcttggggaaggcgacctcgacgtcaaacgtcggatcgtactcggtcatcgtcacaaagtgcgagagcttgatctgctcgcgctcaaagccgtcgaactccttgtccgtgaacacgcgggtcatctgacgggcgcggtcgggacggaagttgaagaagatggccgcgtcgccctcgtgaatgccctcgttatgggcagcgaagggctcgacgaactcgtcgccgcgcggatctttctcgtagtaggccttgataccggcaacggggtcggtatcggcatcggacgcattggccatgacgtcgtaggcgcgctggatgcgctcccaacggttgtcgcggtccatggcccaatagcggcccgagacggtggcaacgcgggcgtcgcaaccggtctcctcggagatcttggccaggaaggcacagaactcactcatgtagccggcgccggactgcgggtcgacgtcgcggccatccatgaaggcgtggacgcggacggtcttaacaccgcgctcggcagccatcttgaccagagcctcgacgtggttcatatgagaatgaacgccgccagggctcatgaggcccatgaggtggagggtcttgccgtcagccttgacgtcgtccatagccttgacgaaaacctcgttctcagcgatggagccgtccttgatggcattgttgatgcgcgaaagctcctggaacacgatgcggccggcaccgatgttgaggtgacctacctcggagttgcccatctggccatcgggaaggcccacgtcctcgcccgaagcgccgagcgtggtgtgggggcacttctcgtacaggctatcaaggaagggcgtcttggcagcggcgacggcgttctcgccgtcggccggggccaggccgcagccgtccatgatgatcaggagtgcaggaagatgacgctgtgccatatgtcctactcgcctgccttgacgaccatagaggcgaagtcggcagccttgagcgaagcgccgcccacgagtgcgccgtcaacgtcgggtttggcgacgagctcggcaatgttgccgggcttggcggaaccgccatacagcacacggatgccgtcggcgagctcctcgccgaacatctccttgagggtctcacggatagcgccgcagacctcctgagcgtcctcggcggtagcggtcttgccggtgccgatggcccagatgggctcgtaggcgacgacgacctgcttggggcaggtgatctcaagaccagcaaggccggccttgacctggttcacgacgtgctcgacataggtgccggcctcgcggacctcaagggactcgccgcagcagaagacgggaacaagaccggcggcaacgagggccttggccttcttgttctgatcctcatcggtctcgtggaagtaatcacgacgctcggagtgaccgatgatgcagtaggtgcagccagcggacttgagcatgtcgcaagaggactcaccggtgaaggcacccttggcctcccagtacacgttctgtgcaccgagggcgatgggggcagcctgaatgcggtcatgaaccgtggtgatgtcgatggtcggagggcagacgagcacctcgacgccagccggaacctcgggcagagcctgagccagctcgtcggcgagcttggcggcctcggcgacgtcgttgttcatcttccagttaccagcgataagaagggtgcgattaggcatcgagaagcgcctccactccgggcagggccttaccctcgacgagctccatggaagcgccaccaccggtggagatccagctcatcttgtcggccaggttgaacttgttgacagctgcgacagagtcgccaccgccgatgatcgaggtgcagtcggcctcggcgacagcctcggcgatagcctgggtgccgtgagcgaaattgtcgaactcgaagacgcccatggggccgttccagaacacggtcttggcgcccttgacggcctcggcgtaaagctcctcggtcttggggccgatgtccatgccctcacgatcgtcggggatagcgtcggaagcgacaacctcggggacagcgtcctcgccaaagtgatcggcaacacggttgtcgatgggaagcaggatcttgacgcccttctcctcggccttcttgagcatctcgccagcgcgctcgacccagtcctcttccttgagggactgaccaacggacaggccctgagccaggaagaaggtgtaggccatgccgccaccgatgatcagggtgtcagcggagtcgatgaggtgatcgagaacgccgatcttggaggaaaccttggaaccgccgacgatagcgacgaaggggcgctcgggctcggcgaagatgccggtcagcgtgtcgacctccttctcgagcaggaagcccgcgacggcaggcaggtaagcggcggggcccacgacggaaccctgggcgcggtgagcggtgccgaaggcatcgagaacgaagacgtcaccataggaagcgagcttcttggcgatctcgggatcgttcttcttctcacgcttgtcgaagcggacgttctcgagaacgagaaccttgcccggctcgacggcagcgacagcctcggcagccttctcgccgtaggtgtcggcgacaaaggcaacgtcgagaccagagagctcagcgagcttcttggcgacaggctcaagggagagctcaggctggaagccagtgccctcgggacggccgaggtggctcatgaggatgacgcgagcgttgtgctcaacgagatagttgatggtgggcagggcagccttgatacgggtggtgtcaccaacgacgccatccttgataggcacgttgaagtcaacgcggacgagaacgcgcttgccgtcgacatcgatgtcgcggacggtcttcttggtaaaggccatgtttgcttctacctttcgtacgtgtctgcctcccattacggcagacgatttcctataaaaagggcgcgaccctagggtgtaagccctataaggccgcgcccttctttagacgctcaacgagctattcgctaaaagctaaattaagcaacgaacttctcgaagtacttgatggtgcggaccatctgagaagtgtaggagttctcgttgtcgtaccaagaggtaacctgaacgagggtctggccgttgccgaggtcagagcacatggtctgagtggcgtcgaagatggagccgtgggtctcgccgatgatgtcggtggagacgatgtcgtcctcgttgtaaccgaaggtctcggagatggtggcagcgtaggccttcattgcggcgttgacctcgtcgacggtgaccttcttgtcaacgacagcgtagaggttggtgatggagccggtcggcgtcgggacgcgctgggcggcaccgatgagcttaccgttgagctcgggaagaaccaggccgatagccttggcagcaccggtggtgttggggacgatgttgacggcgcaggcgcggctacgacgcttgttgcccttgcgctgcgggccgtcgagcggcatctggtcgccagtccaggcgtgaatggtggtcatgatgccggacacgatgggagcgaagtcgttcagacccttggccatcggggcgaggcagttggtggtgcaggaagcagcggagatgatgttgtcctcagcggtcagcgtctcatggttgacgttgtacacgatggtaggcagatcgctgccagccggagcggagatgacgaccttcttggcgccagcgttgatgtgggcctgagccttagccttgctggtgtagaagccggtgcactcgagaacgacgtcgacgtcgaggtcgccccaaggcaggttgttggcgtcggcctccttgtagatcttgatctccttgccgtcaacggtgatggaatcctcgccagcaacgacctcgtgatcgcgagcatagttgccctgcgtggagtcgtacttcagcaggtaagcgagcatatcgggagaggtgaggtcgttgatagcgacgatctcggagccctcatgaccgaacatctgacggaaagccagacgaccgatgcgaccgaagccgttaatagcaacctttactgccattgtgtctcctttcgtaaggcccccgcaagctacagcgcctgccgttgaggcccacaaactaaccactcgcctaatataccttttttttgacttgaatttcacgagaatgctcgaaattgaaaatcaaatttacgttaaaacgttttaaagagtaaaacagcagttcaatccctatataagcagtttcgctcaactacctgtttgcttcaatgagcttttcaagcctcaaaacgcgatggtacagggcagacttcgacaagggagggtcagccatctcccccagatcgcgcagtgacagatcgggatagcgctcgcgcaggtcgcaaaagaccgccaaggcgtccggaagcgtgtcgcgcaaaccccgctgttcgagctcatcgatcaacgcaagctgatgctgggcggcacccgcacttctggtctgattggccagctcggcattcacgcgacggtttacgtcgttcttaaccaatttgaccgcgcgcgcttcctcgatctcggcaacgctgcgcttggcgccgaccagctttagaagctgctcgatctcctcggcgctcttaatgtagacagcaaaggatccgcgccgcgcgttaacgcgcgcatggactccaatctgctccaatagatcgcaaagtccccgggcatactgctcgccctgcaccgcgatctccaaatgaaagtcgccgcggggatcggccacgaaaccgccggcgatgagcgcgccgcggatgtaggcaagcctgcagcagggacgggcaacgatgtgccggggaacaccggcgacgagccctcccctgcggtcgaggatgcccagcagcaccagagccttgtccaggtcgggctgatcgggcagggtaatgagatagttacggaccttatgcaagaccgatttgcgaacggtaaattccgttttgagcttaaggatgcgatgtgtcagtgtgatcatcgtgcgcgcgacggcacccgtctcggtcgcgaccgtcaaacgataccgcccggagccggccagcgaaagtgtaccgctcacacgcgtcagggcggcaagcgtcgacaaatcgcagtattcacattcgggttcgcagcgcgcgagctcgtcacgcacctcggcggtaaacgacatgcaggcctatgctttcgtgttggcgcgcgacaggtcgcgatgggaaatgctcacgtgatactgggcgccttccaaataacgcgccgtggcctcggcgatggcaacgctgcggtgttgaccgcccgtgcaaccgatggcaatagaaagttgcggcttgccctctgcgatatagccgggcatgaccgtatcgagcagctgcgtccaggccttccagaactcctgggtcttgggatggtccagaacaaagtcggagactttcttatcgagaccggtcatggtacgcatctcgggatcgtagaacggattgggcaggaagcgaacgtcgatcataatgtccgcctcgacgggcatgccgtgcttaaagccaaacgagaacacgtgaacgtccatgagctgctggtcggacaactcggagaacgccatgcgcaatttgttgcgcagagcagaggtgcgcaggcggctcgtgtcgatgatcatatcggctcgatcgcgcacaccctgcagctgcaggcgctcgcgctgaatcgcatcggccgtagtctcccccggcttggcaatgggatggcggcggcggttttcgctataacgacggatcagcacctcgtcagaggcctcgagaaacacgatgtcacagctcatctcgcgctcctcgagcgcggcaacggcatcgagcagctcatcgaacaagccctggctgcgcaggtcgcaggtgacggcaagatgcctgcccacgcccgtattgatgccgacgagttcggcaagctgggcaatcagacgcggaggcaagttgtcgatgcaaaagtagcccatgtcctcgaacacatgcatggcctgcgttcggcccgatccggacattccggtgatgatgacgatatcggggatgcgctccgagcgctccgctgcatccatggcatctcccttttgcatgtgctgcctcctaaaaacaagcgcgggacccagcaacccggatcccgcgcggtcaattgcctttaatgagtataccgccctgagcggatacgaggtccgtcttacgcctcaagcgcggctttgaaccaactcgtaatactcgtggggtgcgtaatggcagtgcccacgacaactgcccaggcgcccgcatcaatcgcggcgcgggcctcctcgggcgtgtgcacgcggccctcgcagatgatgggaaggccgggaaattcctcggtcgcctggcgcaggagcggcagatcgggaccgtcggccatggtgcaatcgatagcggcaacaccatgagaaagcgtggtggacaccaggtcaaagcccatgtcgacagcacgacgaatatcctcgatggtggcacagtcggccatcaggagcacgccctcctcgtgcagcggacggaaggtgtcctcgacggtcttgccatcgggacgtgggcgatcagtggcatcaattgccacgatgtcggcaccggcggcaacgcaggcgcgagcatgacgcagcgtcggcgtgatgtagacgccctcgtgtccatctttccacaggccgatgacgggaacctcgcagcggcccttaatggcggcgatgtcggcaagaccctggcagcgaatagcggcggcgccaccaagctcgcaggcgcgagacatctgagccatggtctcgggcgtacgaagcggctcgcccatataggcctgaacgctcacgacgagcttgccctttagggactggatcaaaggatcaacggtcatgttcgactcaacctttctcaaaacagccttctgagacaccgcaccttgacgttcaaaccgtcgctcgcataccaaagtacgcttcgctcctctttcacgtcaatctgcggcacctcagaaggcgcacttggtagttatgtttacttcaacgacgcaagaaggtgttcggcggcaccgataagcggcgcgtcgccctccagagaaccgatgaggatcggcgtgtcctgaagcgggtcgagcgcctggctggcatagccctcgtgcaccgagtccttccacgtctgcgagcgccaatcgggaccctggtgaatcacacctcccgaaagcacgatgacctcgggatccaagatgttggcaagcgagcccaagctggcgcccagcgcaaagccggcgtcatggatgacctcggtcgcctttgcgtcgcccgcacggcacaggtcgttcacatcgcgaccgaccgaaggacggctggggtcgacgcgaccaaagcgctcatcgtacatacgaccaatggaagtgcccgaagcaaccgactcaagatgaccagaacgtccgcaggcgcagggaataccggcagcagccgagcactcgatgtggcccatatggccggcagcaccatggaagccctgcatcacgcggccgttctcgacatatgcgccgccgatgcccgtaccgatgccaaggcacaagacggagaacttgcccttaccgacgccccagtgggcctcgcccagagcatgagcctgcacgtctcccaccacggcaacgggaagaccaaggtcctcgcgcagccgcggccccaactgaacgccggaccagccgggcatgatctcgttggcatacgcgatggcgcccgtcttgggatcgacgacgcctgcggcaccgataccgacgccaaggacctcgacatcgggattcgcctcgagagcagccttgatggacgcctcgatacgctggaagacggcctcgccgccctcttgggcctcggtgggaacctcggcctcaaaaacgggatggggcacactaccgtcagccgggtactccatgatggcagtcgcgatcttagttccgccgatatcgacagaacagacgtacttgttctccatgtcgctctccttcggagataaaaaacaactataggaaatgcgccgtcaggctagccgtcacagcgcagtaaaggttttccaggtgcccaagatcgccgagaaaccgtgtggccattgacctaatagtcatggccacacggttgaacggcgaggtcgggtgcctgggaaagctttacaggaggccgttgtcctggaggaccttcctaatcgcctcgacgttctcgccggtcatggccttcaccgggcgcggcatggtcgggctgtcgaaaatacccatgaggttcatagcggtcttgaaggcaccgacgccaccggcatagccctgaacgcccgaggtgacatcccagatgtgggagatctcgttaaggcgatcctgctcggccttgacggtagcccagtcgccggcctgagcggccttccactggcgcacatagccctcgggctcaacattagcgagacccgggacggaaccatcggcgccaccgaggtaagcgccgtcgacgacaacctcgtgaccggtgaggatactcatcggatggccgttcttctcgttctcctgaacgaggtagcggaacgagatgtcatcacccgaggaatccttgacgccagcaaggacgccctcggcgccgagcttggcaaggagcttccaggggagcttggtgtgaacgcagacgggaatgtcataggcgaagatgggcaggtcaagctcctcgtgcaggatgcggaagtgctcctcgacctcggtcatgccctgcagggcatagaacgggcaggtggcgacgagggcatcggcgcccagctcctgagcgaccttgccgtgctcaatcatgcgctcggtctcggtatcgatgatgccgaccagaacaggcacacggtggtcgacgatacgaacggcctcggcgacaatctggcgacggcgctcgtcggtggagaagacgacctcgcccgaggatcccaggaagaacaggccatcgacgccggcatcgatcatgcggttgatgctgcgctcaaaggaggcaacatcaagctggtgatcttcggtatcgggaacaacgacgggagggataacgccggtgaatttctgagttgccacaagaatctccttagttgtctggcgggcggccctatgccacccactcttgttggcagtgtccaggccgtctaggccaaagaacacgagtagaacgtttggttaaagaagtcgacgacttcgttttcgaacgcattgatgcgctcgtgagcgtattttgcatagatgatatgcctccggtcacactcaagaccgttggatacggcaaactgatccttgggatcgctcacggtatccataagcgatgtgcccatgagcaccgatccgcgcacccgagacgacagcacctcgaggccgccaggaagcggattggcaaccgccgtgcaggcgaggccccgctcgtccagagcagaaaccgccagcgcgactccgccgccaagaccctcgccccatgcaaagatgcggtcggggtccatgccatcaagattgcgcgcgacctccgccaacgcgcagccccaacggacgcgcctgacaaaagcaggcgaggtaatcccctgccgcagatcgctgggtccaatcgcctcatcgtccagcgcaagcacggcatatcccatggccgcaaacctcgtcatgtgatgccatccccgcacgggtcggtcgatgtcgtgaaacatcagacatagcggcacgagctcggatgctcgggcgcgaccgacaggctcgatcaaacgtgcgtggaccacatcgccaccaagctcaaaggaaacctcggagtagcgggcatacggattggcgaaatcgatcgccgtaatactcggcccgcaaacctcaaggtccgaagcggctatctctaattcggaaacatccgcagaagcatcaccgcgccaatcccggaaatcagcgagccttgacgagaccgttccgggaatccccacaaggtcggggacgatcagctcgccgacattgctctcgcacttagacatgagcctcccctcccttgcagaaaaacggaatgatcagatcgtcaaaatcctgaatctcctcgtggccaaagccttcaaagaactcatgacgcttttcacaggtcaggttgttatagaccgcaaactgcgtcgctggcggacagacggtatcggctgtgccggtgccaaacagcacggggcatttgaccataggggcaaagttcttggaatcgaagtacgccagcttggcataggcttcgtcgatacgagtcgagtcctcgtcaaaccagcgagaccaatagcgcaggccctcgtaggcaatgtcgtcggcatccaaatcccagaccaggcgaaaatccgacaggaagggatagaggatggcggcgcgattgataagctcgctgttaagtgcacaggtcgcaatgcccaaaccgccgccctgcgacgcgccgttcacaaacacacgggcaagatcgatgccctcgagctcgcggacgatacggcacaggatgcgaatgtcctggtgcagacggacatagtagaggttggccggatcgccgtcgataccggcgacgatatggcccgcgaccgtcgtaccctcaaatccaccaatgtcctcggaaggacctccttggccggggcagtcgagggcgatgagtgccatgcccatgcccgcaaacgacgcctgctcaaaccagctgcggcttgcacccggatacccatggaactgaagtaccaatggcacgggctcgtccgagacgggtttaaggtacttggcatgcaggcgagcgccacacatgccggtataccagaggtcgaaaagctggcaggtcacggcatcggtgaccgatgccgtctcgatcgcatagtcaagcccgacggcgtcggcctcggccatgcggtccttccaaaagagatcgaaatctgatggacggggcatggcgcctcgatattcaccaaattgatgttgcagctcctgagcacttggcatggctcgtgaacccaacctttcgaaatcgcaacggaggtgcgcccggcaagggaaccgggcgcacgggagggaaagcgaggctactcgccgagcttgggatgcagcagcgacggcgcagcgccgagcagcatcttggtgtaggggtcctgggggtgctggaagacctgcttggcctcgccctgctcgacgatcttgccgccattcataacgatgatgtcgtcagagatatagcggaccgtctggatgtcatggctgatgaacaccatggccaggccgagctccttcttaaggtcggtcagcaggttcagaatctgcgcgcggaccgaaacgtccagagccgaggtgggctcgtcggcgatgatggcatcggggttcagcgacagggcacgggcaattgcgacgcgctggcgctggccgcccgaaagctggccgggaagaacctcagcggcggagctgggcagaccggtgagctccaagagctccttgacgcgcttctcctgctcggcctcggtacccaggttgtggacgcgcatggggtcgagcagttgctcgcgaacgaccattcgggggttgagcgccgtggccgggttctggaacacgaccgagatgacgcgacccatgtggcgacggtcctcggcggtacgcttggttacgtccttgcccttaaagtagaccctgccgctcgtgggggcctgcaggccgcacatgacgttggcggtggtggacttaccgcaaccggactcgccgacgatgccgatcgtctgaccgggcatgagcctaatcgttacaccctggacggcgtgaaccaggttggggtgcagaatcgagccggtacgggtcctaaaggtgacgtggacgtcatcaaggaagatgatcggctcgacgccgttgactgcggtctcgctcatctacatcacctccgcgtgaggggtcaaaccatttgccttgagcacctcgtcggggagctcggaatagaagtgctcggtgccgggcacgcgcttgaagaccggacgggtgtccaggccaatgcgcggatggctcgagcggggcgcgaagcgatcgcccttggggaaatcgcgcgggctcggaacggcgccgggcacctggtgcagacggcccgaaccgctctcgatggacagaacggagcccagaagaccgcgggtgtactcgtggagattccgcgaccgtccaggcggccgtcgccaaggacgcgaaggactggacgctcgaggagcagaaagcggttgccgaggacatcgcctccaagggcgaggcatcgccggcgtacgccaaggcaaaggccgcgatggatgcgggaacgaagttctcgatgaagctgacggacggacagacgctcgagtaccgtatcatcggcatcaaccacgacgacttggccgacggcaccggcaaggcgggactgacgttcctcaccacctcgacggatatttcgtcccgcatgaacgccatgaaaaccagcgatggcggatgggaggcatccgaactccgtgcgaagatgaattcgggcgagatctggaacctgatgcccgccgatttccaatccaaggttaaatcggttaggaagctcacgaacaacgtcggcggcggtaacgcgaacaagaatgccgccgtgacggctacctccgacaagctgtttctgctcagctactccgagatcgtccccacctcctattgggcttccgactacccctggagctcctccgagggaacccagtacgaggccttcaagggcaaggtgatgaatagctattcggacaaccctgccattgccagtggcagctattggtgggaacgttcggtgcgtccggaccactctacgttcttcctccgtgtccacgccggcggcgatccggcgatcagtgacaatgcgacggtctcgaattgcgtccgccccgcctggtgcttctagcctcagctgttaagcccgcacaggctgtgcgggcttttcttttggcaaccaaacgaacgattctcgtcttgaagcatagttgtcgggttgaggtgaaatggggtcatacagcggctctcagagcgcccgtcgcactcccccgccattacccctgcggcgtcctcgtatagagcccatcccgcttggcgtttcgttgcagcagcccacttgtccaccgatcaagtgaactactggaataaatacagcgacacgcttgttcactatagtcgctatatctgtgtaaatcgccgcgataaatacagcccgtactcggctgtataccagctacgcgtatgtagattcacatcgcgttaataaatcggctcaagcgcgtgcaaaacgcgcaagtagccgcaaaaggcgattatcgcgtaggtagatttttggcaccctgttgattaatcaaaattaagcaattgcttaaaacaaaaaaggtcaggcactaggtgcctgacctgcaaacttctggtcgggacgactggattcgaaccagcgaccccttgacccccagtcaagtgcgctaccaagctgcgccacgtcccgaagcttttgtttgttgctctgctctcgctcgcaacagggagtatattaacccgaaactttagacttgtgcaagaacttttttacaatttttgaagcaagtccaaaattgtatctgcgagctggggttttgttagtacgggaagttcttgcgtacccgttgtgctcacaatccaggccttgttggtgtcggtcccaaagcccgaatcggtgcgtgagacatcgttggcgattattacatcgcaccccttgcgggccaatttgcgctctgcgtactcgacaacgttatcggtctcggccgcaaatccgatcacgcatcgctcgcccttctggcgcgagagctcggccaaaatatcgaccgtctcgaccagttcgatgcgatccaggcgctcgttggcctttttgagcttatggtccgcaggggccgcgggggtgtagtcggcgacggcggccgcacaaattgccgcatcggccgtctggaaggcgctcagggccgcctggagcatctctgcggcggtctgcacgcgcacgcactccacgccgcagggcacatcgagtgatgtcggtcccaacacgagcgtgaccgcagcgccgcggcgtgcggcctcccccgccagggcgatgcccatcttgcccgaagagcggttgccaatgaatcgcacggggtcgatcggctcgtgcgtgggaccggcggtaattacgatgcgcttacccgccaggtcctgtggcgcggggttgagcacctcacagacagcctctacgatgtcctcgggctcgctcatgcgtcccgtgtccacgtcgccgcaggcaaggtagccgctgcccggacccaccacatggacaccgcgctcgcgcagcgtggccatgttggcctgcgtcgccggcgccttccacatgccgttgttcatagcgggtgcgatcacgatgggtcgcggcgtcgcaagcagcgtggtggagatgaggtcatcggcgacgccgttggccatcttggcgatgatattggccgtcgcgggcgccacgaccaccagatcgggctcctgcgccagcgaaatgtggtggatggggtcggagggatcgtcgaataggcccaccgcgaccggctcattggtgagtgcgcggaaggtaagcggccccacaaactcggtggcatgctcgctcataacgaccttgacgcgcgcgccgcgcttttgcagcaggcgcacgatattgcacgacttataggcggcgatcccgccggtaatgcccagcaggatcgtatttccctcaagttgtattgaattgttgggtgccgccatcgtttaagcttccttgctcgggagcaccaggaggcggtggcagtacgggcagtgcgtaatctcgctaccgtcgtggttgaggtcgctcatggacgatgcctgcagcgcggtgtgacagaccgtggggatgttgccctggatggtctcgacggccaggccgcggaactgcttgagcagacgctcgtagtcggtgagcacgtcggccggcagcgtggcagcaagcgcggtgcgctctttagtggcggcgtcaatctgagcctgaaggtcggcagccttggcgcgggcggccttggtatcggccttcacgccctcctcgaacttggcgatgattgcctgcgcgcgggcctcgcgctcgagcgcctccttatgggcgacaacgacgtccttgcgggtgtgctcaatcttgtccagacgcttggccagggtggcgagttcattctccaggtcctgaacctcgcggtagtcggagccgtcgacatggcgcttcttggcagcctcgatggcgttgttggtctgaatctcggtggtgttgagatcgtcgagctcaatgtccagatccttgcgctgggcgtagagcttggtcatctcggacttgagcttcacataggtcttgcgcttggaagcgagctccttgagctccggcatattggcaagttcgctcttgttgcgggcgagctccaaatcgatctgttgcagcttgagtagcgtagcgccggcgctcataagttctctccttttgtcacagtccaccattggcaagggttcagtattttaatcgcatgacgggggtcgaccccggcgtcaactgcagagttcatcaatatatcaacgaacggctcctcagagcggtcgtggccgagcaagatcaccgacagcccgcgcaaggcaaggtcttgcgccacgtggtagcccgcctcgcccgtcacgacaacatctgcgcctgcggcgatggcgagctctccaaagtcgcccagggagccgcccaaaatagcgacggttcggcacgcgtgctcggcttcgccccacacacgcgggtcgctgccaaatgccgtggcggcacgggcggcgagatcgcgcaggctacaggggttgttgagggtcgcgagtgcacccaggccggtggactcggggtcgtccacgtgctccagtgagctcacgggtgcggcacccagcagctcgctcaggcagacgcgggcttcgtgcgagcggtccaggttggtgtggagcgaaatgatgctcacgccgcaacgcgctgcctcgtagagtgccgcgctgcactgggggcgtgcggcatcagctgggcaaaacgcctcgggcgccttgatgtatatgggatgatgcgtcagcagaacgttggcaccggcttcttgtgcacggcgaacatttgcctcggtggcatcgagcgcgcaggcaacgccggtaatctcggcagcgggatcgccaacggagagacctacgtgatcccagccctcggcgtccgccttggggtagcgcgccagcagcgcacgttcaaactcggcgacgatcatgcggcacccacgatcgagagcagcgtctgggcaaagtcgtccaggtcggcagggttcacacggtcatcaaacgagatacgcagagcgcccaatgcctgctcgcgaccaatgcccatggcgctgagaacatggctcgggtccatgctgccgctcgagcaggcagagccggccgaaacctcaaagccggcggcgtcgagcttgacgatgagctcctcggagtccatgccgtcgacgtagatcgaaaccatacccggcagacggtcgacctgctcgtagtcgcccatggtggcatgaatgcgtggatgggccgtaagcgtggcgtagagtttgtcggaaagggcttgcagcttttcgcgctcctgagccacttggggcaccagcgtgcgggcagcaacggcaaaggctagctgcgtgcgcaggtcctgcgtgccggcgcgacgtccggcttcctgtccgccgccaaagatgcgggggcgcagtggcgtgcgggtcttaacgtagagcgcgccggatgccacaggaccgccaattttgtgggccgcgacggacatagcatcgacgcccagctcggtgacatcgagtggaatgtgcagatagccctggatagcatcggtgtggaacactgcgcccacggtatgagcggccgaggcaagctcgcggatgggctgcaccacgccggtctcgttgttggcgaccataatgctcacgagcgacacgtcgtcgctcagcaagtcgctcagcgtggcaggctcaatgtagcccgcgcggcagggctgcaccaggtcgacggtaaagccggcggcacgcagcagcggcaggttgtccagaatcgaatcgtgctcgatggccgaaacgattacacgatcgcgcttgcgatcgcgctgacgagcgccctcggcaagaccgagcagcgccagctggttggcttcggtgccgccgttggtcaggacaatctcggacgggcggacgcgcgcgccaaagctgcgggcaatctcgcgacgtgcaacctccagacgcgcggcggctttgcggccaagcgagtgtagcgagttggggttgacgccggcaagctcgctgtcgtcgtactcgcgctgcgcaaggagcgcctcggcgcgcatgggcgtcgaggcggcatagtcaagattaacgggtatgcggttttgacctggggtcataagggtttatgcctcctgtgcggcctcgttgcccagcttctgcagcagcgcaacctcggcagcgggatcttgggacttaaatacggcggagccggccaccaggacatcggcaccggccttgacgacctcggcgatgtttttggaagagatgccgccgtcgacctcgatcatgggcgacacgccgtggcgctcgcacatggctttgagctcgtggagcttggcgatggtgcccgggataaagctctggccgccaaagccggggttcacgctcatcagcagcaccatatcgacgacgtcgatgatgctctcgagcacgcacacgggggtggcggggttgagcaccacaccggccttgacgccgcgctgctgaagatgcgtgagcgtgcggtgcaggtgcgtggaggcctcatagtgcacggtgatcatgtcggcaccggcgtcggcgtaccaatcgaccgtctcgtcggggttcgataccatcaggtgcgcgtcgaccggcacgtcggtggagcgcttgacggccttgaggacgtcaacgccaaaggtgaggttgccggtaaaatgaccgtccataacgtcaaagtgcacgtaatcggcgccagcgatcttgtcgagctcgcccttgaggttggccatgtcggccgaaaggacggacggagcgattttgatggaacccatggtagtagcctttctgcgctagtcgttgagtccgtagaactcttgagaggggacgcggtcggtaagaatctcgagcgctctatccaaagtaacaccgttgtagagcgtttgctccacggcaaaggtgagcggaatgtctacgcccagtgaacgggcaagctcgctgacgctgcgggccgcgacggcgccctcaaccaccatatgcgtgcgcgtctgatactcgtcgagcgacacgccgtgggcaaactcgtagccaaaggtgcggttgcgcgagtgctccgaggtgcaggtggcaatgaggtcgcccatgccggcaagtcccatgcaggtcatagcttgaccgccgcgggcatgcaccagacggctaatctcggccaggccgcgcgtcatgatgagggcgagcgtgttgtcgccggcaccggtgccggcggagatgccgcacacgatggcgatgacatttttcatggcgccgcagacctcgacaccggtcatgtcttgcgacagatagatgcggaaggccgtggacaggagcaggtccttaaaggtctcccctatctgcggatgttcgctggcgatgacggcggcagaaagcccgccgcggcagatctcctcggcatggttggggcccgagagcgccgccacgcgcgcctcgttgccgatctcgctggcgatgacctcgctcatgagcaggccggactcgggctcaatgcccttggtgaggcacaggaccggagtttcggcatcgatatacggcgctgcctgatggcacacgtcgcgcaagtgcgtggagggcacggcaaagatgatcgcatcggcaccgtcgagcgcctgagtgagctcggtcgttgcttccacgttgtcaggcagctcgtatcccaccagatagcgcgggttacggtgctcggcgttaatgccggcggccgtctgctcgctgtgggcccacatggtcacgcgctcggctcgcgcggcggcaaggccggcgacggcggttccccaggagccggagccaatcagcgcaacattcatgactttctcctacttatcgtcgggcacggtgacgcgcttggtaaacgagagcttggactccttaccggccatgagcttttggatattcgagcgatgggcccacaccacggtgatgccgatcatcgccatgcaaaacttgaggcccaggctgctatacggaaagaccgcgcaggcagcgatgggaagaccgatggcggcggcaagcgagcccaccgacacgtacttggtgatggcgacggccacgataaacatgcccagcagtgacaagccaatgggccagtaccaggcaaggattacgcccaagcctacggcgatgcccttgccgccgtggaagttgaggtagggcgagaagatgtggccccacacagcagccaggcagatgacaccgagcatccagtcgccggccgcgccgggagccatgatgctcacggggaagccatagcccacgctcgcgatgagcgggcgcgcgatgatgacacagatggcgcccttaaggcagtcgagcagcagcgtgagcgcggcgaccttggggccggccacgcgcagcgcgttggtggtaccgatgtttccggatcccgccttgcgaatgtcagtgtggttgaacacgcggcccaagatcaagccaaagggaatcgctccgataaagaacgagaccacggcgcagatggcggtcagaagaatcggattatgcatccttttgctccttcttcctaaagaagagtcgaatgggcgtaccggcgaagtcgaaggtcgagcgcatgcggttctccacgtaacgctggtaggtgtcattgaccaggtcgctgtggttgacgaagaacgtgaacgtcggcgggttgacgcccgtctgggtcacgtagtgcatgcgcaggcggcgcttgccgtccaccacggtatgaccgaactcgcgcaggtcggtgaggaacgtgttgaggcgcgaggtgctgatcttttgcgagcgcgtcttctcggcggcatcgaccatcgcccagatcttctcgacgctgcggccggtcagagccgagatgcgcaggtactgggcccagggagccatgacgcccagacggcggtcgatggtctccatgcaggcctcgcgcttacggtcgtcgtcgagcagatcccacttgttgagcagcaccacgatggcgcagccgcgctcgatggccaagcccatgaccttctggtcctgctcggtaacacccacggaggcgtcgacgacgagcagcgccacgtcggcgcggtcgatggcacgcaggccgcggaccatggagtagtactcgatgttctcgtacacggtgctcttcttgcgaatgcccgcggtgtcgaccatgcggtagtgcttgccgttgcactcgacgacggtgtcgatggcatcgcgcgtggtgccggcaatgttcgacacgatggagcggtcggctcccaggatgcggttgaacagcgacgacttaccggcgttggggcggccgatgatagcgacgttcagcgcgtcggggaattcatcggcgacctcgtcctcttcctcggggagcagggccacgatatcgtcgagcaggtcgcccgtgccatgtccgtgcagggccgacagcggcgtgggctcaccgatgccgagcgaatagaactcccagatgctgtcgttctcgcgatcggggttatcgagcttgttcaccaacagaaagaccggcttgtcgcagcgcttgagcatgcgagcgaccgactcgtcctcttcggtgactccggtgcggccgtcgaccacaaataggatgacggcggcttcctcggcggcggcgagcgcctgatcgcggatggacgtggcaaacacgtcatcgctcttgagcggctcgatgccgcccgtgtcgacgatggtgaactcgcggccgttccaatcggccgtgtgatacgaacggtcgcgcgtgacgccgcgggactcgtggacgatggcgtccgaggtctgggccaggcggttaacgagcgtggacttgcccacgttggggcgtccgacgacggcgacgataggtttcatctgctctcctttaatggatagggtcagcggtattagtagagtcggcaggcacaatgccaaggatgtgctccagggtatcgagcagctcatgcggcatggtcgacaccacatgaacctcggcgccgcgactggtaaggcttgcgagtaaatcgtcacgatgatactcgtcaagcgtcatgccgtcagcgttgaacatgagcttaggcacaaagagcataacccccgacaggtcttgcggcagctgctccaggatatcgctcgcgacgatgaggccggtcacgtccacgttgccgccaaagtagcggttcttgatggccatgacggtgccggaaaggccctgtggagactccacgaagcgcgccacggtatcgcgtgcgctggcgcccgagagacataccaggcgctggttgcgggcggtcatagccttgcgaacgcgggcaaggcgctcggcgtcggcggcaaggacatcgtctgtctcgtccagatacgagcggatcatgccgatgccgtcgtagtactgcgggtagccgtcgtagaaatcggcctcgggcggctcgatgccggcgtccaggtagaattcgtcgctcatctgaaaggtgtggcgaccaaagcgctcgtacgcgcggtcctggaagggccggatcatggcgatggtctcgcgcgccagctcgggcttgtcgctgtaggaccacgtaaagcggttctgatgcttggtaaagcccagcggcacaatgcccaggctcgtgatctgttcgtgctcctcgcaaaagcgcagggtcttcagcagttcctcgccgtcgtttatgccagggcacaaaacgatctgcgcgtgaatctcgatgccggcggccatgatggcctcgagcacgtccatgccgcgctgggcgttgcggcccatcatgcggcggcgaacatcggggctcacggcgtggaccgacacgttcatcggactcatgttgcgatcgatgacgttttgcacgtcctcgtcggaaaggttggtcagcgtgacaaagttgccctgcaaaaagctcaggcgatagtcgtcgtcgcgaatgtagagcgtggagcggccgcccttgggcagcatggtcataaagcagaacacgcaggcgttgacgcaggtacgcatgccgtcaaagatggggccgtcgaactccaggccccagtcctcgcccgggaagcggtcaagctcgacgggggtgacggtgccgtcgcgcgggtcgaaaacctccaactcgacggtgtcgtcgtctgcttcccagagccacacgatcatatcggttagctgctcgccgttgaccttgagcacacgcatgcccggctcgatacccacatcccatgcgggcgattcgggacgcacgttctttacgagcgcgccctcacccggctcggggtcgcggctgcgcccgtaatcggccacctcggcggcgtatgcgggtacggtctggtccatgattagcggcaaagctccttgatgcgcgcaacggcgcgttcgatgtgttcttgcggggtggaggctccggcggtgatgccgatgtggcgcgcactggcaaaccatgcggcctcgagctcggaagcttcctcgatgtaatgcgtgtgctcgcagacgtcggcgcagatttgcgccaggcgacgggtgttgcccgaatttttgccgcccacgacgaccatgcaatcacagcggttggcaagcgacgcggctgcctgctgccgttcgctcgtggcggcgcagatggtgttgatcacgcgcagttcctgcacacgcggggtgatggaggccacaacctcggccaggttctgcgcggtttgggtggtctgcacaaccaggcccaccttgcccttgagccgcagcgcgtcagcatcggcggcgcagctcacgacttgagcgtcatcaccagcgtggcccagaatgccctcgacctcggggtggcccggctcgcccacgacgatcacgcggtagccctcgcgcaccaggcgctcggccgccacatgaaccttcttcacgtaggggcaggtggcatcgaccacggtaaggccgcgctcgcgagcggcgtcgatgacctgcggcaccacgccgtgggcgcggatgattacagtgcccgacgcggcgtcgtccaaggtgtcggccagaccaacgcctgcctcggcgagctcgcgcaccacgatgggattatggatgagcggacccagggtgtggacctgagcgttctcccccgcctgcggcgcggcggccagcgccatgtcgagcgcgcgctgtacgccgtagcaggtgccggcgtgggcagcgatctcgatggtgggcgcggttgcctggtcgaacgcagtcgcagcggtgttcttgacttccacgcccatggttagaaccttcccgggtgctcggcgcacaggtcatcgcgcatggcgtagacacgattcatggcttcggactcaaaccatgccaggcgctccttgcgcttgagctcggccggtgcgtcggaaagcgagatggccttgccggcacggatccagcatttcttgggacgcatgagttttttgccttcgggcgtaatgtcggaccacccacagatggcgagcgggttgacgggcgccttgcccatctgggcaatgagcgcaaagccgccgtggacctcgggcttgatctcgcgcgagcggatgcgcgtgccctcggggaagatcaagacgtcctcgccgcgctgtagtgcgtgctgggcggcacgcagacacttcatgtcagcggtgccgcgctcgacaggaatgccgcctacgcggctaaaggcccagcgcacaatcttggttttggcgaactcggacttaaagatggggcgaatgcggcggccgccaaagaacagcgccgtctctacagccaggagctcggccatcgaggtgtggttgcagatgaccacgctgccgcggccttcctggcgctcaaacagcagattggcatcctcgaccttccagcgccacatgagcttggagaaagcccaaaggattgccatgaccacgaagacggtgccgcggatgagcgccgggaactcggcgtacggggcgttgtagtaatcctcgggcgtctgtttaaacaggcgcatgggctacctcctttggttaatgaggtcctcgattatcgagacgacctcgtcgatggtgtgggcggtggagtcgacgtgcacggcgtcctcggcgggcacgagcggtgcgacctcgcggctgctgtcgagtttgtcgcgctgcttgagtgcgtcgagggtctcgtcgacctcggcctcgagctgatcttcggagagcggctgagcgtcgttttggtggcgctgcagcacgcggcgacgggcacgctcgcgcgggtcggcggttaggaacaccttgacctgcgcgttggggaacacgacggtgccgatgtcgcgaccctcggcgacgatgtcgcggttctcggcggcgcggcgctggtggatgagcatggccgcgcgcacgcccgggtaggccgagaccttggagacgttggcgtccacctgcggggtgcgaatggcagccgaggcatcctggccgtcgatggtcaggcgcgtgtcctcgccggtgccgttggtaaagcgaatatcgatctgctcggcgagggcgtcgatggccgcttcgtcgtccaggtcgacgccgcggtcgagcgcggcgaaggtgacggcgcgatacatggcgcccgtgtcgagcttgttaaagcccagctggcgggcgatctccttggcgatggtggacttgccggaaccggcggggccgtcgatggcgacgatcatgcaatgcttcctttcggtggttaacgtgctggtatggttcgcgggcgttgaggcgcggcgggttgtctagcccgtgtagcgctcgcggtaggtgttgcgcttgggcgcggagccgtggctgccgtgatggcgcgtgcgactcgcggtgttggtcactggcgcgccggcgtgtttggcgctcgcctgcttgggagggataccaccgcttttgagaatctgcacctcgcggtcggtgagctcgcgccacgagcccttggccacgtccttgagctccaggccggcaaagttacagcggtgcaggcggatcactggatggtggatcttgctcagcatgcgtttgacctggttcttgcggccctcgcggatgatgacctccacggcggtggtgccgggctttacgccttgcggagccacggcctcggcctcgcgcgcggtaatgacgcggcagattgccggctggcacaggccgtcgtcgagctcgatgccgcgacgcagcggtgtaagatcgcggtcggacagttcgccgtccacgagcgcctggtaggtcttgtagacgtgcttgctggggtgcagcagatcctgcgacagatcgccgtcggtggtaaagagcaaaaggcccgtggtgtcgcggtccaggcgacccaccgggaagagccccggaaagcggtcgcgcgggaccagctcggccacgcaggggcgctcctgcggatcgctcatggtggtgaggtagccggtcggcttgtagagcatcaggtacacggcgccctggttgagcttgacgggcatgccatcaacctcgatgttgtcgcggtcgacgtcgaccttggtgcccagttcggtcgcgacctgaccgttgacggtcacgcggcctgcggtcatcaggtcctccgagccgcggcggctcgccacgcccgcgcgtgccaaaaagcgctgcaggcgcatcgtgtgcgggtagacgggctgggcgtcgcctgcgggcgttgtggcgcctgcggcgcgcgtcacctctgcttcgttagtcctcgtcatgcatgtcctccgaggtatcgtcgacaaccagggtatcctcgtcctcgactgcctcaacatcttcaacatcggtatcgatcagttcgcgctcttcgtccagatcttcggcctgctcctcgagcgtggactgaatgctgcggccgctcaggcgctcgcggataaactggcgcgactgctcgtcgggggcaaactgctccagatcgggcaggtcgcgagtggagcgaaggccgaacttttccaagaaggcgttggtcgtaccgtagatgatggcctgaccgcgctcggggtcgcggccgagctcgcgcaccaggcccttgtcaacaagcgacgcgatgacgccgtcggagttgacgccgcggatgcccttgaccacctcacgcgtgacgggttggtgataggcgatgacggccagggtctcgagcgccgcctgcgacagtttttgcgtgtcccagctcagcacgtaggcctcgaccacgtcgtggtaggcagggtgcgtaaacagacgccagccgccggcgacctcgcgcagctgaaagccgcgattggcctcctcatattcaaccttgagctcggccaaaagcgacgcgcactcgccgggggcgatatccagtgcacctgccagcgcaggtgcactcacggggtcgctcgacaccagcagcagcgcctcgagggcgcctttgaggctgttggcctccagcgtggaaaggtttgacatggttgccgctcctattcagtgagctcggggccctcgccgggcacataggcctcggcgccctcgacgcggttgatttgaatggttccaaagatctcgtcctggctcagcgtgagcgagccgcgtttggcgagctcgagcatggcaaggaaggtgacgacgagctgctcagtcgtggcgtcgccgtccagcagctcgcggaaggtgcaggtttggtgcgccatggtaaagcggtcgaccgaggccaccgtcagatcgagcggcacgcgatgcggcgccacgtgctcggcctccagcaggaaggtctggcgcttgccgtccaggtcggcacagatgacggccaggccgcgcagggtaatgccggccaggtagtcgggcataaggcctaggaattcggggtcggggccggcaacgcgcggatgcatgcggctctcggcctgcatgcgcgcgccaagggccgccgccgcgcccttaaattgcttgtaggcaatcaggcgctggatcaggacctcgcgcagggcgtcgccgtcgagcgcgctgagctcctcgaggtcttcatcgtcctcgtcatcgtcgacggttttgctgggggtctcctggggcaccagcgaggcggccttaatgtccaaaagggttgccgcgaccagcaaaaagtcgctcgccacgtccaggtccaacgcctcgatgcgctcgacctcggccaggtattgctcggccacctcgctaatggagatggcgccgatatcaactttttggcgggttaccagctgcagcagcaggtcgaacggtccgctgtagacctgcgtcgacacgcgatacgacatcttcgacctcctttgacggcgccttcgcggcgcggtttgggtgcatgttgcgaccgttttgcacggccgacctgtaagtttaccttagatgccggcgattgcgaagttgagcagccactcggcgagcggatacacggtaacgtcgaaatagcggccgatcaagtcgatgccggtccacatgggtagcaggtacagcaccaggatgaggatgggcatggcgtattgctgcagtcggtagtagttggcgagcgccttgcctttgaggaatgggacgatgatcgacgagccgtcgagcggcgggatcgggatgaggttaaagaacgcgagtgacaagttgaccacgataaacgtggcaccgaagttcatgatctgtgacgctacggcaaaggacatgcttgcgtagaggttgccatacgctgcgcgcatgagggcggccgcgaggcacgcgagcgcgatgttcgatgcggggccggccgcgctcaccaggacctcgtcgcgcttgggctgcttgaggttgttgaggtagacgggcacgggcttggcgaaggcgaataccgggccgccggccgcgagcataagcagcggcaggaggatggtgccaaacgggtcgatgtggttgagcgggttgagcgagacacggccgcgcgaacgggccgtcttgtcgccaagtgcccaggccgcggcggcgtgcgcgctctcgtggatcacgattcccacgatgacggcaacggcgctggcgagcaggttcatgaagtagctgctggacatggcgctcccctagcggacgcggcgcgaggcacgcgtgagcaggtagtcggccacaaacaaaatgacggccacgatggcgtaatccaagcggaacacaccgccaaaaggcgacgtgatgacgccgtagccggcaatggcgctcggcagggcgcgcgagagctcgacgacaaagccgacgatctgcaacttagcggtgaggccgctaaagcacaatagcacggtcatcgcgctcataaagatgccgcagatgcgacaggcgatggcgatgatgctcatcgccacggcagcggccttacgagagttcacgcgcggtctcctcttcgatctgggtggaaagctcgagccattcgtcctcgagcttgggcagctcttgcttaaggccgttatattcccccagcgcggcgttgaacttgtcctgatcggcataaagctcttcgcttgccatcaattccataagctcgtcatagcgggcgcgctttttgtcaagctcggtctcgatcttcttgagctggttgcgcacgcccttgagctttttgttaagcgcggcgcgggcctgggcctcggcgcgcttttgctccttggtctttttgccctcggcaggcttaggtgccgcggcgggggtgtcggcctgggcggcggtgaccttagcggacttggccgccgcaggcacgctctccgtggacgcctcggcggcggcgcgggccgcgaggtcctcgcgcttgtagaggtagtagtcgtagtcgccgtcgtagaccgtgaccttgccgtcgcgaatgtcgatgacgcggttggccacggcgcgcaccaggtgctcgtcgtggctgatcagcacgatggtgccggggaagttttgcagggcgctctcgagcatgtccaccgagtcgatgtccaggtggttggtgggctcgtccaggcacaggagtgcctcgggggcaacgagcatcttggccagggccagacgcgccttttcgccgccagagaggacgcggacctgcttttcgattgagtcgttgtcgctaaacaggaaggcgcccaacaggctgcgctgctgcggcacggtccacttgggcgtgacggtgtcgatctcttgcaggacggtgttggactcggtcatgccctcgagcgcgtgctgggcgtaataggctacacccacgttggtgcccaagtcgcgcgtgccagtggttggcggctccaagccggcgatgatcttcatgagggtggacttgccggcgccgttggggccgacgagcgccacgtgctcgccgcggtagagcttgatgtcgatatcgctgtaaatgtgcttgtcgccgtaggacttggagacgccctccaggcccacgaccatgtcgcccgagcgcggcgggtcggggaacttaaagtcgatgtgcttgtggccctcgggcaggatgacgagctcctttttgatctgctcgatcttgcggatgcgctcctgggcctgcgcggctttggtgggcttgtagcggaacttgtcgacgaagacctgcatatgggcgatgtctcgctcctgggcagcgcgcttggcgcgcatctgctccaggttgtcctcgcgctgcttaaggtagctgctgtagttgccggtgtaggtggtcacgcggcggttctcgagcgcggccacgtggtcgacgcaggcgtccatgaaggcgcggtcgtggctgacgatgaggacggcgccgtcatagttggcgataaagccgcgaagccattggacgctctcgaggtccaggtgattggtgggctcgtccagcagcagcaggtcggggtggcgcaggaaaagctttgccagcgcgatacgcatctgccagccgccggagaactcggagcacgggcgctcaaagtcagtgaccttaaagcccaggccggacaggatcttgcgggcgttgctctcgagctcgtagccgcccaggtgttcaaagcggtcttggacctggccgtactcgttaaggagtgcgtcgacgtccttgccctgctcggagagctcggtgatctgggcctgcagctcgttggcgcgctcgcccatgcggcggatttccttggcggcggccatgacctcggcgaggatggtggtgtccttttgctctaggttggtttcttgctctagatagcccacgtggcagtccttggcgtactggacctggccggcatctggactgtcgatgcccatgatgattttgagcatggtggttttgccggcgccgttgggtcccacgagcgcaaagcgttcgccggggttgatctggaaggacgcgccgctaaagaggacgcgcgcgccgaagcttttttcgatcttgtcgaccaggaggatcatggtgccgcctttgaccttgtgtgcctatatggtttcaaaccgggctcgaacgaacatgcctattgacaatggctttctcatattataaaaggggaacccgcaggctcccctccggttccaggcatcgaaagtttctggaccctaatcactgacatgatactatcttcaaacttgcgcgcggtcaagcacatgcactgagcatccaccggcacacattaccagcacctccggcattgctcgcatgaaaaaggcaacactccttcactgaaagctttgcctctaaagcgtctgcagaactcctacatttaagccagatgttcctcaccacatcaacagcaatgtgaggtgacgaggaacgctgaaccaagcagaaatagcgttagggacacggcgatccaatttgtgtcgctggttttggggagcgaggcgttcgtcgcggtggttgccttgagcctagaggacttggcggccgtggtgttggtcactgtggtcgtggtcaccgtcttagtcgcggccgcgggcttcagggtgggattcgtcgacggatctgtagctggctcgccagtagcggggtcggtgccaggggcggacggaccatcgcccggcacatcgggcccaccggtctcccccgccggcgccgtggcatccacgggctcgatcgtcacacgcgctgccacggtcctgtcggcatccaccacgccgcctgcgccaaaggccccgcccgcaggcgccacaaagcgcgcggatgcaagcgacccgcccaagcaggcgacgccgccgtcggcgcccgacgcatccagccaggacgaatcgacggtaagctgcccggccgcgccactgccggcagccccgcccagcagacacacgccataggcgcgcacgcccgcggcgacaacgcgcccactgccgcgaacggcaagaccatccgcgatcacgccggccacccgcgcatctgagatgccggcgccgtcggcccgcacgtcaaccttgcagccgtccaccgcgagcgtccccgacacgtagatcccgcactgcgagcctgtggccgccagcgacccggtgccgcggagcgtcagatcgccccacacctccatgccgcaccgcgagatgtccacgtcgggcgcgctcgtctcgacaacagtgttctgcccggtcagcgtcaccaacaggtcgccgtcggcgccgatggcctcgcccgtgtagccgttaagctccaggtggtcggcatcggtccaggcccacccggggcccgatacacccgactcgtagtacgtggcgcccgcaatgaacaggctgtccgcgccggcggcataagaaggcctgcccagcaaaatgcataggcaggccatggcagtaaacagaatgtagtgacggctggtgtggaacgcggcagcaaacataaccgctccgatcttcgcaagagccaatggaagctgcgccaggaaactacctggtagcagcagttattagtgtagccagatcaggtgagcatcgtacgaattgcctgtaaacgaaccccgaaattaggtgtaaatcgttttgggttgatttccgatctcagccgaacacattgagcggataggccgttcccgcataatatgagaaagccattgtcaataggcatgttcgttcgagcccggtttgaaaccgggctttttcgtttcccgtcgggagagcccgcgcacgctgcatggcttagtcgacgcttgcctggcaagctaatatccgcgggctcttgcgggtgcgcttccggcggtcagcccggtatgtccgcgcaccccaccgcatttcgattctccgtccggcgctatcgtacgaatccagtcttttgtcgggcgcggcccgggggctgcccatcaaaaaggtcgtgaactcgcgccggcgatgcgtcgaggcgcgggccctcccggcgggagtcggttgtcgccggccgctagaggacggtcccctcggacctgcacccgatctcccagacccagcaggcgagctcgcgcgccacggcggcgttggccttgcacgcgctcttgcccgccgcggccagcgcctctcggcggcggtggagcctggcggtgcagtcgtccgccctcgagcgtatcgccgggggcacatcggtgccgggggctggggccttgggcctcggggagcacgtggagtagtgccatgcggactctatgagcgccgtgcgcgcgagcgcgttgccggccttggttatcccgccgcgccgctcggactcgccgctcgagtgctccgacggggtcagcccgcaccagctcgcgaaggccggcgccgagcggaacctgctgaaggacccggcctccgccgcgagcctgaaggccgtcagggtgtcgacccccttgatgcaggacagcgcctccaccgtcgcccgccagcggtcggtgcccgccagcgcgacgaccctcctctcgagctgccgcctgtccgattccgcgcagcgggcggccgtgacgtagtactccagcgcgtcgcgctgcggcccctcgagcctgatctccgagacccacctccagtgggccctcgtccaggccctcttcctcgccccgtcggcgttgcgctcgtcccagacgtggcccagcctgatcaggaacatgttgaggcgctgcctcgagcggcggagctcgcgggtcgcgtcgtcgagggcgcggtcgaggtcccgggcggcctcgaccgccacgtcgggcagcgggacctcgacgatgttgtgggtggcgagcatgcgggcgatgaactcggcgtcgcgccggtcgttcttgcgccgggcgtccgccgccggcctctgcatcctggagacggcggccacggcgcagtcgaggccgagcgcgcgcagctcgcgcgccatgtggaagccggtggggccgctctcgtagcaggccctgggctcctcgaagccgagggcccactccgcgatctcggcggcgtccgtcccgaagctgcggtgcaccacctcgccggtgaaggggttgaacgccgcggcggcgaccgatcgcgcgtggacgtccaggccgatggaggtaacatggggcatgggaagcctcctccccgcaggtgcggtaagggctaccgcacgggccgatactcaaagcccattgtggcaccccgagcccgcggaaagaagctgcgccgcgggggaggcggccccaatggctttctcatatcgtcttttatgaacctgtcatgctcggcgaagtgcttgagtcgctgcagctaaagagcggttccgtcgtctgcgactgcacccttggcggtgccggccattcggtaaagatggccgcgcaggtgggggagaccggccttttgctcggcgtcgatcaggacgacatggccctcgaggccgctggcgcccgtctggaccgcgaggttcccggcgtaccgcaccagctgctgaagggcaacttcggcgacttggacgagctgctttgctcggccgaggtgcccggggtcgatggcttcctgttcgacttgggcgtttcgtcgccgcaactcgatatccctggcaggggcttttcgtacaacgaggacgccccattggacatgcggatggatccgggtaacaacaccttaaacgcagctgaggtcatcaacacctataacgaacacgacctcgcccggattctacgcgtctatggcgaagagaagttcgcctcgcagatcgcgcgtgagatcgtgcgccgccgcgagcatgagccgatcgaaaccaccggtcagtttgtcgagatcatcaaggctggtatccccgctgccgctcgtcggcatggcggacacccagccaagaaaagtttccaggccattcgcatcgaggtcaatcacgaactcgatgtgctcgagcgagggcttgacgccgccacaaggtggctcaacccgggcggacgcatctgcgtcatctcgtatcactcgctcgaggaccgtatcgtaaagaaccactttaaggagatgagccaggggtgcacgtgtccgccggagattccggtgtgcgtgtgcggcaacgtgccgatactcaaggtcatcacccgcaaacccctggttgcccaacccgatgaggttgcgcgcaaccctcgggcgagatcagccaagatccgcgtggcgcagcgtctgtagacgcgaccgcgcgatattggacctcccgctcgtaccacaaacgaagcttaaacacactaccaacgtactcgggatgggaggcggcatatcatgggctacaacacctcaaacgtagcactcgcctatgatatgaacgccatgcccgcctatcgtgaggcaccgcaggcccccgttgctccccgcgagcagcgcacgccgcgctttgatgtctacacgggcgcgggccgtcaggcaaaccaggcggtaagcccggttttcatgagcgttcttaaaacgttttgcatcattgcggccatcttcatgacgatcggtgtcgcccgtgtggcgctcgccggcgttacggcccaggtgctcaacagcaacgccgcgcttaccaacacgctcgagaaggcgaccgacgagagctccgacctggaggtcatgcattcggtctatggtgccgacacgcgcattcgcgaccttgcgggcgcttatggcatggtggagcccagcgagagcgttacacttgatttttcgcaggatgcagccgcgggcgccagctcgaccgcgaccgctcagtaacaagacggtagctgagtatgacaaatgactatcgccgcggctccgacgggggtcgcggttctggacgtccctcatcgcggggacgttctggttatcaaggaacgggtcggccatcttacaacgcgaggccgtcctatggcaacgacccggcatcgcgacttcgcggttcgggtggtcctcaagtgcataacaccaggtcgcgcaagaactcgtcgaccgaatggctcacgggcacgccgctgcctcgtcgcaacgtcgtcatggggtgcattgggctcggtttggccgcgggcgtctatcgccttgccgactatcagatcgtgaacgccggcaagctgcgtgagcgcgccgatgcacgccgccttctcgcccagacgctctatgccaagcgcggcactatctacgaccgtaacggcaacgtgctgacgtcttcggtcgagtgtcgcaatatcgccgtgaacccgcagctggtcgaggatgtcgacaagacggtgtcggcgctggtcaaggcgacgggtatcgataaaaagacctgtcgtaaactcgttgagtccgatggcacctgggtgtatatcaagcgccaggtggacgaagacgacgccgcggcgttggagaagaaaaacctgcccggcgtactctttgagcaagccatgaagcgcgtgtacccttacggcaacctggcctcgcaggtgctgggcgtggtgaatgtggacaacgatggtctgacgggtctggaaaagcaatacaacaagctcttgaccggcacgaacggttctcttgtgcgcgagcgcgcgagggatggcagctatatcgcaggcggcgcctataaaaaggtggccgcggtcgacggcgtagacatcgtgacgacgcttgacgtcaatatccagcgtgcggctgaggatgccctagccgaggcagttgagaaaacgaaggccaagaacggctcggcccttgtgaccgatcctacaacgggtgagatccttgccgcctgctcgtacccgacgtatgaccagaccgatctggaaaatgccaagaccgaggatatgaacctgcgcctcgtcaccgatgcctatgagcccggctcggtttttaagacgctcgtgacgggcaccggctttgatttgggcgtcgtgcgctcgagtacgtcgtttgaggtaccggcgagtatcaaggtgggcgacgataccgtcaccgatgccgataaacgcgactacgccatgaccatggatgtgcgcgagatgatgcgccgttcgtccaacgtgggctttgtcctggtgggacgcaagatcggtgccgacgactttgccgcctatgtggacaagtggggcatcggacacagctcgggtgtcgattttccgggagagagtctgggtatcgtcaaggagcgcgaccagtatgatggcgccacgctgggctcgatgagctttggccaggcactgtccgtctcgccgattgagattgcgcgtgccgtgggcggtatcgccaacggcggcgtgatgatgaccccgcacttctataagtccagcaagggcgatgagaaggattggggcgagggcgagcgcgcgatttcgcaggacgccgccgcgcaggtgacgtcgtgcatgcagacggttgtcgccgagggcacgggcgtcggcggcacggtggatggctatgacgtggcgggcaagaccggcacggccgagcgtgccgatgagaacggcggctacctcaaggagaactacatgtcgtcctttatggggtttgcgccggctcagtcgcccaaggtgctgtgctatatcacgcttgacggaacgccgagcggctcggacgccgctgcggtgccgttccaatccattatggccaacgcgctcgacgtgttgggtatcccgcacacgaagtagggggttacaatcttgggcgtggtccattgttcaatctgaggggtgttcacatgccctgcaccacgcatgcgtggcactgggatacaatacgccgatagcattattaggtttacaggggagcagcaatgatagagatcgccgtcaacaacctcgtggccgcaacaggggcccgaaccgtgacggaaggagccgatcgtgtttgccgcgggtgcgttatcgactcgcgtcaggtcgaggaggggacgatctttgtcgccttcccgggcgaaaaagtcgatggcaatgactttgcttcccgtgctatcgaggcgggtgccggtgcggttgtgatgacgcgcgagcccgaccccgagttggtctcgctgtcgcaggacaagggctgcgccatcttgctgaccgacgatcccgaggagtttctgctgcgtctggcgcatgcgtatcgcctggagcttggctgcctggttgttggtattaccggttcgatcggtaagacgacgaccaaggacgtacttgccgcagtactcgccaagcgctatcgcgtctgggcgaccaagggcaattacaacaacctgatcggcatgccgctcacggtgctgagcgcccccgccgataccgagatcctggtgctcgagatgggcatgaatcatttccacgagattgagcgcctgtcccagtctgccaatcccaaccttgccatcgtgagcaagatcggcacttcccatatcggtattttgggcagccgcgagaacatcgcccgtgccaaatccgagattgtcgagggcatgcgtgccgccggcgacatcctgccgttgctggttttgggcggcgaggatgactttacccccttcatccgcgacacgtttgccgcgcctgccggcgttgacgtgatgttggcgggtatctcggacgacgatgaggtccgtgcgcgcgacatccgtgtcgatgacgagggccgtccggtctttacgctcgattttggcctaggcgagtcgatcgaaaccatgctcgccattcccggtgtgcagtccgtccccaatgccgtcaaggccgccgcggttgcctatcgcctgggcgtaacgcccgagcagattgatgctgcctttaggggacttacgatcacgggccaccgtcaggagatcaagcgcgccaagagcggcgcccgcatcatcgacgattcctataacgccagtgccgaatccatggccgccggtctcgatctgctgtgctcgcttatctgccaaggctcgcgcatggcggtcctgggcgagatgggcgagatgggcgccgaggctccccgcatgcatgagctcgtgggtgcctatgccgccgccaagaagctcgacatgctggtgtgcgtgggcggcgagctggcccagcttatggccgatgccgcgcgcatgatgggcatggacgaggatcgcattcaggtgttttccaattatcagcaggtgctcgaccgcatgggcggcgcacttgaaaatcatgatgttgtactggtcaagggttcccgttttgttgagctcgaccgctttgtggaaggtgtgtgctagcccatgttcggcaatccctcgtatcctacgtatcaggcctttttggggcttggcatcgctgctgccattgcgctgctgctcatgccgtggtggattaagctgctgaaggtcgagggtatcggccagcaggttcgagccgacggccccaagcgtcaccttattaagcagggcacgcccaccatgggcggcgtcatcattctcgtcgcgatctcgctgacctgcctgctgatgggcaagctcaccaccgagctcgtactcgtgctgctcgccacgctggcgaccggcgtgctgggcctgatcgacgacctgacctccgttacgcatgggcgctcgctcggtctgacgccccatgccaagatgatcggcctaaccattatctgtgtcacctttacggtacttgccgtcaactggtgcggtgtcgcccccgagattcgttttcccggtgggttgacgatcgacctcggtgttctttcgaccaccatctgcggcctttcgttcccgtggctctacattgtcttttgctggctgatgatcgccggtctttctaatgccgtgaacctgaccgatggccttgatggtcttgctggcggcacctccatgattgccatgctcgccatggctgccatggcgtttttgcacggagacgtgaacctgtccatcttctgcaccgcgtgtgccggtgcctgcttgggctttctgtggttcaactgctatccggcgagcatctttatgggcgataccggctcgcttgccctgggcgccgcgtttgcctgcacgtccatcatgaccaacaccgaggtcgtctccctcatcatcggcggcctgtttatcgttgagaccctgtcggttatgattcaggttgtctacttccactttacgcacaagcgcgtctttcttatggcgcccatccatcatcatttcgaaaagaagggctgggccgagaccaaggtcgtcatccgtttttggattatcgctgcggcctttggtgccgttggccttgctttgttcttccagttgggatagtggtctttcatgcctcttgctgatgtctttagcctgctcgttttgggtcagggcaaatccggtctcgatgtcgcccgctgggcgctggcacatcccgagcgcgtaagcgccgttaccgtgtatggcggcggcacctctgagcccaatgacgccacgcgtgcgctcgaggctgctggtgcgtcgtttgtctatgggaccgaacaggtcgagggcgcctatgacgtatgcgtgacgtgcccgggcatctcggagttctcgggcttctttaaggccgggcgcgagcatgccgcccagattatgggtgagcccgagtttgcctatcgcctgtcgcccgataactggattgctatcacgggcaccaacggcaagacgaccaccacgtcgctgactgattatctgctcaaggctgccggcgaggccagcgtagccgtcggcaacattggcgagccgccggtcaacgagattgacggacgagcccacaacgagtggtttgtggctgagctctcgagctatcagattgctacgaccaccgagctccacccccgcgtggcggtgctgctcaacatcactcccgaccacttgggctggcataagagccataagaactacgcgcttgccaagattaaactgtttgacaatatggtcgatgacgatctggcggttgtcgacgtcgaagacgccggcattcacgagttcgatgagtacatctacacgccgggtcgtcgcatctgcaaggtcgcttttgacgagcctgagggcgaggatgccgcctttgtgcgcgacggcaagatggtcgtgcgcctgaagggggtcgagactcagcttgtcgccccgtccgagctcaagatttcgggccatcacaatgttatcaatgccctgtgcgctgccacggctgccctggcagtcggtgccgatgtcgatggtgtctgccgtggtctggcttcgttccagccgctcgagcaccgcgtggagccgtgtggcgagattgacggcgtgcgctacgtcaacgattccaaggcgaccaacaccgatgcggtcgagaaggcgctgacggcatttcccgatgacgacgtgatcttgctgctcggcggccacgataagggcacgccgctcacggacttcgcgcgcgttgttatggataacgtacgctcggtcgtctgctttggcgatgcgcgcgagcgtttcaccgccgctatggacgaggccgatgtcgatggcgatgtggatatcgcccaggcggatgacctgcgcgatgccgtggacgtcgcccgttcgctttcgagccgtggtgacgtggttctgctttcgcccgcttgctcatcgtttgatgagttctcgggctacgaggagcgcggccgcgtgttcaaggactatgtggcccagcttgccgccgcggcgaaatcgcaaacggaataggggttgccggtgagagaggagagcccccgacaaagcatgaggaggcccgactcggaccgtgcttcctcacggcgcagcacgccgcgttctggccgcggtgggcaaacgttcagcgaacgctatattgccggcgttcccgctcgcatcatgcgcccccgattggtatttttggcctgcttgttttcgctggtgtgctttggcttgttgatggtgtactcggcatcttcggtcgaggcgctgcacgagaacggttcggcgacgttctttttgtttcgacaagccgcgtttgccggggttggcgtgctggccatggttgccattgcccgctatttgccggacagctggtttggggaggacgtgctcaggatcttcctgttcgtcatgatgttcttgctgctgttggtgttcttagtgggcagcggcagtcgtggcgccacgcgctggctcaacatcgccggcattcagttccagccctccgagtttttgaagccatttgccattgcgtactcggcaatcatgcttgatcgcttcttttcgcccggtggcaacatcaacgagttccttagcaagatgggcatctgtttgggtccttcgatcctcttgatctttatccagcccgacttcggcaccatcctgatcatcttgctgacgctggtgtgcatggcgctgtttgcgggattggaccccaaatacatcgtttggacgattgccggcggtatcgctgtcattgcgattgccctgattgccgagccgtatcgtatgacgcgtgtcgaggtcgcttggaatccctgggccgatgagtacggagatggctaccaagccacgctcgccattatggcgtttgcatcgggcggcctgttcggccgtggcatcggcaactcaaccatgaagtactcgtatctgcccgaggcgcataacgactacattcttgccatcattggcgaggaagtcggctttgtcgggaccgttctgttcttcttggtatttgcgatgttgatttactcggcgttccgcattgctgagcaggcgaccgaccgtcgcggggcactcatggcgtcgggttctgcggtcattctcgcggtgcagtttttgattaacgcgctgggcatcctcaacgtgtttcccatgacgggaaagccgctgccgtttatcagttacggcggctcgtcgattatcgtgtcgcttatgcttgccgggttgattctgcgcgtttcttacgagagcgcccgccgtgatgagtacgaccgtcgtcgcgagagctttgccgttatggacgagagcactgccggcgtgccccatgtgcgcggcgagcgatcttcgcgcaatggctttaccgttttggatggcttagcgtccgagccggctgctcgtccgcgcccacgaacggcgccgcagggtcgcccacagcgccccacgcctcgcaacgcgggcggcagatataatcgaatcgatttgaattcggacccgtcggcgcgcttgcgcaccgatgaccaggggccgcgcgtacgaagggactaccatgaccgataagatgaccgttgctatcgcagccggcggcacggcaggacatatcaaccccgcgctcgccttggccgaagagctgcgtaaccgcgggcatcacgtcgtgtttgtgggtcaatcgcacaagctcgagggtcgtcttgttcccgaggccgggttcgattttgtgcccatcacggtcacgggcttcgatcgttcccgcccttggaccgcactgacctcgctgtggcgcgtcaacaaggccaaacgtgcgctcgccaatcatttctcaaaggtcggtaagcccgatgccgccattggtttcggtgcctatgtcgaggtgccgctgttgggctggtgcaagggtgcgggtgttccgtatctgctgcatgagcaaaactccgttccgggcctggccaacaagatgatgaactcccacgccgcccgcgtgtgcatctcggtgccggcagcgcgttcggtctttgagcgcgaaggtgaccctgaccacgtgctcatgaccggcaaccccgtacgtcgctcggtgatcgagggcgatcgcgctcgcggccgcaaggcacttggcgtacccgaggacgctacgctgctgctcgtctttggcggttcacttggcgcccagcacctcaacgagcgcgtggcttcgctcaaaaacgagctgctttcgcgcaagaacctctatgtgttgcattcgacgggagccgacggctttgaggagaccgaacgtgctctggcactgacgcccgaggaggcgaagcgctatcgcgtgcagccctatatcgataacatgggcgacatgctggctgcggccgatctggtgctctcgcgctccggcgcctcgagtgtggccgagatcgccgctctcgccgtgccctcggtgctcgtgccgtatccgcatgccacggccgaccaccagaccacgaatgcccgctatctggtcgatgccggtgcgggcgtgctttgcgccgatgccgatatcgatgcccccgcctttgccgaggagctgttgcacctggtcgatgacgccgcggcgcgcgacgccatgcgccaggcggcacgcggcttggctcaggatcgcgccgccgcacttttggccgacgcggtagagggattgcgttagttagacgggatatcgccggtcgccctcgcgcggatgcggtaggtgcggtacagttaacgggttacaggcagtgtttacgcaaggagtacacgagcacatggctgattcccagactgcaacctccgcgcccgagtttaagagcgcccacttcatcggtatcggtggcgccggcatgagcggcatcgccctcgttttgcacgagcgcggctatgccgttaccggctccgaccttaagacgtcgcgctacattcgccagcttacgcgcgccggcgtgaaggttcacgttggccatgaggctgcgacgatcgacgaggtcaagcccgacgtggtcgtggtctctaccgctattcccgagtctaaccctgagcttgttcgtgcccgcgagctgggtattcccgtgtggcctcgcgccaagatgctctcggcactgggccacggatataccaccgtcgccgttgccggcacgcacggcaagaccacgacgtcttcgatgtgcgccaccatgctcgatcgcatgggcctggaccccagcttcttgatcggcggcatcgtcgagggctatgacaccaacggtaaaaacggctcgggcgattactttgtcgccgaggccgacgagtccgacagctccttcctgttcctgaaccccaacgtggtcatcgtaaccaatgtcgaggccgaccatctcgatcactactcgggcatcgaggagatcgaggccacctttgccaagttcatgagcctggtgggcgaggacggtaccgttatcgtctgcggcgaggatccgcatctggtcgagctcgccaagtcgacgggacgccgcgtgctttcctatggctttgccgagaccaacgacatcgtctgcgtgcatccggacgtcaagggcatccagagcgactttaccgttcgctttgaggatggcaccgagcacgctgtggagatcaagagcaaccccggccgccacaacatgctcaacgccacggccgttttgaccgtcgctcacgtcctgggcctcgacatcgatgctgcggccaaggcactgtcgagctttgagggcgttcgccgtcgctttacccatgtgggcgatatcgacggcatcaccgtggtcgacgactacggtcatcatcccaccgagatcaaggcgacgcttgccgccgcctcgtcgctgggttataagcacgtcgacgtcgtgttccagccgcaccgctattcgcgcctgcaggccctgtgcgacgatttcgccgatgcctttgccaatgccgacaaactgctgctgatcgacgttttctcggccggcgagatgcccatccccggcgttacctccaagatgctcgccgataccgttcgtgccaagcatcccggcaaggaagtcgtgtactgctccagccgtcttgagctcaaccaggagctcgagcagatggtgggcgagggcgacctgctgcttaccatgggcgccggtgatgtcacgacggtcggccccgagttcatcgattatctgactgccaagaaagacgcttaagctccatgggtctgtttaatgccgtcatggcgctttcgggcatgatcgacacggatgtgattgaggacgagcgacttgcgcgccatacgagctatcgtatcggcggcaaggccgacctctttgtgacgtgccacagctatcatgccctgcgtcgtgccgtggcggtgctcgaccgcgaacaggtgccgtgggtgattatcggcaagggatctaatcttttggttgccgatgccggttatcgcggtgccgtcatttcactggggcgtgagttccagcgcacggttgttgccgaggacggctgtacgctgaccgttggcgcgggcgtgatgttcgcgcgcttggtcaacgacgccctgtctcgcagcctctcgggtcttgagtttgccgtcggtattcccggctcggtcggcggcgcgatatctatgaatgccggtacgcgtaccgagtggatcggttcgctcgttgaggatgtcgtaacgtttgaccctttctccggcattaagcactatgcggggtctgagataacctggggctaccgcgaatgcagccttcctcgcaatgagattatcctcgagtgcgttcttaagctaaagccggctccgaaagccgatatccgtgagcgcatggagcggtatctgactcggcgaaagcgcacacagcccatggggcgcgcatcttgcggatcggtctttcgcaatccgcccgatgcgagcgtgggcaagcttatcgaggattgtggattaaagggtttttcggtcggcggcgcggaagtttcgcccgtgcacgctaattttatcgttaacaacggaaccgcttcggccgatgatgtggccgcggttatcagacatgtgcacggaaaggtgagggaggcgtatggcatcgagctcagaccggaagttaaattcctcggcttctagagcatcgaaacccaccttccgccgcgccggagggcgttccggcgcacctgccaaacctcagcgcaaggccgtcacgccttcgaagccctccgggcacgtgcgacctgccaagcgtccggttgtcggctcgcagctcggcaaccatcctgccgcaaaaaaggcctcgcgtccctcggtgacgtcaaggtccgtcatgggcgccaagtccgctcgtcccgtggcaacgcctaaaacctcgatgggggccaaagcgccgcgtccgggccgcacgctgggtgcatcgaagccgcgttcgctgacgtcggtgccggctgccgctaagaaaccttcgagtaaaaaaggcgtcaacccgctgacttcactgggggctatggctaataagacgaccgacgccgttcctgccgttaagggcaaaggcaaaatcgtgggcggcgttcttgccgccttggccgtgctcgtcatcattgccatcatagtgatcaactctggattgtttgccgctaccgacattcagattcagggcagcgagcatgtgaccaaacacgatgccattcaactgatcgatttgcccgagggcacgtcgctgtttaacgtcgaccccgatcagatcaccgaggacctcaagcagaacccgtgggtttcgggcgttgatgtccagcgccagttcccccatacgctcatcattacgccgacggagcgcaaggttgtcgcaattgcctatatcagctcggacgatcttgcctgggccatcggcgatgacgatacctggatcgctccgctttcgacctcggttgaggtggatgaccagggcaacgtcattacgatgggtcagggctcaaacaccctgaccggcattgatgccgcgctggcactggccaagcactacggcgccgtgctgttgaccgatgtatcggccgatgtcgccccggtctctggccaggcggtgagctccaaggcagttaaggccggcttggactacgcgcgcggtttttcgagcgagtttctggggcaagtcaaggatatttccacgccttcggtcgaggccatctcggcaaacctcaataacggcatcgaggtgtcgctgggcgattctaatgatattgccaagaaggagcgcattgtcaccaagctgctttcgcaggtagagggcgtgacgtatatcaacgtgcgctctccgggcaactatacgtttaggaacgcacccacctcatagcggcgtttgggcctttgttgacaggccataccacgccgtttatctggtttgtttggttttcacggtcaattatttgactgatacgttcataatgtgcaaacataatacggtttacctttgcatttactttcaacctgaaggttaacgtgcgcaggggtcgacccatgctatggctataacctttgttcggaggaccgacatgcacgagacagagatcaacaactaccttgccgtcattaaggtggtcggcgtcggcggcggcggtaccaacgcggtcaatcgaatgatcgaagagggcatccgcggcgtcgagtttgttgccatcaacaccgatgctcaggcactcgcgatctctgatgccgatatcaaggtgcacatcggcaccgaccttacccgcggcttgggcgccggcgccaaccccgaggttggccgcaaggctgccgatgagtcccgcgacgacattgccgaggcgcttgctggcgccgacatggtgtttatcacctgcggtgagggcggtggcaccggtaccggcgctgctcccatcgttgccgatatcgcgatgaacgaggtcggcgcactgaccgtcgccgtcgtgaccaagcccttcaccttcgagggccgcaagcgcaagaagagcgccgaggagggcatcaagaccctctccgattgcgtcgacaccatgatcgtcatccctaacgataagctgctcgacatcgccgagaagaagaccaccatgctcgaggccttcgcgattgccgatggcgtcctttcccagggcacccagggcatcaccgacctcatcaccgtccccggtatcatcaacctggacttcgccgatgttaagaccatcatgaagcaggccggtaccgccatgatgggtatcggtacctcttctggggatactcgtgccgtcgacgctgcccagcaggccatctccagcccgctgctcgagagctccatcgatggtgccacgcgcgtgctgctctccatcgccggttccaaggacctgggcatccaggagatcagcgacgccgccgacgttgtcgccaacgccgtcgaccccgaggccaacatcatcttcggtaccgttgtcgacgagtccctgggcgatcaggtgcgtatcaccgtcattgctacgggcttctccgactccaacgtcaaccgtcaggatgagctctttgctgctcagcagtctcagagcaaggccgctgcctccgctgagccgcagcgcaccgctccggctgccagcccggctcaggccgctccgacccgcaacgtcggtggtaccgagctgcccaactttggcaacgaccagttcgagcttcccgacttcctgaagcgcggtagcttctagttcgtttttctcaacgacctgcacggggtgtgtccatttggatgcaccccgttttgtttctcgtttgtaaacgaaagcctccaatctccttacgttccctttacgtttggtccctaccgctgcgggtatccttttaaggaagtatgacagccgtataaacgcggactgcgcggcgacgccgcggtacttgtgttattaggaggctttagtatggcagcacgtgcggacagggtttcgcgtgtcgaccatgatggagttacgttggtggagggcgcgacatccgatgtccgctttgcctttaccgagcgcaccggtggtgtttccgaagatgcgtactcctcgctcaacctgggctcgcatgtaggcgatgacccctttgcagttcaagaaaatcgtcgtcgagcgctcgaagctatgggcgccactgagtgcgagcataatctgctcgtgcccaatcaggtacatggtgaccatatcgttacggtgacttcgaacagcgccgacgatcttgaggctgttcgcgagcagattgccgagggctgcgatgccatcgtctgtacggcccatgacgtgcccgtgctgctctgctttgccgactgcgttcccgtggtgctggtggcccccggcggatttgccgtggtgcactccggttggaagggcacgattgcacgtacttctgccaaggcgtgccaggcgctttgcgatgctgccggctgcgatgcgagcgacgtttccgcctatatcgggccccatatcctgggtgacgagtacgaggtttcccaggagctcatggatcgctttgccgccgagttctcttgcatcgatgcgagtgcctctcgcatgctcgatctttccgctgccatttgcgaggcgctggtagatgtcggtgtcgacgcggataatatcgtggatacccagctttcgaccgtgcgtcagaacgaccgcttttattcctaccgtaacgaggacggcacctgtgggcgccatgccgcgatcggcgtgatgctatgagaaagatcgtatcggtcctgagcgccgctgtgcttacgcttacgctgtgcgcctgttcttcgggatcttctacctcttccattaccgtggccggctccacgacctgccttcctatcgccgaaattgcggcagagggctttaaggaggagaccggcatcgacgtgctcgtttccggtttgggctcttccgctggcatcgaagccgtcagcgctggcacggccgatatcgccagctcctcccgtggactcaatgccgacgaacaggatctgggcctgactcccatcgtcattgcccacgacggtatcgcggtcatcgtgaacgaaggtaaccccgtcgataacctctcgaccgagcagctccgcgatatctatgccggcaagattactaactggaaagaggtcggtggcgaggacctgaagattcaggtcatcaaccgagacgaggcgtctggcacgcgtgaagccttccgcaccatcgtgatggacggcaccccgttcgatcgccgctccgccgttctttcgggcacgggccaggtgcgcgacgtggtatctcgttcgcgcggggctatcggctacatttcgctgggcttcgtcgatagcctcaacgccaagacctcggtcaaggccgtctcggtcaatcatgttgaggcgtccgagaagacggtcgcgagtggcggctatcccatctcgcgcgacctttacttctttgtgaagggtgcgccttcgcagcaggcgcaggattacatcgactacgtgacgtccgaaaagatggacaagcagattcgcgaggcgggctttattcccgtcaccaacgacgagaaggggagtgagtagcatggaagcacaggaaaactcccagactgagcagaatgctcaggcgcccaagaagcgcgagctggcgctcgtatcgcgcagcacctatatcaaggagaaggcgctgcagtggattttctttgcctgcgcgttcttggcggttgttaccgtcatcctgatttttgtctttaccacgtactcggcgctgcccgtctttaccgacatcggtctggcggacttctttagctttacgtgggcgccctctgagggccactacggcatcgtgtcgctgcttgccggctcgggtctggtgaccgtcggtgcgctcgccatgggtgtgcccctaggcgtgggcacggccgtgtatctggtcgagatcgccagcaagcgcgtgcgcaagctcatcagccctgccgttgacctgttggccggcatcccttctatcatctatggcttctttggcatgatcatcatccgtccgtttatcgcgcaactgaccggtggtcttggttttggtgcgctgacggcgtggttcgtgcttgccatcatgatcgtccctaccatcaccacgctcaccatcgatgccctcaattccattcccatgggtattcgcgaggcatcgtatgccatgggtgctactaagtggcagaccatctataaggtcgtgctacctgccgccaagctgggtatcgtggatgccatcgtgctgggtatgggccgtgccatcggcgagaccatggccgtgctcatggtcgtgggtaacgccccggttattcccgacagcattgcgagccccatctcgacgctcacgagccagattgcgctcgacatgagctattcctcgggtctgcatcgctcggcgctgttcggcatgggcgtggtcctgtttatcatttccgccacgctggtgggcatcgtccgcctggtttccaagaagaagagggggtaggctatgtccgattccgttgacacgacggtcgatacgacctcgtcgcgcgagcgcatcaagcgtgccctttcccacggcaagaagggccgcatcaacaaggacctgtccaacaagatcatgcttggcgtgttccgtgccgcggcatacatcaccacgctggtgctggtcgctatcatcgcctacgtggtcatcaacggcctgccacacatctcgctcgactttatcttcggttggccccagggcgtcaacgccgagggcggtatttggcccacgatcgtctcgaccgtctatgtgacggcgctcgccatgcttatctgcacgccgatcgctgtgctggcagccgtctatctggccgagtacgccaagcagggcaagatcgttgagctcattcgctacgctgctgacgctttggcctcggtgccctccatcgttatgggcctgtttggctacgccttgtttgtcgaggctatgggtctgggcctttcgatggtctcggccgctctggcgcttgcgctcttgatgcttcccatcgtcatgcgcaccaccgaagaggccattcgcgccgttccgcgctatatccgttggggcgcgtatggcctgggcgccaccaagtggcaggttgtctccaagatcgtgcttccttctgcctttggccgtattgccacgggcattgtccttgccatcggccgtgccattggcgagaccgccgtggtgctctacaccatgggccaggccatcaatctacctatctcgccgctcgattccggccgccccatgaccgttcacctgtacctgcttgccaacgacggcatcaacatgaacgcagcctacggcaccgcgctattgctgatggtgatcattctggccttcaacctgtttgcgcgcttcctgtcgcgcaagcgtcgctagttaaggagtcccatgtccgtttatcagtccgctcccacgctggagcaagcggccattacggccaaggatttcaacttttggtacggtgactttcatgcgctgacggggctcgacctcaacatcgccaaaaacgccatcacctccttcattggcccttcgggctgcggtaagtcgacgtttttgcgctgcatcaaccgcatgaatgacctgatcgagggtacgcgcgtcgagggcaccatgacgctcgacggcaacgatatctatgccgagggcgtcgacccggtcgacctccgtcgccgcgtgggcatgatttttcagcagcccaacccgtttcccaaatccatctacgagaatgtcgcctttggccctcgtctgcagggcgtgactagcaaaagcgacctcgatgacatcgtggaagaatcgctcaagcgcgccaacctctggaaagaggtatccaatcagctcaacaaggatggcttggcgctctcgggcggtcagcagcagcgtctgtgcatcgcgcgcgtgcttgcggtgcaacccgatgtcctcctgatggacgagccctgctccgccatcgaccccacgtccgtctctaaggtcgaggatttgatggccgagctggcgcccgagatgacgatcatcatcgtcacgcattcaatgcagcaggcagctcgtatcagcgactacaccgcattcttcttgcaggaagttgccggtgagcctgccacgctcatcgagtatggtcaaaccgacgcgatcttcaccagcccggtggactcgcggacggaagactatatcaccggccgctttggctgatcggtgcgactagtcccaagccgatcggacctggtccggtgcgtattcactgtgcgggcggcatgaccgcacccaactgattggagtgaaccatgcgtaaactgttttcccgtcagctcatcgaggcccgccacgagatgctgagcatctacgaggccgtcgatctggccctccacgatgccgttaaggcctatgtgaccgacgaccgcaagctcgccaccaagaccaagaagcgcacgctttcgattgacgcgcgctgcgccaacttggaggccgtgtgctacaacctgatcgccacgcagtcgccggtcgcctccgacttccgcttgctgcagacgattatctacgtcgactttaacctgcagcgcatgaccgataaggttcgccagatctgccgcgccacgcgtcatatgatcaaggccgacatctcgctgcccaaggagcttgtcggcacggtcgaggccgaggctgaggccgtctaccaggtgctgggctcttcgctttctgcgctcgtcaccaatgacatgtccatcatctgcaacttggccgtcgaggacgagccggtgcacgccgcctacgagaagttcttccgcacctttaaccgtatggatacgggcgactttatggacgacgacagcaactacgatgacctgcgccgcgccatcatggtctcgcgctaccttgatcgtatcgcctcgatttccatcgatgccgcctgccgtctgaccttcctgctgaccggtcagcgcatgaacaccggcgatatcgcccgcgcggacgaggatgagctcgagagcatgcgcgtgccttcgggcgagggcgttatcatgaggcccgccgtcgacgcgcgctatgttgccaaggtgcccgccaacgagctgagcgagggtcttcgctacctgcttgagcaccttgaggatgaggatgacgccgaggacgacgaggagtagggtgaccccgttcgtcaaaagattgtaaatacccaagtgagcgcgaccttgcgaatgcagggtcgcgctcttgcgttagcatgagactacttgtttggctgtctgcggaggcgattggcaatggataattatttggacttgatgcgcgctcgccgcgagcagattctcgagcgtttttatgccgcactcgatcgagcgggccgctcccacgatgccgcgcgcctcatcgccgtgtccaagaccgttggcgtcgatgagactgtcgctgcgattcaggtggggtatcgacactttgccgagaaccgcccgcaggagctcgtccgcaagctcacgggcctggcggagcatccggagctgcccgaggtgcgcttcgatatgattggcaacctgcagaccaataagatcaatgcggtgctgggctcggccgagctgattcattcggtgagctcgctgcatttggcgcaggctatctcgagccgtgcggtccgcaagattgaggcgggtgagcttgccggtcctcagcaggtgctcatcgaggtcaatgtgagcggcgaggaatcgaagggtggcttttcgcccgatgagattcgtgccgccatgggcgagcttgcagagctcgagggaatttgtgtgcagggccttatgactatggcaccacggggtaataaagatgtggcgcgccgcacctttgccggacttcgcgagctaagggatgagcttgaggcgacgcactccgatctgagcctgcccgaactttcctgcggcatgagcgaggactttgagcctgcccttgaggaaggctctacgctcgttcgcctgggcagggtagtatttagcccggagtttgcagtaaaataaggctctgaagtgcgcactgattatcggagcgcctgcactaaaccgcgagaggacacaaccatgggcttccttgacgagattaaaaataagatgcacctgggcggccagcagggttacgaccagggttatggtcaggacgacgactacggctacgatgatggctatgacgacggctaccagaacaacggttacagcggtgcctcgggcgagggcttctacacccaggatgagccgagcaacggcctgttgggtcagacgcgccgcggcgaggccgagtcggtggccgtatacacgcgctccggccagctggtcggcgatgactcccgccatgccacgacgtataacccgccttcgcgctcgcaggacagtgttgcgagcggttatcgtcctggtgcctatgacacgccgtcgagctacgccgagaatacccgcgcccgtgccgccgctgcacccgcgcctgcaccgagcgatgcctcggcctatgcgagcaatatcatcaacgccacgccgcagctgccggcctatgtcctgcgccccgagagctatgacgacgtggagaccgtggtgcgccgcgttcgcaccaagcagcctgtcgcactgatttttgtgggcgtacgcaccgaagttgccaagcgcgtcttggacttctcttacggctttgcctgcggtctgggtgccacggtcaaggaggtgggcgaccgcgtgttcatggtgctgcccgccggttgcgaggtcaaagattccgatctcaagaagcttcgtgccgacggctaccttaagtaaagacaagacgaggagattcccatcaacatctacactatcgtccagctggtcaacacgctgttcaacttctattccacgctcattgtcgtctactgctttatgacgtggattcccatgaagcagggtggtttgcttcaggatattgccgcggtgcttgatagcgtgtgcggtccgtggctcaacctgttccgtcgtttcatcccgccgatgggcggtatcgatttttcgccggtcgttgcgattattgcgttgcagttggtgcagaggctggttctgcagcttcttataggtatactcgtgtagaactgacttagtaacttacgtcgggcgtgtagcgccgaggcgatgaaaaaggagacttgttatggctattacccctgcagacatccaggctcagactttctctgaggccaagcgtggctacgatcctgctgaggtcgacgtcttcttggagacgctgtcctccgaggttgacgctatgctcgctaagattgtcgaccttaagggtcgtctgactgctaccgagcagcagcttgccgacgcacaggctcagcttgcccaggctcaggatgccaccgcccaggccgttcctgccgcccccgtggctgctcccgcccctgacttctccgctcaggagcgccagatttccgctgccctgatcgctgcccagcagaccgctgagaccatcgtcaacgatgccaacgagaacgctgagcgtatccgcaacgaggctgacgccaaggcccgcgaggttatccgccaggctctgaccgagaagcaggccgagctcgaggaaatcgaccgtctgaaggcttcccgcgaggagttcaaggccgagtacctcaagctcatccagcacttcatggacgatgcccagaactccttcccggccgacctcatggcctccacgccggtcggttctgccgcttctcctgcggtgactgttcccgccgagccgctgcccgtcgctgacccggttgtccccgtggccgatcccttcgccccgatcgacaactttgccgccgacgacctggattagcattagagctataatctagtgtccttaagaggagctcgcacctgcgggctctttttttgtggctgtatacgggttgggaaacaaaacgccgagctctgcatgcgataggacagaactcggcgaagggcgcgtggtaaaaggtagattttaaggtatgtctaaaaactacttgaggaggaagttggagaggggaatggtgcgggcctcgcgatgctcgggatcggcgatgtggtcggcgggatagccacagacgagcatgtgatagggatagacgcccttgggcagattgaactgctcctctgccacctcaggcttaaaatggcatacccagcacgttcccaggccctgctcggtggcctccatcatcatctgatcacacacgatggacgtatcgatttcactggaattcatctggtcatacgggcgtacccaagcatcatcggtaacgctgcaaataaggaagacaagcggagccccaaagatagacccatcacgagcaaaccgaggctgacaagcagcagccttctccagaagctcaggcgtatccagcaccatcacacgggttggatgattattacaagcagaaggagcaatccgccccgcctcaacaatggcatccaccacagcttgctcaacagaacgattctcaaactcgcgacaagaataccgaccccgagccagatccaaataagacatacaagccctcctaaaattaaaaatcaaacaaacccaaagtaacccaaagagtacccaaagcagcaatcggccacacgctcatcaagggccaaagtgtccgaacgggtaccaaaggtcccttcagccaaacccccattgcgctacaactatcagccaaagttcccaatggtggtacgtaagggagcgggcccgaccactaataccttttgaacgactctgcttgcagccggagtgaaaaaggtattagtggtcgggcccgcgaccggtgggatacgtgcccctaattaactgttcttcatgacaatcgaatccacaacatcggccacattctcacagcagtcagcgcagtactccaggaaggcgtagacgtcacgccaggcgatgacctcgagcggatccttgccgttgacatgcaggttgcgcatagcgttgatgtagagctcgtcggcctcggactcgatcgtgttgatctggatgacgagttcgcgcagggtcttggacttgcggtagttgggcagctcgaccatcaggtccttcatggcgcggcaggcgtcggtcaccttgtgggcgatcacgatggcatcgggatggatgccctggatgttggtgaagtagacgcgctgcacgacgccctcgatacggtcgagcacggtgtcgagcgagcagctcatcaggtcaagatcctcgcgctcaagcggcgtgatgaaggccgtgagcagggcgtcctcgagctcatggtgcttcttgtcggccgcatgctcgatcgcatgcatcttgtcgagcatatcgtggatctgcgcgggatcgaagttctcgaaaatctgggtgagcaactcggcggcctgaacggagaggtcggcgcaggcgacgtagttgtcaaagtagaacgaatcgggtttctttgccatgggtgggtcctttcgaggcgaagacgggtgggcgaagtattgcggtccggatggacgctcggtttgactagaggaacatcatgaacagcttggccatgacaaagctgatgagtccgcaggcggggaaagtgaagaaccaggtgaacatcatgtccttgaccacaccgaagttgatggccgagaggcgcttgacggcaccgacgcccatgatggcgcaggtcttgatgtgggtagaggacacggggatgccggtgagcgtggcgagcagcaggttcgcggcgcctgcgaggtcggcggagaagccctggtacttctcgagcttgaccatgctctggccgacggacttgatgatgcgctcgccgcccacgctggtgccgatacccatggtggcagagcacagcagcatgatccagatggggatgccggcatcgccgacgctggtctggccgttggcgaaggcgacacctaaaaagagcacgccgatgaacttctgcccatcctgcgcaccgtgcataaagctcatggccgcggcactcgcgatctgagcgtatttaaagaagacgttggcgcgtcgcctgttggcggcggcgaacagaatcgagacgagcttgcacaggacccagcccatgacaaagcccaggccgatggagagcgccaggccgtagatgaccttcatccactcgtggacgttgacgctgctcgcgccgccgagggcgatagcggcaccggtcaaaccggcgataaggctgtggctctgcgaggtggggatgccaaagcgcgatgccgtggcaccgtaggcgacgatggagaacagcgccgcacacaggcaggcgagcgccatggtgctgtttccgccaaagtcgacgatatgtgagatggtgttggcgacgctcgcgttaaagtgcgtcatgatgagcacgcccaggaagttgaacgcggcgctcatgaggatggcggcgcgggcgggcatgcaacgcgtggtgacgcaagtcgcgatggcgttgggcgcgtcggtccatccgttgacgaagatggcgccgagcgcgaggagcacggtgacggcaaggactgggttcgacacaagttggccgaggaaggttgagaacgttacgtccatgtaagggctttctcgaagtttgcagacacgttacaaaagcatgataaatcgtatcacctcctgcgggtttctttactgagttctgatgggagaagtgaatttttggccttgaatatcaacttcatccgaacacctcccatattcatccgtacatgtacggacaaaggaaagcacttaatgtgctttccgtcttgcgcaggactgtagagcaggaaacttcatatgcggccctcccgggcgcaagcaaaagggcgacccctgtccggagtcgcccttgttgagctgcttatgtttagctgttactcggcgtcgtggtgacggcggggcttgcggcctccgttgtcgccgggacggcgcggacggtcgctgcgctcggagcgctcgcgacgcggacgctcacggcgctggaagtgctcgccgtcgccctcggaggcaccctcggcgcgagccggggcctcgggcttgtcaaggcgatcgagcgagatcttaccgcgatcgtcgacctcgatgacgacgaccttgacctcgtcgcccacgttgaggacgtcctcgaccttctccacgcggcccttggcaacgcgggagatgtgcagcaggccgtccttgccgggcagcagattcacgaacgcgccgaagggctggatggaaaccacgcgaccggtgtactcctcgcccggctcgggaaccttgatgatgagcttgatgcgctcgacagcctggtcgacggactcgccggtgccgccgacaaagacggtgccgtcctcctggatgtcgaccgaggcgccggtctcgtcctggatgccgcgaatgaccttgccgccggaaccgatgacgtcgcgaatcttgtcggtcggaacctggatggaaacgatgcgcggagcggtgctgcgcgtagtgtggcgcggctcggggatcacatcgagcatcttctgcaggatgaaggcgcgaccctccttggcctgctgcagggcgcgggccaggatgtcgaaggtaaggccggtggccttgttgtccatctgcagggcggtgatgccctcggtggtgccggtgaccttaaagtccatgtcgcccaggaagtcctcgagaccctggatgtcggacaggaccacggtcttgccctcctcctggatcaggcccatggcgataccggagaccgggcgcttaatgggcacgccgccgtccataagggcgagcgtggagccgcaggtcgaagccatcgaagaggaaccgttggactccatgacctcggagacgacgcggatggcataagggaactcgttctcgtcggggagcaccggaagcagggcgcgctcggccaggttgccatggccgatctcgcggcgcttggggctgcccatgcggccggtctcgccggtgcagaacggcgggaagttgtagtggtgcatgtagcgcttgccctcggtgggctcaatagtatccagacgctggccctcgttgagcataccgagtgacaggacggagagcacctgggtctggccgcgctggaacaggccggagccgtgaacgagaggcaggtagttatccttcaccatgatggggcgaatctcgtcggcggcacggccgtcgacgcgctcgccggtctcgacgaccatggtgcgcatggccttcttctcaagcttcttgagcgccacggggatctcgcgctcccaagcggcctgctcctcctcggtgaactcggcgcggatggactccttcagagcctcgaccttaccgatacgggaaagcttgtcggcatcgcgaagggcggctgccatctcgtcgtagtgggcgaagatgcgctcctggacctcctcgacgggctgatcgagcgggtactccttcttgacgatggcaccgttgacctgctcccactcggcaacgaactcgtcctgagcctggcagaaggcagcaagggcctcctggccaaacttcatggcggcgagcatgtcgtcctcggagatctcctcggcgccggcctcgaccatcgagatgaagtcggcagagccgcccagctccaggtccagatcggagttctcgcgctcctcgtaggtggggttgacgataaactcgccggtctccacgttgcggccgatgcgcacgcaggcaagcggaccctcgaagggcacgccgccgagcgtcatggccagggaagcacccatgacgttgatgacatcgaagggattgacctggtcggcgacgagcgaggtagcgacgatgtgcacctcgttgcggaagccgtccgggaagctcgggcgaatcggacggtcgatcatgcgcgcggtgagcgtggccttctcgctgggacggccctcacgcttgaggtagccacccgggatgcggccggcggcgtacatcttctcgttgaagtcgacggtcagcgggaagaagtcgtagttcttacgctccttggagacgaccacggtgtcgagcatcgtggtgtcgccctgcttgaccaggcaggcgccggtggcctgcttggcaagctcgcccgactcaaaggtgtaggtcttgccgtacagctcaaaggtcttggatacgagtgtcattgttctccttaaccccgcagaccccttgtctgcgggcttctcatgtgacgcgggccccctgcccccgccacgcttcagagcgtgattgttcgcgcccttacacaaaaagagcgccccgctgcgcaggacgctcttagcatgtacaaatcctactggatgttgtcgcggatgcccagagccttgatgagctcacggtactcgacgatgtcgttcttcttgatgtaggagagaagacgacgacgacggccgacgagcatgagcaggccacgacgggtgtggaagtccttctggtgggacttcatgtgctcggtcagctccttgatgcgctcggacaggatggcgacctgaaccttggggttgccggtgtcgaccggggtgttaccgaactgggcagtcagctccgccttgcgctctttggaaacagtcattgtttcacctttcgttttgcgtcgcccacgggcgactcgattcgcctcggactgggaagccgccggtggagcgaacaaccaaggtcgaggtaccaacaggtcggtatgttaccacaagcagcccgcgcctgcgcatcatcaccgacccaacatgaattccatcgcgcggaggcgctgatcggtgtgcgtcgcagcccaaacatgcgaaagcccgagcaggaatgccgccgtatgcgggtcgattcgctcggccatgagcgcatcgaaggtcatggacatgagggcgcgcagccatgcggtctcaccggtcgacaccagttcggcacctggaacgctcgacgcgcacgacccgcacatgagaccgcccgcctgggctgaaaaatacgacagcatggggtctccgcacagcacgcaggccgaaaaatcgggtcgatagccaacgtgcgacagcagcttaaagacatatgccgccacaagtagatccatgtgcgctgtgtcgagcccgctgcccgccagggcaagcgctcgctgcgtgatggcaaaggtgaacgggtcctcagcgtcctcgaacgagcatacgcgcgcgacctcggcgatcgcgcttgcggcgcaggtcgtctcgtaatcgggcgtagcgctgagcggcgcctccataagctcggcctgggaaaccacgtcgagcgaccgtccatgcgcgagcagcatatcgacggtacagaacagctcgcagcgcgcagccaggcgcccaccgggtttgcgggcgccctttgccacggcacgaacctgccgaccccgctcgtcaagcatcgtcaggatcaggtccgtctctttaagcttcgtcttgtcgaggacgagcaccttggtgcgatatgtccgggagcctgccatgcgcgccgcgcgtccttagtcctcggcgttgtagccaaagcggcgaatctgggcctcgtcgtcacgccagccggccttgaccttcacgtccagctccaaaaagacctgcgtgccaaaaatgcgctcaagatcgcgacgggcgtcgataccgatatgcttgatcatctcgccgcccttgccgatgatgatgcccttctggccctctcgttcgacgtaaatggtggcgtgcacgcgcagcaccttcttggtctgctcgagcgcatcgcagatcacgccaacggagtgcgggatctcatcacgagtgcggcgcaaaaccttttcgcgcacaaactcggcaacgagcgtctcatcggaagcgtcggtacccatgtcctcggggaaccaacgcggaccttcgggcaaaaagtgcgcaacggtctcgataaaggcatcgacgttgaagttcttgaccgatgacgtcacgatctcgtcgtcatattccatgagctcgtgggcagccttaagctgctccatgacctgtgcggggtcggcctcatcggccttggtgagcaccaggaccttcttggaacgagcgcatctgacgcgctcggcaacccaggcgtctcccctgccgatcggcttggtggcatcaatcaaaaacgcgacgacgtcgacatcgttcaactcgaacagtgcgctcttgttgagctcggaccccaggccgtccttgggcttatgaatacccggggtatcgacaaagaccagctggtagccgggacggttgacgacggcgcgcatgcgacggcgggtcgtctgtgccaccggcgaggtgatggcgacctttttgccatagcaggcgttgagcagcgtggacttgccggcgttgggacgaccgaccagggccacaaaaccgctgcggaaaccgggctccacgtcgccaaagcccataggaccgtcgtcctcgtcgcacagggagtcgagttcctcgtcgctcatgccctcaaacgggtcgaactcctcggcctcgtcaaacgaatcggcaccttcagcctcgtccaggacctcgtcatccaaaatctcatcggtaggctgcatattgtcggacatgggaatccctttctaaataaagccgagcgcgtgggcaaagacaagcaagcccacaatcgcggcggtgatggaaagaacgtatacagaggcggcggcgatgtccttcgcacgcttggccagcggatggagctcctgggtcgctaggtcgacgatagcctccatagcggtgttgcacagctcgccgtgaatcaccaggccacaacagatgataatcgtggcccactcggcaatgtcgagccccacgatacagccggcgatgacggtacacacgcccgccacgagcatgaccttaatgttgcgctcggtcttgacggcggtaacgaagccctccatggcgtaggaaaacgactttaagaaggacggatggtccttgttcgatccgggaatcatagacggctcctagtcgtgggcgtggttggtgatggggccgacgtggactagcttggggtcctcgccgcgctcgagtgccagatcgcgcaggatggcgtcctcgcgggcctccataacctcggcctcgtcgtcctcgatgtggtcatagcccagcaggtgcagcatgccgtgtacgagcatcaggcggcactcgtcagcggggctattgccaaaaccgggggcctgacgggcaataacctgcggggccaagataatatcgccgagctcgagcgtctcatcggcgggaatgtcatcgtcgaaggccgaatcgcactcaaacgaaagcacatcggtggtgcggtcgataccgcgccactcgtggttgagctcgtgcatctcgtcctcgtcgacatacgaaagggaaatctcgactccacgttcaacgccctcggcggcaagcacaacctcgcagatgtgctccacctcctgcgcgtcgagcagcgtatcgagctcggcatcgttgctgatcaatacactcaacgggactcctttcggtcgcgcgggcgctgctcgcgcacgtcatcataagcttcatatgcctcgacgatacgacccaccagggcatggcgcaccacgtcggcacgctcgaggtgagaaaatgcgacatcgtcgacacggcccaaaatctgctcaacgtcagcaagaccgccacgacgacccaccaggtcgcgctggctcaggtcgccggtaatcacgaacttggagttgaacccaaggcgtgtcaggaacatcttcatctgctcgggcgtggtattttgcgcctcgtcgagcaccacgaaggcatcactcagtgtgcggccgcgcatgtaggcaagcggggcgatctcgatcacgccacgctccataagctcatcggtgcgctcgcgatccatcatgtcaaaaagggcgtcgtagagcggacgcatgtaggggtcgatcttttcctcaagggtaccgggcaaaaagcccagattctcccccgcctcgacaaccggacgcgtcaagatcagacggcccacctcgtgacgcttgagcgcggcaacggcgagcgccatggccagataggtcttaccggtaccggcaggacccaggccaaacgtgatggtatgcgagcgaatggcatccacatagcgcttttggccgagcgttttggggcgaatggcacgaccgcgatacgaaagcagcacgtcatcgcgaagcgacgtagcctcgtgctcaccgtcgcgcagaacggccagacagcgcgagacatcgtcggcagacagcgtgcgcccggcagccgcctcgcgaaaagcatgttcgaaaaaacgcgccacgagttcgacctcatccgggtcaccgctcacggcgatgctatcgccacgggcgaccacatgggcgcgaaccaagctctcgagcgcacgaaggacgccgtcgccggcgcccaaaacgcacgagggatcaattccctcgggaacggtaagtctaatcttcgaggcttccatgaacctccctgcgcgcatggaccaagccggaatcatcgactccgatgatagcaacatcgagcaggcacggggctgtaagtccacaggtatcgtcaagacgggcatgatggaacgaaccgagcgtcaggttgtcgccgtactcgaggacggcacgctcgacggtgcccacgcgacgacgagcgtcggcaatggcgagttcctgcgccgcggctcgcatacgacggctgcgctcggccataacctcgggcggcacctggtcgggcatatcggcagcaagggtaccgggacgcttgctatagcggaacacgtgcatacgcgagaaacccacacgacggcacagcgccagcgactcctcgaactcctcgtccgtctcaccaggaaaaccgacgatgacatcgcacgaaagagacgcctggggcaagttggcgcgaatcatacgcaccgtgtcctcaaaggcctcggcgctatagggacggcccatgcgatgcagggtcgccgtgcagccggactgcacgggcaggtgcaaaaacggggcgatacgctgcgggtagcgcgccataaccttaagcaggcgctcggagatatccatgggctcgaccgaggaaatgcgcacatgcggaatagacgtgcgctccatgatggcctcgagcagctcatcgatttcgacatgctcgtcggtcgcgctcttgccatcgtaggcacccaggttcacaccggtcagcaccacctcgggtacgccggcctcctgggcctcgcgaacttgctcgagcacggactcgacgggcacggaacgctcggggccgcgcgccttccacacaatgcaataggtgcagcgatggttgcagccgtcctgtatcttcacgcccaggcgagagcgaccgagcgcatcgaccacctcgccatcgctgcaggcgggaacgctatcggactcaacgcccagcacctcgcagacacgttcggcgacatcgatcttggacggctcggcgatcacgcgatccgaaagctccagcagctcctcgggatgcaaattaaccacgcatccggtcacgatcacatagggctcgtttggatgggccagcgcatgacgaacggccttacgggtcttggcctcagcctcgcccgtaacggcacaggtgttaatgacgatcagatcggcatcctggggctccacaatagcaaagcccaggcgcataagatcggcagtgatacggtcagactcaacccggttgacacggcagccgaggttgacgacggaaatatggggtgcgagcacgcgggctccttaatcgaggatatcgtcgagggcactcttgatacggtcggtcaccgacttcttaccggaagcgacgtcatcgcccatctcatcggcaaaagcacggagcagctcgcgctgcttattggaaagattggtgggaacgaccacgcgcagttgcacgatcaggcggccacgcgaaccgccaccgccaatgcgcggcatgccgtaattattgacgctcacggtatcaccgtactgggcgccggcgggaaccgtcaccttaacgacctcgtcgggcataatgccctcgacctcgatctcgcagccgagcgcagcctgcgcaatcgagatatcgctcaccaggtacaggtcgtcaccgttgcgcttaaagcgctcatggtcggcaacgcgcacgttgacaatcaggtcgcccgaaggctcgccgcgaaggccggcctcgccaaagccgctcacacgcagctggcgaccggtcgaaacgccggcgggaatatcgatgtcgatcttttcatgcgaaggcgtgcggccctgaccgtcgcaggtctcgcagggatggtcgatgaccgtgccctcgccatggcagtcggggcaaggcgaggaagactgaacctggcccaggaacgaacgctgaaccgtcgtgacgtagcccgtaccgtggcagcggccgcactgcttttcctgtgcgccctctgccctaccggtgccgttgcagtcctcgcaaggagcaaggcggtcatagctgatcgtctttttgcagccgagcgccgcctcctcgagcgtcaccgaaagcgagatggccatgtcacgtccgcgacgacgctcacgacggctgcgggcgccaccgccggcaccgccgccaaagaacgacgagaacaagtcgtccatgcccatgccaccaaagatatcgttgatatcgacgtagcccgaaccaccagggccgtcggcagtgccgtaacggtcgtagttagcacgcttctgctcatcggaaagaacggaataggcctcgttgagctccttaaacttggcctcggcctcggggtcgtccgaaacatccggatgtacggtacgggccttctttagaaacgcacgcttgatcgtccgcgcgtcggcatccctgtcgacgccaagcacctcgtagtaatccctattttccgacacgaccgaatccttccgactttcaatattgtcacagtgcgtcctatacccaagctgggccgaccgcaaacagagggtttgatgttattgcatttggtacggcgaaagcatggcccgttgcgagcagctcgcgaaccaaaccgacacgagcgcgaacataaagccgttggcaaaaccgttggcaaactgcatcgcaccgcgcttccaccacagcagactgcgatgaagcacaccgtccgaaagcaccatgaacaggcccatggtaaacggaataaagcacatcacggcaaaggcagagaacacgcccgagatggccgagagtaccaaaaacggcgccacgatgcccatcaggtaaaaaccggtacgagctttgccttccaagcgctcggcctcaacatgggcgcggccgaccaggtcgccgcccgcggcaccgttggtgccagcatgacccatgccgctgatgcggacctcgtcgccatcgtgagtgccggcaggaaactcaatcgtctgctcggaggttacgcgagtacgaccgctgccaccgcaatcggggcaggggtcggccacgaccttaccggaaccgccgcactcggggcagaccgactggaacgtgcccgcaccaaacaggaaggacaggtcgacatcgatgtggccgcggccgccacagctcgggcaggtatgggcatgctcagacgaaacggagcccgagccgccgcagttgctacaggtatcgaagcgcgtgtagcggacggtcttgcgggcaccgcccttggcctccttcgcgtcgagtttgatatcgacgaccacgttggcgccgttctcgggattgtaggcagcctgcccgcgacgctgctggccccaggcgccgccaaaaggaaagccgccctcaaaaggattgccatagcctgcgctgccggcgtagccgccaccatagggcgaagccgtaggagcaccggcgaagggattgccagaacgcatggcgtcgtagcgcgcacgtttttgctcatccgaaagcacggcgtaggcctcggaaacctctttaaacttttcctcggcatccggctctttgttgacgtccggatggagcttgcgggccttttgttggaaggccttttgaatatcacgcgaggtggcatccttggagacacccagaatctcgtagtaatctttttcgttcatcgtcgccatgcgcggcaacctcctgctcacagcagcgtatatattccggtaattctacccgagcggcctaagctagatcccaaaacagctcgaacagaacatttccatcgagccagcccaggtgggtcggcgccagacgagctcgaacatggcccgcgacgacatctgccgaagtaaagggtccctcatggaccccgagcgtctcaggcacccaagtggcaagacccaattcgagcgcgcgatcgcaagcggctgtcagcccatcggccgggatgacacgagccgcgcgaaccaacaggtcggacgcgacaccgcgcgtcatgcgacaggcgagcatcaggtcttcggccgcagcctggcgctgcgacagatgttcggcctcaaacgccgtcgcgtcatcgtcacgttgcaccagacgcacgcggtacgcatcgcctcgagaagaaacaccggggaacaaacctgcaagacggtcgaaatccgcggcgtcgagcatgcccgcggcagaacgccccaggcccaggtagccccgtccggtccagtaggcaatgttatgggcgcactcatggccgtcgagcgcgtagctcgccacctcatacgggtgatagccggcggcacccaggagctcgcgtgccacgtccatgcatgcggcctgaaaatcctcatcaggctcgagcgactcgtcacggcacgccatgcgataaaggggcgtcccctcctcgagcgtgagcgggtagaccgacacatgatgcggagccgccgccagcacgccatcgagcgtacgcttccaactcgctgcggtctgcccgggaagtccgcacataaggtcgcacgacacgtcgagcccagcgttcttgaccgtcgcgatggcggagagcgcccgatcggcatcgtgaatgcggccgatggcggtaagttcggcgttatcgagcgtttgcacgcccagagagacgcgtgtgacaccaaccttggcaagcgcagcggcaagctcggcggtcagcgattcgggattggcctcgcaggtaaactcaacgggggcgcaccacgcacgaatacgccgcgccagctccaccaggcgctcccccgccagcgacggcgtaccgccgccaacatagacggtgcgaatctggtcgagggccccagccttgccaaaagcatcgaggcgcgcgtacaactgctcaaaataggaatcgagcacggcatccaaatcacacgaagcaaagctgcgcgagtcgaagtcgcagtagcggcacttttgggcacagaacggcacgtgcacgtacagcgcggtaacggccacccttaagcctccagcggatgagggggcaccgattcgccggcggcaagggcagcctcgcaggccaccacatcatgctcgatctcatcgaccagcgccataaactcctcatacgtggagcagcgcaccacatgggcacgccaagcggcggcatggggcatgccttttaagtaccaacttgcatacgtgcgggcacgcgacatgagcggcaggagctcatgcgtcagcgttaggtgctcacgcagggcgtccaggcgctcgaccgagctgcgcggcggcaccggtatgccatcgagcgcaagagcgcgagcatcaccaaagacccagggattaccgtagataccgcgcgcgataaacaccgcgctggcacccgagttgcgcagatgctccgcggcatcctcggccgagaacacatcgcccgaaccgatcacgggaatctcaacggcgtcggcaacctcatcgacgaccgaccaatcggcctggcccgtatagagctgcgtggcgcaacgaccatgcacggcgactgcggcagcccctgcgccctcaagcatctgggcaaatgtcgcggcattgcggtcctcggcataaaagcctttgcgaatcttgacggtcacgggcacgtgcgccgcgcccaccgtggcctcgacgatcttctccgccaggtagggcgtgcgcatgagcgccgagccctcgcccttggtaacaaccttgcgggcggggcatgccatattgatatcgatgagcgacaggcgatcgccaacgcgctcctcgacggcagcgacggcgctcgcaaactgatcgggcttggagccaaagagttgcacgcaaatctgctgctcctcgtcggccggtagcaccaggcgccaggtcttgttgctggcataggcaaggcccgccacgctcaccatctcgctgtaggcaaggttggcaccgcggcggcgacacatgatgcgataggcggggtcggttacgcccgccatgggagccataaggaacggctgctcggcataagcacccagcagccgcttgctgtattcagaaagcgccatggacctactcgtccaccttgagaatcgccataaaggcctcctgcggaacctcgaccgagccgatggccttcatgcgcttcttgccctctttctgcttctcgagcagcttgcgctttcgcgagatatcgccgccgtaacacttggccaacacgtccttacggcgcgccttaacggtggagcgggcgatgatcttgttgccgatggcgccctggataggtacctcgaacagctgccgcgggataatctccttgagcttgtcgcacaggccgcgggccaggccataagccttatccttgtgcacgataaacgacagtgcgtccacctcgtcgcccgaaagcaggatatcgagcttgacgagctcggagggacgatattcgttgaactcgtagtcgagcgaggcataacccttggtgcggctcttgagctgatcgaaaaagtccaagatgagctcggcgagcggcatatcaaaacgcatctcgaccgatttgctcgtcaggtggatcatatcggtcgtgacgccacggtgctcgatagcgagctgcatgacggcacccgtatactcgggcgggcagatgatctttgccttgaggtagggctcttcgatgcgctcgatgcgcgtggcctcgggcagatcctgcgggctgcggacatcgagcatctcgccgtcagtcttgtacacgtggtagtcgaccgaggggctcgtggcgatcaggtccagattgaactcgcgctccaggcgctccttgacgacctccatgtgcagcaggcccaggaagcccacgcggaaaccaaagcccagcgccaccgacgtctcaggctcccacaccaacgacggatcgttgacgtgcaacttatcgagcgcgtcgcgcaggttctcgtagtccttgttgtcgatggggaacaggcccgtgtagaccatgggcttggcctcacggtagcccggtagcggctcggggcaggggttcgaagcccacgtaagggtatcgcccacgcgcacagcctcggggtccttcagacccgtgaccacataaccgacctcgccgacggtcagagcatcgaccggcgtctcggcagggcgcttgacgcccacgccgtcgaccaagaagtcgcccttggcctgcatcatgcgcagggtatcgccctttttgatggaaccgtcaaagacacgcaccgtggcgacgacgccgcggtactcatcgaagtacgaatccagaatcagtgccttgagagggccatttgcatcgcccttgggaggcgagatcaaaaagacgatggactccagcagatcgtgaatgccctcgccggtcttgcccgacacgcacacggcatcgtcggcgggaatggccagatcgtcttcgatctcggtcttaacctcgtcggggtgcgccgagggaaggtcgatcttattgatggccggaacaatgtccaagttggcgttcatggcaagcgtcgcgttggaaacggtctgcgcctcgacgccctgagtggcgtccacgacgagcaccgcaccctcgcaagcggccagcgaacgcgagacctcgtaggtaaagtccacgtggcccggcgtatcgatcaagttgaactgatacgtctcgccgtcgtcggcgtcataggacacgcggacggcattggacttgatcgtgatgccgcgctcgcgctcgatgtccatcgtgtcaagcagctgagactccatgtcgcgctcatcgacggtatgggtgagctcgaggatgcggtcactgatcgtggacttgccatggtcgatatgcgcaacgatcgagaagttacggatgtgggaaatgtcaattgaagtattcatgcggactatcttacccgagcggtacaaaaaatggagcctgttccataaaacaggctccatttatgcgcgtaatctgtgtggtgtgaaatttacaacttaggcgttgatgctgttcacgagcttggcaagaccggacttgcggttggaagcctggttcttgtggataacatgcttggcggcagccatgtcgagacgcttggtgacggtcttgagggcagcctgggccttctcggcgtcgccctcggcgacggcggactggacgtgcttggtcagcgtcttgagctcggacttgacagccttgttacgcatgcgagctgcctcattggtgcggatacgcttcttctgagacttgatgtttgccacttctggagttcctttcgagttccttgcaaaaaatgtatgacacctctgagacacggtgaggtcatgcaagcgcctactatagcacgctccccctcaaagggatagaacgaatttgtcaaataggcaggtatcatcacgattttctcaagatgttcgtaatccagagcaaaagcgcggtctccgaatcggccgagcccttgagcgcgagctccacatcgacggcgccctcgagcgcggcaacgagctcggtcatcgaaaaacggcgcgcccaggtaaggtgattcttgacctgccaggcctgaagcttgagcgtcgcggcgagctcacgcccctgcccacgcccatcgagcgccttggcgacgattagctcacggatgcgaccgcatagcagcgtgtaggtccatacgtagctcttggagggcagaagcttaaagagttcgagcgaacgccgcatatcgcgagccgagacggcgttgaggaagtcccagggctgaacctcggccgtacgcacgatccaacgctcaacgtcggcaagctcaatctggggcgcctcgaccatctgggcgagctttgccaggtcgttatcgagcatgcgcgtgttttcgcccgaacgcgagacgagctcctcggcagcagccgtcgagatggacttaccgtgctgcgtcgccatctgctgaacgcggcgcggcagttcccagcgcttggtacccgagcaatcgacgatagccttcctgtcgatcttggcgattgccttatacaggcgcgtattcttggcaagtgagtcggcgataatgagacagaccgtcgtggggctgggacttgcgaggtactcgacaagcggttccgagaccgccttggcaagcttggagcaaccgtcgaggatcaccaggcgaaactcgctacccatgggaaaggtattgagcgagccgatgatcgactcgatatcgggatctttcgtcatgtcgcgttcatcgaggttgaactcaaccatacccgacttttccaagcgagctttcatacgcgagacggcgtggtcgcgcttgaccccatcggtaccgacaatcagatatgccggcagcagaccggtttcggacattgcgctcccctctcgcacactctcgaattcataccgtgccattttagcccaggggtccaccgcgcgccaacgatgtcgtcacggccgctggcatcgcatcgcaaagcccttcgcagtcggcgcgacggtaatgtcgccgtgttcgatggtgcatgcgaacgcaccacccgcttccttaacggcatcgatgcaggcatccgacggatggccgtaacgattcccctcgccggcgctcgcgatagagagctcgggcttaagcgtgcccagcaggtctgtgtcgacggaaacttttgagccgtgatgccctagcttgagcacatcgatatcacccacctcccgtacaaactcgcgctcttgatcgagctcggcatcaccagtgaggagcacgcgcaggctcttgccttcctgggcataggagagcagcaagacaagcgagtcctcattgccctcgccatccaccgtgtcaaacggccacatcacacgtgtccgaaacgcgccgatatcgaccgtgtctccgcaagccacctgccgatacgttacgcccggacgatttagaacctcagcaggcgcaccgtcaagcgcatcggccgcgaccacaatggttccaaccgaaaactgatcgagcacatcgggaagaccaccccaatggtcttcgtcccaatgtgtcacgaagacggcgtcgatatggtggacgttattgcgaaccaacgccgacaccacgcgctcatcgagcccacagtccacgagcgccacggtcccacccagacgaaccagaatcgcatcggcctgccccacatcgagcaccgtcaccgaaggcggcgcgaatcgatcccaatagacgtacggaacaaccgcagcaagcatcaaacatagcaaccccaccgccatgggtcgcgcgcgaggacgtggccaccagaccaggagaaccgccagcaaacacggcaccaggtaaatccacatgctatcgggtggcacgctcacggatgcacccggcacggcggcaaagaactgctcaaagaacagcgcgcaacgggcggcaatcatgggcacaacgagtgcccaagcttgcaacggctccacgagcgaaaagggaaccagcacgatcgacacagcaagcaggagactcaccaccggaccgatgaccgcattcgccagcggagcaatgagcgagaacgtaccaaaggcaggaatggtgatgggaagtgtcgccagttgcgagcaaagcgtgaccgaaagcatgctggcaacgcccgatggcacacccagctcacccaaagcgtaggtcacataggggcaaaagcacagaatggctaagacgctggcacatgaaagctgaaagcccatctcgaacagcaccgtcggccgcagtagcacaaagatggacatggttacgaagagtgccgaatggccgtgccggcgacgccccgcgccgtttacgacaagcgtcgcaaacaccatgcaacacgcgcgcactgccgagggagacgcgcccgtaaaggcagcgtaacccacaagcgttatcgccaatatcgcccgttgaagaccgcgtgaacaccgagtcttttgtaaaacgccctcgcttacaaaccccacgatagccaaatggctgccagagacggcgacaagatgcgccgttcccgtcaccgaaaaccagtcgcccgccggctgggcgcgcagctcggccgaacgaccgcagacgacaccggctatgagcgaacgcgccgggtcggtcgcaggcgcgatggacgcaagcagcccatttcgcaatcgaagcagcggccccgaagagccctcatcgaccgacacaatccgaacggctttaaccttgcgcacctcgcctcggagtacgcgcgagcgcccatacgcatcgttctcaaggcgcgaaattcgaccgatagcacgtacatgcgaaccgacgccgagctcgcgatcacacgacagccgcacctgacctaaacgcttttcgcccgcatacgcatcgcaggtataggagtacgcaccgtcattgatggacgggtcaccgcgcacaacaaattcaagactgctcgcagcccgattatccagcgccctcgaagcacgcagcgccccaatcgcccaacccgcggacacaaccgaccccgccacgatgccaagggccgcggcatacagccatcgtctccaccgcataaggcgcatacaggaccgagccaatacgatgcaagccgcagcagcaacgggaatggcccagagcgatgcgacgggcgccgaccgctctcccagcagcaaatcggctgccacgttaagcaccaagccacagctcgtacacaggccggcacaaagggccatcgtccacggcatcaatggccgaggtggcatcacatgctcgcgctcggacgcgctcatacgcagatacaatctttgattttggcgagcttcttctcaccgattcccgatacgcgcatcaggtcatcgactgaggcaaaagcaccgttctttgtccgctcatcgataatcgactgagccatagaaggcccaatgcccgagagcgtctgcagttccgccgcgctcgccgtattgatgttcacgagccccgacgaagaccccgcgccaggagtcgtggcagtactactttcggccccgccgaccgccgcagcagcttgttgctcccccaccgtcggtacataaatcttttggccatctgtgatcttggacgcacggttaagccctgtcacgtccgcctcggccgtaagccctccggcggcatcgatcgcttgggacacccgtgctccttctttgagccgatacacgccaggcctcacaacggcgccatccacatcaacgtacacctcggcagcagaggagctcttgcccgaagacccatcggcatcatcaggagacgcatccccggccccgcgcgcatctgaggcgcttgcctcatcactatgctcaaacgacacgccgctggagcggctactaaaacttgccatcgccaagccgctcgcggcggcaatgacaaccaaaatcgccaccaccaacgctttatgcccgagcagcttttctgcccagcggtccatacgtttaacccgttcgtgatgttcgcgctgcgccatagcaaacacctcccaacaccatcgtgtcaggaaacgagcgccgaagcctccgcacgtccacactggttatcgcggtcaaaccaaaatctgacaaaaaccttgcgcgaacatgtccatttattcagtcacacgtcgataaatgaaccgtttatcgccaaaagcccagatacaaaaagaccgacgatgcaaatgcaccgccggtctatacacaacattactcgtgatcttggtaaatctcacgcggagcaagctccgaatgtttgcgttttaaggtcttaggggccttatacgtgttgctggagaagtcgatgtactcggtctgcttaagcaggcgttcgatcatctcctcgtggtcgaacagctcccaggcctcgtgcacggcatcgagtttggcgtgtgtctcgggacgacgcggcataaacagcgtgcagcagtcgggcgccgcctcggtggaaatatcgaacgtgccgatttcctgagcgcgcgcaataatctcctgcttgtcggacccgatgagcggacggaacacgggaatcttcacggcctcgttgacggccatgatgttctcgagcgtctgggaggcaacctgaccgagcgactcgccggtcacgatggccttggcgccctcgatatgcgcaatgcgctcggcaaccgaatacatgatgcggcgatacatgatcacgcgcaggttgctggggcaggtgacggaaatctcacgctggcaatcgccaaacggcaccacgtacaggcgtccgatctgcacacccggctcaagcgcacggatgatgtcctgcaccaaatactcgctcgtatcgggcgtctgcggacgaccggagaaatgtaccggcacgcacaccgcgccgcgccgcgcgagcatccaggtcgccaccggagaatcgatgcccgacgacagaagcgtcacgaccttgccggcagaacccaccggcagaccgcccacgccgcgctcggagcgcgcgtacacgtaaacgctaccctggaccaccagtacgtgcaccatcgcatcggggtcgtgcatttgaacctttttatcggggaaggcctcacacagtacctcgcccacctgacgattgatatcaatcgaggtgagctcatagtcggtattggagcgcttggcgtgcaccttaaacgaatcgaagggaccaaactcgcgcaacgccttgacggcagcggcgcagtactcctgcgggtcgcggttggtgtggtacgccagggacacacgggcaacgccggggacggtgcggatgacacgcgccgcctcgtcggcctgatgctcgttaaaggtcacgaggatataaccggaaattcgagacacggcgttcacggaaaaggcggccaaagccgccttaatgttatccatgaggatatgctcaaaatgtgcgcggttcttgcccttcagtccaacctcgtgatagtggaccaggcagacgcgagctgccatttaggcttcagcaaccttgtggccgagcgccttctcgtaacgggcctcgtcgtaggagatatcgccgtcgacgatctcgtccatagccatcgagatggtatcggcgccggagagcgcgatggtgatgtcgtcgacatcctgaacggcaagcacgcggttatgctggccgcgcagcatgctattgatgtcgcaggcacgcttggaggcaagcgaagcgagcaggaagcggttgtgatcggtcttctccagaagatcgtcaatgcaaggctttacaacggacacggacctcagatcctttcatgcatatcgagaacgcgaacgagctcatcggtcgcgcggtcgagatcgtcattcaccacgacttcgtcgtagcggtcggcaagggcaagctcatgggcggcgtttgccatacgcagctcgatcgtctcgggcgtctcggtaccgcgaccgaccagacgctcgcggagcacctcgagcgagggtggcttgataaagatcagcacggcctcgggaaaacgctccttgacctgcaaggcaccctggacatcgatctccaagatgagagacgaaccagaggcgagcttggactggacctcgctcaccaacgtgccatagcagttaccgtggacctcggcccactcaacaaactcaccgtttgccacgcggcggtcgaactcctcgcgcgtcaggaaaaagtaattgacgccatcgacctcgcctttacgtggggctcgcgtggtagccgaaaccgtcaggcccaggttagagcgacgctcgcgcacacgagtgacgagcgtgcccttgcctgcgcctgacggtccagaaatcacaaagagctttgaatcctgagcgctcacttatttggtcagctgctcgaggagctgctcgcgctgacggacgccaaggccctggacgcgacgggtagcggagatgccgagctcctccatgatcttggcggccttggccttgccataaccggggagagactcgatgagggtggaaaccttcatgcgggaagcaatggggtcatcggagttgagcacggactcgagggacttctcgcccttcttgatctgctcacggagctctgcgcgagcgtgacgcgcggcggcagccttctcaagagcctgcttgcgctgctcatcggtaagctgagggagtgccattcgtacctccaaatagttgggttatatctgattcaatatttggcattttagcacgtaaaacgtacaaaatgcccaatcgcggctccataggttagacgatacccgcaaaaagtgcaatatatcgcgctaaaagatgagcccctgacctgcgattccacacaaaggatgggaaagttttcgcaggcacaggggctaatttgtgctaatgagacccaaaagtggtgacttaagggaatcttttatgcgacgttttcgaccagctcggcaacgatggcgtcaaacgcggcaaccggatcatcggcgccggtaatggggcggccaaccacgatatggctcgcgccgcgctcgatagcctgggaaggcgtggccacgcgggactgatcgcccagcgcagcaccaacaggacgcacgcccggggtcacaatcagcgcatcggggcccagcagctcacgcatgtcatgagcctccatcggcgagcacacgatgccgtcgataccgttggcctgggcgagttttgccagacgggcggcctcctcggcaacgggcaactcgacgccgatctcgctcaacgcatcctgattcatactcgtaagcacggtgatggcgacgagcttggctcgatcctcgcgcgcctcctcggcaccctcacggcaggcggcgagcatagcacccgaacccaagccgtgaaccgaaagcaggtcggcgccggcaagcgaggccgagcgagcggcaccgcgcacctgatgcggaatgtcgtggaacttaaggtcgaggaagaccttaaagcccaggtctttaaaggtcttgacgatctcgggaccctcagcgtaatagagcgtcatgcccactttaagccaagcggcatggcccgaaagctcatgggcgagctcgagcgcacgctcacggtcgcagtcgagggcgacgataacgcggtcgcgggcatcggtctctagcattcgaaagcacctaccagctcgttgatgtccttcacgccctgggactcggcccaggcctcgagctcgcgcgcaatcttgagcgaagcgcacggatcgacgaagttggccataccgaccgatacgcaggcagcgccagccaggataaactcggccgcatcctcaccggtcatgacgccgccgacgccgttgatggggatatcgacggcctgggcaacctcccagaccatacgcacggcgatgtgatggcacagcgggcccgaaagaccgcccttgggcttggccacacgcgacttgcgggtgtgaacgtcgatggccataccctggatggaattgatgaccgaaaggccatcggctcccgcggcctcgagagccttggcaatctcggcgacgttaaccggagccatctttacgaacagcggcttgtcggtcaccttgcggcaggcggccatgacggaagaggcgccctcgggcgtggagcccatggcggcaccgccggcggcaatgttggggcagctcacgttgatctcatagccggcagcccaggggcacagctcgacatacatctcgagcgcacggacaaactcgtccacggaatgaccggcaacctggcagatgacctggcaaccgtccttagagagctgctcgagccacggaccggactcgcgggcgaaagcggccacaccggggttctgcaggcccacggaattgatcatgccgccggggatctcggccatgcggggtgcgggattgccgggccagggctcggcagcgcagcccttggtggtgatggcacccagctgggagacatcgaagaagttttggaactgccaaccgtagccaaaggtaccggctgcggtgttgatggggttctgcatcttgacgccgccgaaatcgacggccatgttcacggtacccactagaagaccaccaccttggaagcatcgaacacggggccgcacatgcaggcgcccttcataccgtcgaccgtctcgacattgcaggtgttgcaggcaccaaagccgcagctcatcatgcgctcgagcgacacctcgcagtacgcgccggcctcggcggcagcggcggcgaccttctccatcatgacggcgggaccacagctggcgacgtagtcgtaaccgccctcgccgagcagctcggcggcaggatcggtgcagaagccgtgcgtgcccaacgagccgtcatcggtgcacacgttgaccgtggctcccagcgcgcggaactcatcgacgcccacggccttggacgcggtgccaaagcccaggcacacgtcgacggctacaccctgcttagcaagcatgtcagccaggcagagcacgggcggaacgccaatgccgccggcgacgagcagtgctttcctggtaccctcgggcacgaaccagccgcggccgccagggcccagcaagttggaggtggagccaggggccatctgcgacagacgacgggtatcatcgcccacgacggcgtaccacagctcgacggtgccggcctcggcgtcggcacgatagaagctcaggggcacgcgaagcagcgaggaagcatcgcccggcacggcgatattcacgaactgaccgggcttgagcgcacttgcaagcttgggggccgagataacgagcgagaagatgccgtcggcgatctcctggttcgagacgacctcgaagtcgtgcatgcgtgcagtggaaggtgtgggcatagacgctccaatcccccatgcggttgcatggttcaggcgaacagaaagcgcggcaccgcaagggcgccgcgcataaaagcgataaagctatgctagcagatgcagccgtcggcaagcgtctgcttaccgccgacaaacacatcggtggcacgaccggtgagcgtgcggccggcaaaaccggagttctcggcgcgcgactcgtaaccgccctcgccgaccgtccaggtggcggacgcgtcgaacacagtcaagtcggcaacggagcccgccttgatctgaacctggtcgaggcccaggatctcacgcggcttgatggccatgagctcgaccatgcggcccacgctcatcttgcccgtgttgaccagctcggtgagtacgagcgacagcgaggtctcgaggccgatcataccaaagggcgcaagctcgaactcgcgggccttctcccacggggtgtggggagcgtgatcggtgacgatgacgtcgacggtgccgtcgatgacaccctgacggatggcctcggcgtcctcgtcggtgcgcagcggcggattgaccttgagcgaggtgttgtaggtctcgtccaggtcgttctcggtcaggaacatgtggtgcggggttgcctcgcaggtaacctgaacgccagcggccttgccggcacgcacgatctccaggccatgggcggtggagatgtgctggatgtgcagcttggcaccggtcagcttggcgatctcgatgtcgcgagcgatttgcagctcctcgccggcagccggccagccctcaagagccagacgggtcgagaccttgccctcgttgatctggccgtggccgaccaggtcctcgtcctggcagtggctcataaagaccttgccgaacatcttgccgtagtccatgcagcgacggagcatgcctgcaccctgcacgccgcgaccgtcgtcggtgaaggcgacagcgccgtgggcgaccatatcgcccatctcggacatggcctcgcccttaagaccgcgggtcatggcgccagaaggatagacgcggcagtggccgacctcggcagcgcgggacttgacgaactcaacgacggtaccgttatcggtaacggggtcggtgttgggcatggcgcacacgccggtgaagccgcccttagcagccgcgcgggtgccgctctcgatgtcctctttgacctcgtagccgggctcacgcaggtggacgtgcatgtccaccaggccagggacgaggtacttaccggaaaggtcgcggacctcggctccctcggcggcgaggttctcgccgacctcggcgatcttgtcgccgtcgatcaggacgtcaacgacaccgtcaagctcgacggacgggtcgacgacgtgggcattcttaagaagcaaggccattatcggcacctccaagcagcagatacaggatagccatacgcacgcagataccggcgtagacctgctccaggatgacggagcgttgcgggtggtcggccatataggagtcgaactcgacgccgcggttgatggggcccgggtggcagatgatcgcgtcgggcttcatgagcttctcacggtccttggtaaggccgaagagcttgtggtactcgcgaatggtcgggaacggggcaccctcgaggcgctcctgctgtacacgcagcatgtagacgacgtccagctcgggcaggacggaatcgaggtcgctcgtcacgtggtcgcagcccagaacctcgggcgccggcggcagcagcgtgccgggggcgacggcgtaggtctcgcagcccatgatcttcagcgcgggaatcagcgagccgcaaacgcgggagtgggcgatgtcgccgacaacggcgaccttcagaccgtggaagtcacccttgtgctcccagatggtgtacaggtcgagcagagcctgcgtagggtggttgtgcttaccgtcaccggcgcagataacactcgcgggcgaattctgtgtgacgatgtagggagcaccggcatgcttgtcgcgcacgacgatgcagtcgatcttgtaggcgttgagggtctcgacggtatcgacgaggctctcgcccttgaccgtggaggtcgaggagccaccgaagttgaggctgtcggcggaaagacgcttctcggcgagctcgaaggagctgcgggtacgcgtcgagggctcattgaacatgttgacgatggtcttgcccttgagcgtggggaccttcttgatggcacgctcgttgacctcggagaacgccttggcggtctcgaggatgagcttgatgtcctcttcggagtactcggtaatgtcgatcaggtgcttatgattgaacgccacggtactactcacctcccagcggcgcggagcccacgtgggaacccggcgcgacgtcgttgatctcgacagcggtacggccgtcgacttccttcatatataggtgcacgttctcctcgtgcgacgagggaacgttcttgccgacaaagtccggcgagatagggagctcgcggtgaccgcggtcaacgagaactgccagctcgactcggctcggacggcccaggtccataacggcgtccagagcggcgcggatggtacgacccgtgtacaggatgtcgtccaccagcacgacgcgcttgccgtcgacgctgaagggaatgttggtagcgtgaatcgcgggagcgaaattggtcgcatagtcatcgcgatagaagctgatgtccaggctgccgagcggaacgtcgacaccctcgatctccttgatcgcctcggcgagcttctttgccagaaggtcgccgcgcgtgacgatgccgaccagagcgaggtcttcacagccctcgttgcgctcgaggatctcgtgcgcgatgcgggtcatcgctcggttgacggcggtctcgtccatgatgaccgccttgggggaagtcgtgcccatcgatctccttcctcacatgtcttgactgctgacacagtcaaaaaaatagatgcccgaccgctcaaagcggaccagacacccacaggaagtactgctcattgacagctatgtaattccatgtgggtatctcgtacccctttaatggtcaaggcatagtgtagccaacctcgggctcaaatgcgagcataaatactagtcaatccgtaaacggagccaatagctccataaacctatatatatttgtgggacgcgcttgaaaaccttgttgcgagctggcataatcccctctgccgcacgcaaatcggatctacgtccagggccgtagcgtgggcactatcgccaaaagaggaatatctctgtgtagattgcgcacagagacatgcttctgtgctatagttcaggcttgtttgttaacgcgacatgttcgtttgtcgcccaaggagggtcagttatgtccaaagtatgcgaagtttgcggtaagcaccccgttgccggtcgctccatcagccactctcaccgcgtcaccaaccgtaagttccgccccaacatccagcgcgtctacgtcgtcgtcgatggtcaccgtcgcaagatgaacgtttgctccacctgcctcaagtccggcaaggttgcgcgctcctaaataaggtcttaccaacaagtacctcggactctccgggtcaaagacctcgcgttcacatagaacttaccaaaggcgtcctccatgtggagggcgcctttttgcacccattggggacagacttacatgagtgttttcacgcattggggacagacatgatgcgtgccagtagcggttcgtcccctgcctcacgccgcctcgttccagcctgtggtggccttagtcacgcttgtagcgccgatgccggtgatacgggcaatttgcttgaccgtaagatgcgcccgcctgagcctcagcagacaggcatcgcgttcggggcgtggcagggccttgagcagcgcaggatctatgctcggcaggacttcgcacgcaacggaaagagcatcctcatcagggatccgccgacgtggaagaacctccactgaccagatgcgcccggcaacttcctcgagatgctcgcaatagcaacgggagcctccgacaatatcgagcattggggccgcatcacaaatgtcaaagggatcgtagcccagctgatatgccctgaagcttgaccaacggtacgcctcgagcgagtcgagtgcgcctttcacgggattgagatggatataatcgagcagctgcaccgcctgcgtgtccgactcaactgcgacccgcgaatagcgattgtcaaacaaatgccccgttctccccgttttcccattgaaatacttagcatatgccgtcagtgcgcactgcatcgcctttgaaaggttgtcaaatgggtcatcaaccatcaaatggaagtggttatccataaggcaccaagccaacaccgccacttcatggcgcacaaacctgtccgagatgtccgataggaaacgatagcggtcggagtcatcttcaaaaataatctgtttggagttcccgcggtcatagacatggtagtagccggtgatcgaaacggagcgggcgcgtcggggcataatctctcctttcaaaactgtacaggcaacacctaaaaggagagaagcaacgcgaaatgctgagcctgtaacctatttatatccaatgagcggcaatagaaggcccagagcgacaaaatgacaaatcccttgattatcaactttatccgaacacctcccacattcatccgcacatgtgcggatgaatgtgggaacccgataccttgagggccggatcggccggccccgggagatcggaggacggaatgtccggagagaagaaaaggggccccgcaagggcggtcccgagggcctacggaaggctcacgaggcacgagcgggacacggtccagaggatgctggagcgcggggcctcgtgcaggcagatcgcgcgggagctgggcaggtcgccctcgacggtgagctccgaggtggcgtcgcacaggttcgtgaccgcgccgagggagaggcgcggcgagcgcgtggacgcctccgccgacctgtcggcggcctgcccgcgcctggcggcgtggccgcgctgccgcgacggtcggcggggccgacgccttcaccgcgggcgcccgcgtggtcgccgtgtacaacgcgccactcgccagcggctgcaatcatggcatcgccaagggcaaccccaacgaggtctacctgcgctacccacgctctccctttgccgaccagtccggcgacgccggcttcacccgcacgccgagcgatgacgcgacggcctacacctgggatctcgcgctcaccaagcgcggcagcgacggcgacaggccgctgcccggggcggtcctgagcatcaccgacgaccgcggtcgcacgctggcggccaatggcacgtgggatgcggagggcaaggccaccgtcaccacgggcgaggacggccgcgtgaccgtctcgggcgtggactcgggcaagctggaggtccgcgagctcaaggcgcccaagggctacaccgcctttgagggcacgcgctccgtgacggtcaaggccgagggcctggacgtcgaccaggtggccgccgccaagcccaagctcaccatcacggccgagtcgcccctgcgcgccgacaacgcggacgggtcgacgggcagcctggaggcgtcgctcatcaacacgcctaccggcacgccccctagcactatcaccggaggctttatgccctcgactggcgatatggcaatgtacgccgtggccgccgcagcggtcgccggagccgcactcctcgtggtcgcgctcctgatcaagcggggaggcggcaaccatgcagagtagccaatggccccacagagagcggggcgagacataaccaagcagatgcttagacacagacagatggttttagatcaagcggaattcaagcagaaagcagaggaaaagaagatgagtatgagcaagaacatcgcccgcctggcagtaacggccggcctcaccgcagcgttgagcttcggcggggtcatggcgcctgtgaccatggcgtttgctgagggcgcggcggacagcatcaccatcaataaggttgccgaggacaacaaggacaatacgttcaaggcttatcagatcttcaaggccacggttactgacacgaatggtggcaagactgcgcagaacattacgtgggcgagtgagacggttggcccgaaagttattaccgccattaagaatgactggaagggttatcagagcttagcgaagaataacaaactgtccgaggatcctacggctcaggaagtcgccgacttcctcatggcgaatgcgaagggcgctcatgcgggcgaggatggaacgcgaatcactaccgacagcgttctctatgcagttgcgaatgctgtaaagggtgagaacccggctgagtctaatatcactgccggtaacgcctgggctcccgatgcaacgcatggcagcggctactacctgtttgtgaccaataatctcgactcgagtaagccgaacaccggtacatccccgattttcgcaatcgtgggcggtgaggctgtgactgtaaccgagaagactagtatccccactgtcgacaagcagattcttgccgcagctcctgctaatcccacgcagcagacaaatggttggtctggcgttgccgactcccaaattggccaggaagtgacctataagcttaccggttcggtcgccgataactacgccacctatgactcctatgcatacaagttcacggacactctttcgaatggcctcgattacgtacaggattcgcttacagtttacgcagtgaacggggacggcgattacactctgattgatagcagtgcctataacctgactactccgagtgccggtaaccgtgttttgacggttgactttgccgtcgataaggccaacaacaaaaaaggcctaaaggatgttcagggcgtagacgctagcacccagattgttgttttctataaggcgaagctcaacaagaatgccgttaccggtaatggcactggcgagaagaagggcaactacaacactgttaagctggaatactccaacaatccctatgccgaaggaacaggaacgtctgtcgaaggtggcgctggagactttaccttccagctcaacattaacaaggtcgatcaaggcaccgagaagggccttgcgggcgccgagttcagcattcagtctgctgatgcggacactttgaatcaatacgttgcttcaaaagatagttcagacggaaaagtcgttgctggccaacttgtgagctttactggcgcaactcttccggactatttgaagtttacttctaacgataagggaaagattgaagcaaagggactcgatgctggctcctacacggtgactgagactaaggcaccaagtgataaatataccgtcgccaagcccttcacctttactattaaggcagagtataaggataatgcggcagagcttaagaagattacggtcagcccctctcagaatgacgagattcgttccgatgtcgccctcggcacgctcaacaacactccgggcgataatacgctgaccgctacgaataataccgctgccaatgtcgaaaccggtgaaattaacatcaccatcggcaataccaagtccgtcggcctcccgctcaccggcctcaacggcgtgaccttcacttggatcgctggtggcgcggtactgtgcatcggcgtggcgcacctcatccgcagccgtaagcaggctgaggagtccgagcaggagtaacgctcactcacccatccctttggcaggtgggatgtgatggccatgagacttgcggacacttttctcgtccatcgacgttcttgctttgccattctaatttcggggcagactccacactggagtttgccccgttctttttggacaacacaggcagcctccaccgtccgatgcggactcatccgtcatcgcgttttttgactcgtatgaggttcggtttaaggtccgtaggcgcacgtcggcggggccgacgccttcaccgcgggcgcccgcgtggtcgccgtgtacaacgcaccgctcagcagcgcatgcaaccacggcatcgcgaagggcaaccccaacgaggtctacctgcgctatccgcgatctcccctcgccgaccagtccggcgacgccggattcacccgcacgccgagcgacgatgcgtgcgcctacacctggggactcagtctgatcaagcgctcaagctcggacgataaaccgcttgcgggcgccaagctacgcatcatcgatgaccgcgggcgcatcctaacgactgatggctcgtggtcgacggatgccgacgcttgtgtcaccacgggcgcggacggccatgtggaattgaccggcgtggacgcgggcgtctataccgtcgaggaaatcgcggcacccaagggctacaccgcctttgagggcaaacgaacggtaacggttacgtccgagggattggacgttaaacaggtggcagccgcgaagtccaaagtgaccgtgtcggccgaaagccctctgcgggttgataccgccgatgccgggacgggctcgattgagctgtcggtgctcaacaccccatctaaagaagtgagtcgaggctttatgccctcgacgggagatagaacgttggttctggtggcggctttggctgccatcggagtggcggctattgttgtcgcgctcgtcatcaggcggggaggaggtcgccgtgaaaaataattgtcccccccccttgctcaatggcgtactgcctccgtagcgagtgacgcacaggtctaccgacctgatgatcattggttttgaaaaagttactagagaactctccaagaaagagggccaaacatgaagacaaccaagaacatcgcccgcctggcagtagccgccggcctcacggcggccctgagcttcggcggagtcatggcacccgtgagcatggcgcttgctgagggcggaaccgccgcaaactatgtgccgacggcgacgacgaccggcaacgtgaccattgctgagaacacctatgccggcacctcgtttaagggtatccagattttcaaggccacggtaacgcagggtaaggctgatgcggatggcgatggcgttgcagatgagaatggagcttggactgaggatcacgaaaagacgctgtccgacatccagtgggcgactcctgaggttgagaatgctgttaaaggcgtttttgctgaagacaccaataatcctggtgaaggcgccacagctcaggattgggcagactacattgctggaatagttgctggtaatgctggcaaaggattcaaggtcgatgccgacagcgcgctcgacaagattgccaaggcgcttgagaaattaaccacagtcaatgaggctactggctggataaattcgtctgatggtaaattttccacgctgtctgccggctactggctctttgtgactgcgggcgttagcgacaccgccaacacgactactggcaacacggatgcctacacctcgccgattttcgccatcgtcggcggagccgatgtgaatgcggagcctaagaagggtgtccccaccgtcaaaaaggaaatcctcgatgacgccgatgctgatgctgatggcgttaacatcaagacttccaaaaaatggaaggatatcgccgattcccaaatcggccaggaggtcaactacaagcttaccggttcggttgccagcaactatgctacttacgatagctatgcgtacaagtttaccgacgagctttccaacggccttgaatacgttgatggatctgctgaggtatatgcgctgaacggctctacctataccccaatcgatgggaccaattactacgtaacgaaacctgatgccagcaataacaacactcttacggtcgagttcaaggttgatgaaactgataacggcctcaaggacgttgcgggcataaatgatcaaacccagattgttgtcttttatagggccaagctcaatggcaatgctgtaattggcaacgctaaggatgagtctggtaaacccaaaaagggcggcaaccccaacaccgttacgctcgagtactccaataatccgcatgcccaaggcacgggcaagacgattgagcacaccgtcgccgactttgcgttcaggctcaatctcaagaaggtcgaccagggcaccgagaagggccttgagggcgccgtcttcaccatccagtctgctgatgtgaacaccatgggcaagtacgtcgcttcaacggcgggagaatttgggggcagcaacgtcgtcgctggccagctcgtggacgtccctagcgacactagcgtcgaaaaccttcctgattgtgtgaagttcacgtccgacaataacggcatgatcacctcctccggcctcgacgccggctcctacaaggtaaccgagatcaaggctcccggcagcaacaaagagtacaccgccgcagaacacttcacctttactatcactccggagtattccactgacggcaccatgaatgtgaaaacgatcggcgctagtctcgattccccccgtagcgatgttgtcttaggcgagcttgacgagaccgccggcgacaacaagctgaacgtcaatggtgacagcgccaccaatcctgcagatggcgtaatcaacatcaccgtcggcaataccaaacagatcaaactcccgctgaccggtctcaacggcgtgaccttcacttggattgctggcggcgcgctgctgtgcattggcgtggcgcacctcatccgtagtcgtaagcgcgacgacggttctgaggagtagctgttcgcctcgaatatcaacacgagatatgaaaaagcggggcacccggtcgatgcgatcgggtgccccgcttcgtttgttggtgcaaagcaacctgacccctttgcaccaccataaaggtgcctgtcccctttatggggtttggcggctaagcggtggggagttctggcgtgttagccggctgctgcggcttgaggtgggcgttgcgccagatggtctggataacgtagccgagcataaggacaaaggccgcgccgctgatgaagccgcctacgaggggaagccccgtgagggcacctgcgattacgccgcccacggctgccatggcgtagcggttctggttgtgtccgaccatgcgggcaatggcgcagcccgcgaaggcgctcgacaccaacgcgatgccgataacgccgcacaagagggctccggcaagcgacagacctgcgatagagataatcagcagtaggacggcgggggcgatagcaatcgcacccagaagaccgctcacccacagaggcatgggacgctggtggagcatgccggcggcgccggcggtcgcgcgcggaaagacgagctcgagcagcagagcgacaaagcaggtcgagagggccgcggcgacgataccgccgatgacatcgttggcggtggaagtatcttcgttctcgatgcggtcgatcttgagcgcgccgacctcggctcccgcggcgcgctcggggtcctcggagacgtgcgcgttcacggtgccggtgatgtgggcgttcttgcccaggatgagcttgtcggcccaaacctcgacatcgccctcgacggtgccatcgatggtcaccgtgtcgcctgcaagcgctgccgacttggtagagccgcgcagggcaaccgtctcgcccaccgcgtaaagacagttggcagagctgtcggtgttgagcacaacgtgctgaccgaccaccgtgacgctgccatcaaccgtggtcttggcgatatcgatagtgcgtgccgccagacggacggcaccgcccaccgtgcagccgcggatcgagagggtatcgcccgcggcgatgatatcgcggtcgatggaggtatcgtccaggttgaggctctgacctgcccagtacaggtcaccttcgacgccggacggagtggcgtcattgtcggtcgcaagtacgttgcctgcggtgtccgtgccggcaagagccgtagcgggaagtgcggtgagcgccagagcgatgagtgcgaataggatggtgatgcggccccacgctttacggcgttgggtcgacgggaattgattgtggggcatagtgaatccttcgtcagatgctcgatatgcacctaacagggtacccaacgcgtgggcgctctaaaagaacctctcggttgcatttcgaaggatgagcccgcgcaatctactttttgtggtgcaaaaagcgcgcgatgtcctcttcggtggggcttttgatgtcaaaacgcagcgacagccagcgcagccccatggttaccgcaacgcatacgatcaacgcggtgatgttgctgacgacgccgctcatgacaaggcatacatagctcgccgagccggcgatggctgcgatggcatagaagttggtgcgctggaaaatgcccggtaccacgcccataaaactgtcgcgcagcatgccgccgcccaccgcggtgaaaaagcccatcatgatgcacaccgccggcgcaaagccgtagaccagtgccttgtctgctccggtggcggcgtagatgccgactgagatgatgtcgagcaggggaatgagtttttcgggtttgtcgacgattgccgggaaaatgtagatgatggctgccgtggcaatggaaagcggcagcgccattggctggttgaggatgtagacgttgcccacctgcagcgtcatgtcgcgtaaaagaccgccgcccaagccacagaccacggcgagcgcaactgcacccaccaggtcgagtttgtgctcgcgcgcgaccaacacgcccgagattgaagccgcgacgacggcgaacatttcgagccaaaacgggatggcgaccatggcatccgtggcgtgtgaggtaacggttatagcggcgacgacgggcaagatggggtcctttggattacggatttggacaatgcccgtacatagtacatggttggcgggcgtggtgaccctattgctcggtaaacggtcgggactgggaacggtcatgggtaccaaacatatacatcagccttcaaagatgccgaaaaatgtcgtttttggagggtgatgtacatgtttttgagggaggggcgggttcgaatcccttctcctccgccgtatttgcttgtaagggactctaaacaaaaaagcccccgttttcgggagctttctcaaccaaaatggcggaggaggagggattcgaaccctcgtgaccttatacaggccaaacggttttcgagaccgccgcattcaaccactctgccacccctccgcgtggggtaaaaacaaagcaggctcgaaggcctgctttggaattaactggcggagagtcagggatttgaaccctggagacgcttttgacgcctacacgatttccaatcgtgctccttcggccactcggacaactctccgttaaatgcgaaagtcagtatacacgaggaatcgcaaagtgcaaacagaaaagttggcattttttaaaacgctcggccgcgtttggcgttgcagtggggtttgaggtgccaaaaaacggcttccgaccagcgtggttgatcaactcaattgttcaaaaggggtattcataagcgacttggcaatgaatttaaaaatctttgggtggtgctgtggaccactggtatgcattttgcgaccacagccttgtgcccgttgacctgcggcttggctcagcttgtccccgcggcaccgtatcttgtccacaaatccgtcaagctcttggtcggcatttggttggaatgcgcatgaaacgtggtgcgagcatgggcatatgtggaggtcatgaggttgtagctgcatattcttgcggcttgggaggttgaaagatattattaccaagtcttttcctgcttcaggcgcaccttcacgacctgaagccacatttgcccagaggaggtgacaatatgaaggcttatgaactgctgttctttgttgacccgtcgctcgaccccgagactcgtctcgctgttatgaagcgtatcgataccacgatcgctgagggcgctggcaaggtcgactccgttgacgagtggggcaagcgcaagctcgcctacgagatcaacgacctcaccgatggtgactacaccctcatcaacttccacgcagatcctacccagatcgccgagcttgatcgcgtcctgcgcatcaccgacgctgtggtccgccacatgatcgtccgtcgcgacgaccaggagtaagactgtcgttttggactgggcttgtgccccaagaggaagtagtgagttatgagcatcaatcgagtgaacatcaccggtaacctcacccgcgatcccgagctgcgcgccaccgccggcggaacccaggttctgtcttttggcgtcgccgtgaacgatcgtcgccgcaacgcgcagactggcgagtgggaggactatcccaactttgtcgactgcactatgttcggcacccgcgccgaggccgtgagccgtttcctggcaaagggaaacaaggtcgcgatcgagggcaagctgcgctacagctcttgggagcgcgacggccagcgccggagcaagcttgaggtcatcgtcgatgagatcgagtttatgagctcccgtggtggccagggtggctacgatcagggcggttacgcccccgcagctcccgcgcccgcagcacgtcctgccgcaccggtggccacgccgcccgcggtcgacgtctacgatgaggacatcccgttctaagggttgttcacctatttttgagtgagaggcggcttcggttcgccgaagttgccaaatgaaaggtattttgacatggctaatgatttttctgcacgtcagccgcgtcgtaagtactgccagttctgcaaggagaacactgagttcatcgactataaggacactcagcttctccgtaagtacatgaccgaccgtggcaagatcaagccccgtcgcgtcactggcgcttgcacgcagcatcagcatgacatcgccaacgccatcaagcgcgcccgcgagatggctctcctgccgtacaccgtccccgtggtttcctctcgtggcaaccgcgaccgcggctaagaagggagacgcatcatgaaggttattcttctcgatgaaatcaagggcaagggcggcgagggtgacgtcgtagaggtcgctcagggttacgctgagaacttcctgttccccaagaagctcgctgttgccgctaccaagggcaacctcaagcagcttgacgagcgtcgcaacaacatcgccaagcgcgaggccgtccgtctggctaccgccaacgagaccaaggctgcccttgagggcaagacggtcaccgttgacgtcaaggtcggcgacgagggcatcctctttggctccgttaccgccgccatgatcgctgacgccatcaaggctcagctcggtatggacatcgaccgcaagcgcgtcgaactcggtaagcccatcaaggttgccggtgcccacaccgttgccatctcgctgtaccgcgagatcaaggccgaggttgtcgttctcgtcggcgttaccgccgaggagctcgctgccgaggctgaggtcgaggaggccgctgaggtcgccgaggccgagaccgccgaggtcgagactgaggctgctgccgagtagcatttgctgcaacgcaacaatcttgttctaagaagggcactctgggaaaccagggcgcccttttgtttttttgcgctgagtgagtgtcatggtgaacgttgcgtcgaagtcctatatacaggatcgttcatccgcttggttcggtgatgattggcggcgcgcggcgcgttttgggaccgtggctgatactatggatgctcgcaagcgatatgaatgaggatgctcatggcatatgacgatagggagaccgggctgacggttgaggaccgcggctcaaagttgggtcttccccaaaaccaagatgcagaggccaatgtactggccgctatgctgctatcgcccgaggtggtcgaagaggcccaggtcgagctgcagcccgatgacttctaccggcccattcataagaccatctataccgcgatggtcgatatgtacaacagccgcattcctatcgactccatctcgctgatcgattacctgcgaagcatcaacaagctcgatgccgtgggcggcgaagcgtacattttggagttgatgggtcagactctgtcgctcgtcaactggcagcaccatgccgccatcgttcgccgtgattcgatgctgcgtgagctgatcggcgccaccaacgagatcaacgcgctggcatataacgcccccaccgacaccaaagaggtcgtggagctagccgagagcaagctgctcaaggtcacggcacgcgaggtcaagtcgagctataagacgctgaccgagtttatggtcgaggcctataacgaggccgaggaagtgtgccaggccggtggccaggctgcgggcgtgcccacgggcttcccgtcgctcgaccgcatgctcatgggttttcgcgagggtcagctcatcattatcggcgcccgccctgctgtgggtaagacgtcgttcgccctgaatctggcgctcaacgccgccgctgccggttataccgtcggcttcttctctctggagatgtcgggcaaggaaattgcccagcgtctgatttgcgcctacgccatgatctcgatcagtgacttccgcatgggccgcattagccccgagcagtgggccaatatcaacgaggccacgcagaccttgtccaagctcgatattctgattgacgatacgcccggcaccacggtgaccgagattcgcgccaagagccgccgcatgctccacaacaaggagaaggccatcatcatcctggactacctgcagctggtgagtcctccgccgggacgccgctccgagagccgtaccgtcgaggtctccgagatgtcgcgtggtctgaagatcatggccaaggagctcaagatcccgctcatcgcgctgtcgcagctctcgcgtcaggtcgaatcccgtaccggcaagcgcccgcagctttccgaccttcgtgaatcgggctccatcgagcaggacgccgatatcgttatgttcttggaccgctccgccgacgaggccgaagcctcgcgcgacgatcgacccgacgagggcgttacgcgtatcgtcgtggccaagaaccgttcgggcccgatcggcgacgtcgacctgatgttcctgccggcatccaccaagttctatgagcttgatggggcacatgccgaggagtaggacaggcgcccgttgcacgggtatactgggaatgttttgtgcttctgcgtgccggcgtggcgcgtagacagtccatgaatgtaaggagtaaacatgccgtcaaccgttttggtcggtgcccagtggggcgatgagggcaagggtaagatctgcgacctggtcgccggcgacttcgatgccgtcgtgcgctactcgggaggcaacaacgccggccacaccatcgtcgtcaacggcaagaagtacggcctgcaccaggtgccctccggcatcatgtattccgaccacgtgtcggtgatcggtaacggctgcgtcgtcaatcccaaggttgtccttgaggagatcgacatgttcgaggccgacggcatcaccaccaagaacctcaagattagcggcaatgcgcatgtcatcatgccgtaccacatcgatctggatggtgcctttgagcagaagctcggcaagaagaacatcggtaccaccaagcgcggtatcggtccgtgctatcaggacaagatggcccgcattggtctgcgcatgcaggacatgctggacgaggcactgttccgcgacaagctggagaccgctctcgcccgcgtgaaccctgagctcgagctcatctacaacctgcccacctacaccgtggaccagatttgcgacgagtacctgcccatggccgagcgcctgcgcccctacatcaccgagacgagcctgctgctcaacaacatgatcgatgagggcaaggacctgctgtttgagggcgcccaggcgacgctgctcgacatcgaccacggcacctatccgtacgtgacgtcttccaactgcaccgccggcggcgccatcatcggctccggcgtgggcatgaagaacgtcgaccgcgtgctgggcgtcatgaaggcctatatcacccgcgtcggttcgggccccatgcccaccgagctttcctatgagtccgaggccggccacacgctgaccgaggagggctatgagtacggcgtgaccaccggtcgccgtcgtcgttgcggctggtttgacggccctatcgccaactatgcctcgcgcgtcaacggcctcaccgacatcgccgtgaccaagctcgacgtgctttcggccttcgacaccatcaaggtgtgcgtggcctacgacgtcgatggagagcgctacaccagcgtgcccgagcatcaggtgcgctttgagcatgccaagcccatctacgaggagcttcccggctggaagtgcgacatcaccggttgccgcagctttgacgagttgccgcaagaggctcaggactacgtggcgtttatcgaggatctggcacacacccgcgtgacgtttattggcgttggcgctggtcgcgagcagatcatcaaccgattctggaagtaatcgggactatttggttattgcgatatacccctttgcagcccggacgggcggccgaggggtatatttgcttgcaaagggctcgcgcggagcgggccattcatccatagaggaggcacccttgaaggcggacactcaaaccatcgacatcctgttgttgggcagcggcggccgtgagcatgctttggcagctaagctcgcagcatcaccgcgcgccggcaagctctacattgcgccgggtaacggcggcaccgcgagctgcggcgagaacgttgttctcgacgactgcgatcctgcggccgtggcggcgtttgcgcagagccacggatgcggactcgtggtaattggccccgaggctccgctcgtggcgggcgtggccgacgccgtgcgcgcggcaggtattccctgctttggcccgggtgccgagggcgcccagatggagggttccaagctgttctccaagcagctcatggagcgcgccggtatcccgacggcagcctatggttcgtttaccgacgaggcttcggctctcgcctacgtgcgcgagcagggcgctccgctggtcgtgaaggccgacggccttgccgcgggcaagggcgttatcgtggcgaccgaacttgagcaggccgaggaggccgtgcgcgagtgctttggcggcacctttggcgatgccggcaataccgtggtcatcgaggagatgctcgttggtcccgagtgctcgctgctggcctttaccgacggcaagaccgtgcgccccatggccacctcgcaggaccacaagcgcgcgctcgagggcgacaagggccccaacaccggcggcatgggcgtctacagcccggtgcccatcgtgaccgacgaggagcacgccaccatggtggcggtcatggagcagaccgtggcagagctcgctgccgagggtatcgactaccgcggctgcctgtacggcggctttatgctcacgcctgccggccccaaggtgctggagttcaatgcccgctttggcgatcccgagacgcaggtcgtgctgccgcgccttaagaacgacctggtcgaggtcatgctcgcctgcgccaactgcgagctcgatcagattgagctcgactggcgtgacgagtgggccgtggccgttgtcctgacgagcgcgggctatcccggcagctacgagaagggcaaggtcatcaccggtatcgccgatgccgaggccatggagaacgtgaccgtgtaccacgcgggcactgccgtggtggacggccagctcgtgaccaatggtggccgcgtgcttgccgtgaccgctctgggcgacacgttcgagaacgctcgcaaccttgcctacgaggcctgcgagaagattgattttgagggcaagaccctgcgtcacgacatcggcctgcgcgcgctgcgcggccgcgacgcctgggatgcctaaagtccgagaggaatgagatggatggacgagaagaacgaagagctcgtggatgcgcagatcgtcgaggaggacagccgcgtgtatgggcacgccgagggcgagcctggcggcgaggtcgctgacgagccggtgctggtgctgggcgatgacgacccgcacgatgccgagctgcacgagaagattctttcggaggagtgcgcctggaagggcaagatcctcgacgtccaccgtcttgaggtggagctgcccaacggccaccgcagcgcccgcgacatcattcgtcatccgggtgcggcggccgtggtggcgctgaccgagagcggcaagattgtgctggtgcgtcagtaccgcactgccatcgaccgcgtaacagtcgagattcccgccggcaagctcgacccgggcgaggatccgcttgattgcgccaagcgtgagctgcacgaggagacgggctttagggccggtcgcattcgctttttgacgtcgattgtcacgacctgcggcttctgcgacgagatcattcatatctacctggctaccaagctcgagttcgacgcgcccaaccccgatgatgacgagtttgtcaacgtggacctggtgccgctgcacgagttgatcgacgccgtactcgacggcaagatcgaagacgccaagaccgtcgtgggcgccttggcctgcgatagcatcgcgcaccgcttgggcggagccgagctctaggttacgcggttttaccaaaccgcgtaacgagtcgacgctgcaaacgcccctaagcggcaatctgcctttcaatcgtcgctcgcgtaccgaagtacgcgtcgttcctctttcaaggcaccttgctcgctcagggacgttttcgctgacgctgccagaacatcggcgttatgcttgttgggacgctttgttttcagcctgaccggttcaaccggatttctcacgctatttatttctcttcgaggattgcatgtttaaaaggtttctttcgtattacaagccccagatggggctttttgttgctgatactgtttgtgctctggtgcttgctgccattgaccttgcgtttcctattattctgcgcaatctgaccggcgggttgtttacccagggtcaggctgccattatgcaggcgctcggtatgatcgcggtgggtttggtgctgatgtatgtcatccgttgcgcctgccgctattttgtgagctattggggtcacgtgatgggcgcgcgcatggagtccaagatgcgcgaggacctgttcgaccagtatgagcgctttagctttgcgtacttcgaccgcaacagctcgggcgatatgatgagccgcgtggtcaacgacctgttcgatatctgcgaggcggcgcatcacgtgcccgagtggatcatcatctgcggcatcgagattatcggctcgtttgtgatcctctttaccatcgctccggtgctggcgcttgccatggctgcggtgacagcagcgtttgcggtcatcatgttttggcagaacatgcgcatgcgcgaggtctttagcgacaatcgcaaaaaaatcagtggcatcaatgcacagctgcaggattcgctggcgggcatgcgcgtggtcaagagctttgccaatgaggagaccgagcgtgccaagttccgtgcctctaacgaccgctacctttcgtccaaggaaaacatgtatcacgccatgggcgtctatactgcgacgtatggcctgctctcgggcgtgctgtacgtgatcgtggtgctgctgggtggttggctcgttgcccagggtcagctgcaggcggtcgatatggcaaccttcgcgctctacatttcgctgttctgcacgccgctcgagacgctcgtcaattcggccgaaatgtatcagaaggccatcgctggctttaagcgtatggacgaggtgctctcgaccgcgccggatatccaggacaagccgggcgccacggatctgcaggtgaccgccggcgccgtggattatcacgatgtgtgctttaactacgaggacgttgagctgggcgagggtgatgccgacgagcgtcccgttatcgaccatatgaatctgtccatcaagcccgggcagaccatcgctttggttggcccttcgggcggtggcaagtccacgacctgttcgctgctgccgcgcttttatgacgtggctgccggatccattagcatcgacggccaggacgtgcgcgatgtgacgcagcagagcctgcgccgcgccatcggcctggtgcagcaggatgtctacctgtttgacggaacaatcggcgagaacatcgcctacggcaagccgggcgctacggctgaagagatcgccgaggccgcccgtcgcgccaacatcgatgcctttatcgagtcgcttccacggggctacgacaccgtggtgggcgagcgcggcagccgtctttcgggcggacagaaacagcgcgtcgccatcgcgcgtgtgtttctcaagaatcctaagatcctgattttggacgaggcgacgagtgctttggataacgagagcgaggaggcggtgcaggagtcactcgaagagctggcacgcggccgcaccacgattatcattgcccatcgtctttcgaccattaagcatgccgatgagattgcgaccgttgagcatggtcgcgttgtggagcgtggcacgcacgaggagcttctcgcccatggtggcacctatgcccgttactatcgaatgcagttcgaaggtgcgcgtgcgcacgagctcgactgattgatatgacaggaagtttatggctgacaagaaccctttgactccggaagaagtgacggagttattctccgaaatcgatgcatccggtgtcttggatcccacgcttgccaaaaagcgaaccgagcgcatgcgtgagaaggaggttgcggccaagcgcggtgacaaagcggcgctagcgcagctgcgcagtgaggaccgcgcgagccaggcaaaacatatcgacccgctgtccgaggacgatccttcgggctcgcaggtgagccataccattacgaagaccgcgatggccgtggtcatcggtattctggtgctgatcgtgggcatgcagatcggctacggcgtgatgcgccgtctgaataccgccaacctgtccgagagcgtttcggtggataccgtctcgaccgcgctcaagggcggccttgagtggggcaacggctttacgcagttcccgctcgactttaccgtcgatgaagctgatgagcgtacgggcacggtcgaggtgacggtgttggacacatcgtctgccaatgagctcgagctgctgtccaacgggcagatccaggccgcggcgcttgcgaccaacgccctgctcaacgacaagattgaccgcgtggtgtataacgttcacgcctatatcgacgaggatagcaacattcagcacgattccttttttggcatgttccccgcgcggggtcatcagagcgccattttgacgtttgtgtggaccaagagctcatccaacgccacgagtatcgactggaagatgcgcatcgtaagcatggacgacaccattgccgagcgcattcaaaaacaggtgaactcggtttcgtcgctgatcgaggaccaggtggtgagccagaccaagattgacgaggaaaaggccgaacgtgacctggagcatcgtctgcatggccgcgagattttccgcggcggcaagcccgatcgttcaccgtccgatctgctggaacaggacaagaaaaaataagacgccatcatcccgtgtgagccacaagccccgcgggatgatttttaatccccgtcccagaaaaatcattatgcatagaaagtcataattatcatttcgtaaacatttcgatgaaattaacgccatgaggcatgcttgcggttacaataccgcgaggcctaactacacacctttaagccggtcctgtgagaccgggaaggagaattatggcgaacaaccataccgcgggcgctgccgcccgcaccttcgcgcccagcgagctttgccagcgtatgctggccaaaaccagcaagggcacctgcggtccctgtatcctgtatcttgaggatgggaccattttttatggacgtgcatgcggcgccgagggcaccgcgaccggcgaagtctgcttcaacacctcgcttgagggctactttgaggtcatgaccgacccgagttatgccggccaaattgtaaccatgacctatccgcagatcggcaattacggtatcgacgagaccgatgtccagtcggccttccccggcgacgccgtgcgccctgcgagcgctccggctatgcgcggcatgatcgttcgcgacatgtgcgccacgccttctaactggcgctcggccgtcagcgtgccggagtacctgcgcgctcacggcatcgtcgctatcgagggtgtcgacacccgcgctctggtgcgccatctgcgcgacaatggttccaagatgggcattatctcgacagagatcttcgacgtcgacgagctcgccgagcgtctggacgcagcgcccacgctggtgggcgagaacctggtcaagaccgtgagctgtcccgtgcctcacgagtttgtggccgccgacctgcctgccacgcatggctttgcgcttgcggctgccgctcctgcccgtcacaaagtggtcgcctacgactgcggtgtgaagcgcggtattctggagggcctggtccgtgccggctgcgacctcaccgtcgtgccgtgggatacgcccgcccagcaggtgctcgacatgaatcctgatggcgtctttttgtccaacggccccggcgaccccgatgccgtggtggagacctacgagcaggtgcagcagctgatcggcaaggtgccggtctttggtatttgcctaggtcaccagatgatcagcttggcctgcggcgcccaaatggaaaagcttaaattcggtcaccgtggcggtaaccagccggttatgaatctggtgagccgtcgcgtggagatcaccgcgcaaaaccacggctttggcctgctgttccccagtctgggcaaactgattccggagctttccggcggcgaaaccgagcatgcggccgatggcgacctgcgcgcctgggtgcgccgcggtatcgcgccggtcgtgatgaacgagcgctttggccgcattcgcctgacacatgtgaacctcaacgacggcaccgccgagggcatccagctgctcgacgccccgtgcttctcggtccaataccaccccgaggcttcgcccggccccaccgatgcccactatctctttaccgcctttacgcgactcatagacggcgaggagaactacctggacatcgacaccgcgaaggaccgcctcgccggctggaatttcgccgagtccgagaacgctgcgaccgaggagaactaacatgcctaaacgtactgacatcaagcgcatcctcgttattggttcgggccctatcgtcattggccaggcctgtgagttcgactactccggcgcacaggcctgcaaggtgctcaaggaggatggctttgaggtcatcctggtcaactccaatccggcgaccatcatgaccgacccgggcttggccgaccgcacctatgttgagcctatcaccgccgagtttatcgagcgcgtgatcaagaaagagcgcccggacgcgctgctgcccacgctgggcggccagaccggtctgaacgccgccgtcgagctggcaaaggacggcacgctcgacaagtacggcgtcgagatgatcggctgcgacctggccgctatcgagcgcggcgaggaccgcaaactctttaacgaggccatggccgagatcggcctggaggtcgcgcgctcgggctatgcctacagcgtggccgacgccgaggctatcgccgagcgcgtgggatatccctgcgtactgcgcccgagctttaccctcggtggcgccggcggcggcatcgcgcatacccacgaggagctcgtctccatcgtgagccagggccttgagctctcgcctgcccatgaggtgctggtcgaggagtccatcgagggttggaaagagtatgagatggaggtcatgcgcgaccacgccggcaacggcatcatcgtgtgctccatcgagaacctcgaccccatgggcgtgcacaccggcgactccatcaccgtggcgccagcgcagaccctctccgaccttgagtatcagcgcatgcgtgtcgcgtcgctcgccattctggagaagatcggcgtcgagaccggcggctccaacgtgcagtttgccgtgaacccccagaccggccgcctgatcgtcatcgagatgaacccgcgcgtgagccgttcgtccgcactggcctccaaggccacgggcttccccatcgccaaggccgccgctcgcctggccgtgggctacacgctcgacgagatcgtcaacgacatcaccaaggcaacgcccgcctgctttgagcccacgattgactactgcgtggtcaaggtgccgcgctttgccttcgagaagttcaagggtaccgaccccacgctcaccacgcgcatgaaggccgtgggcgagatcatggcgatcggccgcacctttgaggaggcctttggcaaggccatgcgctcgctggaggacggacatcagggcatttgcgccggtggcaaggagggtgccgacaagctgagcgacgacgagctcgctcaggccgtggcaaccccgaccgagcaccgcatcttctttgtggtcgaggccctgcgccgtggctgggacatcgctcgcatccatgccatctgcggtatcgatccgtggtacctcaaccgtatcaacgatatggtgcaggtccaggagagcatccgcggcctgcgtgtggaggatatcgacgccgacgcgatgcgcctgctcaagcagtacggtacgagcgacgccgagatcgccgcgctgaccggctcggacgagcgctttgtgcgcgcctatcgcaagggtctgggcgtggttcccagcatgaagacggtcgatacctgcgctgcggagttctcgagcgccacggagtaccactacaagacgtacgagaacatctaccgcacgagtccggatgccaagaagtgcgtggctcccgacgagaccacgccggcggacaagcccaaggcgatgatcctgggcgccggtcccaaccgcattggccagggtatcgagttcgattactgctgcgtgcacgcgagctacgcgctggcggcccgcggctttgagaccatcatggtcaactgcaaccccgagaccgtctcgaccgactatgacacctcggaccgcttgtactttgagccgctcacctacgaggacgtcatggatgtcatcgatgttgagcgacccgacggcgtcgtggtgacgctcggcggtcagaccccgcttaagctggcgcgcatgctcgaggagagcggcgtgaacatcatgggtaccaagcccgacgccatcgactttgccgaggaccgcgagcgcttcgccgctctgctcgacaagctgggcatcatgtacccgccggcgggccaggccacctcgtttgaggaggccgaggccgtggccgcgcacatcggctatccgctgctggtgcgcccgagctatgtgctgggcggccgcggcatgatgatcgcctacgatgccgagcatctgcgcgattacatggccgaggctgcgcgcattagccccgactacccggtgtacctggaccgcttcctggagggtgcgatcgagtccgacgtcgacgccctgtgcgatggcgaagaggtatacatcggcggcatcctggagcatatcgaggaagccggtattcactccggcgactccgcgacctgcatcccgccgttcagctttagcgagagcctgcaggcgaagctccgcgagaccacgcgccgcatcgcgatggcgctgggagtccgcggtctggtcaacgtgcaatatgccatcaagggcgagaccgtctacgtgatcgaggccaacccgcgcgccagccgtaccgtgccgtttatctccaaggccaccggtgtgccgctggccaaatgcgcggcgcgtatcatggcaggcgattccatcgcgagcttgggcctgccgagcgacgaacgtcagctggactggttctgcatgaaggaagccgtcatgccctggggtcgtttcccgggcgccgacgtcatcctggggcccgagatgaagtcgacgggcgaggtcatgggtatcgccaagagctaccccgaggcatacgccaagacgcagctggcaatcgactacaagctgcccgatccgagttgcggcaaggtattcatcagcgtgtgcgaccgcgacaagcgtcatatcctttcggtcgcgcgtatcctgcgttacctgggctttgacatctgctctaccgagggtacggcgcgcgtgctgcgtggaggcaacgtgacgtgcgagatcgtggagaagattagcggcccgcacgacggcgagcgccccaacatcggcgacctcatcgccgatggcaagatcgcggtgatcatcaacacgccgtacggtccgggctcgcgcggcgacggctatctgctgcgcaccgaggcagtgcgacgcggtgtgacctgcgtgaccgcgatgtctgccgccaacacgtacgtgagtgccatcgaggcggtgcgtgaggaccagcagggtcacggcagcgccaacgacatgggcatggacgtcatcgccctgcaggacctgccgcagcacacggtgtaatgtgacctggtcggccggggcggcagccggacactttctctcggaaactgggcttcgcgaagttttccgagagaaaggtccgcctcccgccccggcctgcggtgacttggccgcaccgtgtgctgccgaaggggctttgtgcgatgactagggctgaatagaaaatgagtgtgggcgccgtcgttcgtttgaacgacggcgcccacgttttggatttattgggctgtggcggtgaaggttgttttgtcggcggcgatgtgcacgtgcagctttgcctgaccgtcgcagctgatgagcacgcctacctcgaacggggttcccgtcttgtcgtaggtcgaacgcacgatgcgcatcgccgccttaccggtgttctgtcccaaaagacgcgcctcatgcttgtcgaggttgaccgtctcgtagacggcatcgacgcttgcgggcaggatgccggtcttttccgcgatgtaggcgtagagcgagccatccacgtctttgcgcgtgagctcggggcaaagtgacacggggatatagacgtagttgagctccatgggtttgtcgttggcgagacgcaggcggcgaatctcccagacgggtgtcccttcgggcactttgagcccggaggcgatgccgcggacggccggtatgcttgaaaaggcgagaatctgcgagctcggaacccgtcccgcttcgcgcatccgcgcgctgaaattcagggccaggtcgatgccgggtgctgaagtttggggcttgatgaacgtgccctggccgcgcttgcgcaccacgcgcccctcgatgacgagatcttggaagcaacggcgcacggtcgcgcgcgataactccagccgctcacagatttcgagctcgcgtggcagcggcgtcttggtgtcgaacgcctggctggcgataagcagagcgattcgatgtttaagctggacatagagcggcgtatcaccgctgcggtcgaagggttcggaggcgagaaacgagatcatatccatggggtacctccatgtcgtgggcgtacgtgacatggtctgacactgcggggcaaaccggagatgccaggcccgattcttgctggtatgtatggtgcataaggaacataaaacatttatcaggcaatctacctgctattttaaaaataattagaagaaaaaataatttaggcacaaaaatagttgctaccgttaaccgatgaatagttgccgttcgcaactattttcttgtaccgaacatgccccggcgcaacaataatctcagcaaaaagcaaagccgtgcgacacacggcaggtcgagaggagaccgcatgcggtatctggtaatggtcagtcacggaacgctcgctcccggactgcacagtgtcctcaagatgctcggcaatgacgccccgaacatcttgtcgacgagtctcgtggacggcatgggcgctgacgagtatgtcgagaacgtcaaggcgatgctcgctcccgttaccgccgatgacgaggttgtcctgcttggtgacatcctgggcggatcgccgctcaccaatgccatgaacacgctggccgagaagggtttgctcgcccacaccattgccttcggcggtatgaatctgcccatggctatgaccgccatgatggggcttgccaccatggacctggattccctcaagcagatgatgctgcaggagggcaagaacggtatgtccgagctcgttgtcccgaccgatgacgccgacgacgaggacgacgacatctaggcagcgcatccgcccaaattttcgtgatggagcgggggttaagaggaaagacccccggtgataaagaaagggagaacgcatgatttcgttcatccgtattgatgaccgtatgatccatggacagaccgttacccgttgggccctcgagtatccctgcgacggtcttatcgccgtcaacgacgctgcagcgtccaaccccgtgctcaaggaggcctacaagagtgcctcgggcaagaagacgttcgtgtggaccaaggagcacttcaaggaggtctccgagaaggttctcaagtccgacaccaagtacttcctgatcaccaagaacccgctcgacatgaaggaacttctcgtcgattttggctttaagcccggcatggaccgcatcatcgtcggtccctgcaacgatcgtcccggcaccaccaagcttggcaacaaccagtcgatcacgcaggaagaggcccaggcgctcgaggatctcaccaacgccggttacacggtcgagttcgcccttatcaaggagaagtccatcggtgagtggcccaagttccgcggtcagtttggcttctagttaggtgccagccgcattttggtatctacagcccttggtgaaaggggctgaggaataaagaaaggggaaagcatggcaatcaatgcattccaagccgcgctgttcggcctgttcgcctgcctggcatcactgcctggcatgggcggcacgacgatcggcaactacactctgggtcgtcctctggtcgccggcctcatcgtcggcatcatcatgggcgatatgcagacgggtatcctcgtcggcgctgccatccaggttgtctacatcgctctcgtgacccccggcggaaccgtctccgccgacgtccgcgccgtgtcctatatcggcatcccgctggcgatcctcgccatcaagaactcgggcatcgatcccgcctccgctgaggctgccggcatggccgcatccctcggtgccgccgtcggcacgctcggcactgtgctcttctatggcaccgccaccatcaacctggtgtggcagggcatgggctggaagtggctcgagaagggcgatctccacaagctctacctggtcaacaacgttctgccttggatcggtcacatcgtctgctcgttcctcccgacgttcatcatcaccatgggcggcaccgccatggtcgacctcatgaagacctacatgcccatggacggcatcgcgatgaagacgctgtttaccgtcggctcgctgctgcctaccgtcggtatcgccatcctgctcaagcaggtcatctctaagcccacggacttcctgacgttcttcttcggcttcaccctgtccgctgttatgggctgcaacctgatcgccgctgccggcatcggctgcttcttcgccctgatcaactatgagatcgcttcgctcaagatcgacctcgcaaacgctcccaaggcagctatcgcctcgggctcagatgatgaggaagaggaggacatctaatggcagagaagaaaaagctctctaagaaaacgcttgccaagtcgttccgtaactggtcctatggcaacctgacctgcttctcgcaggagcacatgcagaccttcggttacctgtgcgccatgcttccgattgtcgaggagctctacgacacgcccgaggagcagaagcaggccctccagacctactccgcgttcttcaacaccgagccgcagatcggcaccatgattgtcggcgtcaccgccggcctcgaggaggctcgcgcaaacggcgaggccatcgacgacgacgccatcaacggcatccgcgccggcctcatgggcccgctcgccggccttggcgactcgctgatcgtcggtaccctgatcccgatcctgctcggtattgccctcggtctctcgaccggcggctccccgctcggcgccatcttctatattgtcgtgtggaacctgctcatgttccttggcatgcgctttgcctacaaccagggctatgagctcggcggcaaggcggtcgaggccctcgtcggccccaaggccaaggctctgcgtgattccatcgtgatggtcggtaccatggtcatcggtgcagtcggtgctacctgggtctccatcacctgcagccccaacctggtgctgcccggtggcggtaagttccaggacacgctcgatggcatctatccgcacctgctgccgatgatcttcatcatcttctgctggtacatgatgaccaagaagaaggtcaaccccatcgttatgatgctgatcctcgttgtgatcgcatttgtgggcgttctcattggcttcttcgacccggcactgagctactagtcatcatcccctggccccctgtaaggccgtgcggcctcaaccgcacggccttctgattttgcgccgcccttcaagggcaatatggctagcgacctccatcgcctacacgacacccgctatattgctcttgaaagatgacgtattcgacaaacgatgcacttgcgcatgatgcacactttgcacgaggaggaccatatgcacgagaaacatggacacgacctttcgcgcgacgacttgattcgcgaggcaaagatgcagaccgatgctattcagcggctcaatgtttggctgcgcctgggctattcgctcgtggcgattggctttttgatggggatgtggggtatgcagggcggccccggctggggtgtccccgtgggcatcgtgtgcctggtggtgggcactccgctttcgatcgtgcttaaggtcggcacgaccaacgccaaaaagaatgtcgagcgcatgctcgaggccgctggtgtcgacgttgaggagcttatgcgacgcaagaaggacgagcaatagacttccgcgttggggtatcataaaaaaattgttgcgaatgttaactaatgtacggcaaatgacggttttatggcccttctagagttgcaaaggacaatatccccagtggattacgatgacgtcgctcgaaaactgattgtgtactcacgttcccttgccaagggatccttgagtgctgccggcggcgccagtgtgggcgaggcaccggttttacagtatctatcgggtattgacggtgatgtcattccctccgagattgccaagaagctgaaattctcccgtgcgcgcatgtcgcatatcttggattcactcgagagtaagggttacgttcagcgcaggactgatccaaacgatcgtcggcgtgtgctggtgagcattaccgaggaaggccgtgatttcgcggcgaaaaaaaatgccgagagtgtggcatcgctctcgaaacaactctcagcgctcggcgagcacgatgcccaggagctcgtgcgcatcctgaataaagcttacagccttacctatgatgccgacgactacctggacaatctataaggataaagacagacatttaggtgcatcttgaaatgcacccgggacagttgtgcccatcagccaccgtcaacatctcattccaaaccaaatcagccaacgtacgtcatggcaatccccggtaggttgcaggatggcggctgagcctttccctcgggaaacttcgcgaagcccagttcccgagggaaaggtatggtctgtgtaataccagacaaacagtacatttttgctagattggtatttgactgaagaaccaattggtatggcttattaagcccaccttgccgttgacgcttattttgctgccgctgggagaattccgaacttgggtgcgcaagtgctcccatatgttgatatgacctagtaggtggctatctggttactatcagttggccccttggtaacgggtggcccccattgtgcggaatgtaccgaacatctccgtttgatacgttttcccatgctgccggggggcgtcctcggcacctcagcatgtcggaagaaaggagaccagatgcgcaggaattccatttttacgaaacggtgggtgaagggaagcgcggtcctcgttgccactgcagcgacgctcgtgtttgccaatccccagcaggcgattgccacgccactcaagggcgtcgactcggcgaccgtgtcccagtctgcctcgaatgtcgtcgacatcgatttcgctgacggcatcaagggccgtattacgttcctcgaggacggtattttccgttataacgtcgaccccaagggtgagttttccgagtacgccacgccgcgtagtaagtcccacacggctaagatccaggctcagcccgatacctcggacacctacagcaagccgagtgcgacggttgccgacaagggcgacactatcgagatcaccggcggaaaggcgaccgtgatcctggacaaggcgactggcaagatgagtatcaagtcaggcgaccgtgtcgtggtttccgagtccgcgtccctcgaccttgataagaagggtaccgtccagacgctcgccaaggagaagtccgagaacttctttggcggcggcacccagaacggacgcttcctgcacaccaaccagaccatcgccatctccaacacgaacaactggaccgatggcggcgttgcctcgcccaacccgttttattggacgagtgacggctacggcgtactccgaaacacgtttgcagagggttcctacgacttcggttccacggactcatcgacggtcacgactttgcacagcgagaatgagtttgatgcctactacttcgtggcgaccaacgagggcgcttcgaacgtggcaaccgagatgctgcaggactactacaaggtgaccggtaacccggtactgctgcccgagtacgggttctaccttggtcatcttaatgcctataaccgtgatggctggtcaacgacctcgggtcaaaagaagtgggagaccaagggcagcaagtcctcgagcgagaagggcgacgttaagtacgagtctggcatgtcgacgggctacaagctcgacggcacacttgcggccgagacgctcaacggtgagggccctacggttgataccgagaacatgaaagcgaccgatttcgaccgccagttctctgctcgtcaggttatcgatgactacgaggacaacgacatgccgctcggctggttcctgccgaacgacggttacggcgccggctatggccagaacggttactacaagaccggcggcgtcaactccgacggagcgagctcggccgaccgtcttaacgctgtgcgtgccaatgtcgacaaccttaagaagttcaccgagtatgccaactccaagggtgtgagcacgggcttgtggacccagtccaaccttgagcccgacagcaaccctgagaccccgtggcatctgcttcgcgacttcgacgccgaggtcaagacgggaggcatcactacccttaagaccgacgttgcctgggttggatctggctactcctttggtcttaatggcatcaagacagcttatgacacggtgacgaccggcgctaacaagcgccccaacatcatcacgctcgatggttgggccggcacgcagcgctttggtggcatttggaccggcgaccagtatggcggtaactgggagtacattcgcttccatatccccacgtatatcggtcagagtctttcgggcaaccccaacatcggctccgacatggatggcatctttggcggcgaccccatcatctctgcgcgtgactaccagtggaagacgttcacgccctctatgcttgacatggacggttggggcacctaccgtaaatcgcccatgacgcacggcgatccctacacaggcatctcgcgcttctacctcaagctcaaggcgcagctcatgccctatatctacacgagcgcggcctcggcggccaacatcgacacgggtaacggcgatgccggcctgcccatgatccgcgccatgctgctttccgacaactccgagtacgccgcaagcacttcgacgcagtaccagtatatgttcggtgagaacttcctagtggcaccggtgtatcaggatacccaggcagacgagaacggcaacgacattcgcaatgggatttacctccccaactacggcaccgacgagaatcccaccatctggatcgattacttctcgggtaagcagtatcgcggcggccaggttctcaacaactacgaggctccgctttggaagctgccgctgtttgtgaaggccaacgctatcgtgccgatgtacgccgagaacaacaaccccgaggccgtgagcgacaccaacaccaagggtaccgaccgcagccagcgtatcgtcgagttcttcgccaccgagggcgacggcacctttacgcagtacgaggacgacggctcctccatcgagaacaacacgactgaggacgattcctacggcacgatcgacaatatctcctacggtgagcatgtgagcaccgtctacagctccaaggccgcaggcggcaccgcgacctttaccgccgaggcctcgcagggcggctacaacggctacgactccaaccgcaccacgaccttcgtggccaatgtgtccgccaagcccacgagcgttgtcgccaagaacggcggatccgcactcaacgtggttgaggtcgactcgcaggagacctttgacgccgcgacccccgaggccggccaggcggtctacttctacagcgagacccccaacctcaaccactacggcagcgatgcggacggcaccgaggccgagcagggcgagagcttcaacaacaccaagatcaccacgaaccccaaggtctacgtcaagttcgcgaagaccgatgttgctgcagcggcgcagacgcttgagctgggcggtttcgtgaacgccgacgccacgctcacagccgatcgcctcaacgagaacctctccgcacccacgaaccttgctgcccccgaggacgccacgaccccaacgagcatcaagctcacctggggaaaggtcgatggtgctacctcctacgaccttaaggtcgacggcactgtgtttgccgtgggtgatgcggccgagttcacgcacaccgacctcgcctacaatagcaagcacacctaccagattcgttcgcgcaacgccgaaggttactccgcctggagcgatgtgctcgaggcgaactccgcactcgatccgtggcggaacgtccccgacgccgaggaaatcacctgggagggctcactttacggcagccataaggccgagctcgccttcgaccatgagttccagtcgggcgacggcggtttccactccggtggcaacgatctgggcaaggcgcttaccgttgactatggacgcgcttacaagctcgataagctcgagtactatccgcgcgatgacgccggcaacggcaccgtgaccaagatgcgtgttgagacgagtctcgatggcgtccactggacgagccaggaggtcgattgggcacgttccgctgattgtaagacggtagcgtttgacggcaccgtggccgcccgttacgtgcgcatgacaccgctcgcctcggtcggcaatttcttctccgcgtccgagattgccatctacaagaccgacggcacggatggcttcgccgtgggctccaacctcaacaaggccacgatctccgacggagactactccaacatgaagaactatctgggcctcgagaatcgcgagcccgataccccgacgttcggttcgcagatccgcgaccacttcgccgacctcaacgataacggcgtttacgacgtctacgattactcgttcaccatggcgggtcttgacggcggcactaaacaaaagggcaaggtcgcaggttcgctcgcggtgattccgagcaagaccgaggtcgaggccggtgatgagatcaccgttgatgtctatgcggccgacgccaagaacgtcaacgccctgggcgccctcgtcaacttcaagagcgaccagttcgagtttgtgtccgagagcatcgcgcaggacggctcgactgccggcatggagaacctgtctcgcgagaaggtccagttcgtggacggaacgcagactatcaatctcgcctttgccaaccgcggcgatggcaagctctacaacggtactggcgcggtggcgagtttcaagctcaaggccaagaccgccggaaaggtcgaactgccctcgacatcttggcttatcggcccggcatgcgacgcacttgagtttgcgagcgacggcacggtgacgatgccggacgttcctcagccaacggtcgccgagtacgcccaggatgccttcaacatcacgatgaccaacgatgagctcacgaccgacgacgggaccaacgtcgagaaacttatccagcagaagagctataacgcgctgttcgataataacgagggcgacaacggctttgagttcctgtggaactggagtggcaactgggacagcgagggtaagctaccgagttacgtgaagcttcccaccacgatgacattcgcatttaagacgccgtcgaaactcgatagcgtcgaggtcgttaaccgcaacggcggcaacggaaccgtacagaagatcaaggccgtcgtgacgttcgaggatggctcgatccaagagttcgcgggcggggagtacgattccttcctggctcgctacgcctttgacctctctgccgagaacaagggcaagaaggtgactaaggtcgaggtcacgccgcttgaggcatcgggtgaccagatgctcacactgcgtgaggtcaacttcaactacacgcagggtgtcgaggccatcgagggtgtcgagctaggcaagaaccagaccgagttctttgaaggcgacattacgcccgtcgacgccaaggctacgcctgagagcgctggctacccctatgtgacggtcgagagctccgacccctctgtggtaagcgtctccgctgttcaggctggcgatagcgtgagctactacctgcgtgccaacaaggccggcaaggcaaagatcacggtggcgtcggtactcgacccctccaagaccgcatcctatgaggtcgaggtcaaggctggtgtcgatacctctgcgctcgtggcagcgctttccaaggccgcgggctacagcgagtccgtctacaccaaggattcctatgcagctctcaccactgcggtcgaggcggctcggaagctcctcgacagcggccagggcagctatagcaagaaggatgtcgcagacgccactgccaagatcgagaaggcaatcgacggcctcaagatgcgccctgtcgatgagaagatcctcatcaacacgcccgagaaccgcaagaacgtcaaggtggccgacttctcgagtgaggccgactacgagggcagcaacgccgtcaacgctctcgacggcgacgagcggacgctttggcacagcgactgggcccatgggaccggtatgccccagtatctgagtgtcgacctgggccgcgactacgatctcaccgacgttacattcctgccgcgccaggacggcggcactaacggcgatatcttcgaggccgagatactggtctccgacactgccgacggttatgagatgggcaccgccgcgtcgatgggtacgttcgccttcgacaacgacggccgcgtgctcaccgaccgtggcgactggaagcagatgagctttggcgccgcgcgcggtcgctacgtgaccgtcaaggtgattcacgccggcggtggcgacgttgatgcctactgcagcatggcggagctcaagttctacggtacggccgtccccgatccggtggcgaaggatgatctcgctaccgcgatcgaaaaggttgatgccgaggttgctgccggcgacctcaaggccggtgactacaccgaggcctcctggacggcgctcgagaacgccctggcgagcgcccgcgccatcttgagcgatgaggacgccacgcaggacgaggtcgaccaggcgctcagggcgctcgagagcgcccgcggcgcgctcgagaagaccccggtggtcccggtcgagaatccgactaagaagcagctcaaggccctggtcaagcaggcgaaggagactgacaccaggggcaagacggacgagtctgtcaaggccctgacggatgccattacctacgccgaggacgtcttgggtgatgagaatgcttccgacacccagctccaggcggcctatgaccagctcaagctggccattgagagcctcagggatgccgactccggcaaccagggcggctcgggcaaccagggttccggcaatggctcgaacggcggcaaccaggcgggcaagcccgcaggcgacaaggcccagggcagcaagaagaacggttcggcgatccccaataccggcgaccagacggcggcgaccgtcgtgaccgtcggtggtctcggcgccatcatcgccgcgatcggcgctttcttccatcgtcgcagcaaggccaagtagccccagcaacagctaagcaagcgtgcccgccgtcccacccaaggacggtgggcatgctttttgaatgtaggcggaaagctccgacccttcggccttaatctcgcaaagcattccgtctctcaccgaacacatcggcatcggtggctatacttgaattatttgcagttaagggtcgcggattcgctgcgtcaccgctctcaacaggaggtctatgtttatggcagatcagaagccggttgtcgggatcatcatgggttccaagtccgatctgggcgttatggaaggctgcaccgccgagctcgaggcactgggtgtgccctatgagctcgtcattgcgagcgcgcaccgcacgccggcgaaggtccacgagtgggcttcgactgccgccgatcgcggtatcaaagtgattatcgccgccgccggcaaggccgctcacttgggtggtgtcgtggctgcctttacgccgctgccggttatcggcgtgcctatgaagacgagtgacctgggcggtatggattcgctgctgtcgatggtgcagatgccttcgggcgtgcccgtggcctgcgttgccatcaacggtgccaagaacgccgccatctatgccacacagattctgggtgcttgcgaccccgagtaccgcaaggttatcgagaagatgaagcaggagatggctgacgcctaagcgttccgccgtttcaccgcagtataaggagagccatgtccgattatcagggaaaacgattcaaggcttctcagattcccgatccgtcgaagccgggtgctgcccgtgcggcacagcagggtcggacatcctctcctcagcagccgcgcgcgccgcgccccgtgacaccggcgacgcatcgtcgacaggacgcgccggccgcatatcgtccttcgtcttatagctccgctaagaagccgccccggtcttcatcgcatgccgcgccgtcggatcgcaccgagccgccgcgcaaaaagcgccactccattattcccattctgctcatcatcatcggtatcggtctgattgtcgccgccgccgctatttttattaatgcccagattggctataagcaggcgagcgattcgtatcagaaaatcgagaagcaatatgtaagcgataaggacgccagcggcgtgccgattatcgactttgatgcgcttgctcagacgaaccccgagattgtgggttggatttacgtgccgggaaccaacatcaactatcccgtggtgcagaccaacaacaactccaaatacctcaacacgctgttcgatggcacgtctaacgcctcgggtgccatcttcttggatagcgatgacaccgcgccgggaatggtcgaccagcagaccacgatctacggccaccatatgaacgatgggtcgatgttcaacgtgatttcggatacgactgaccaggcaacgttcgatagcattgaatatgtgtactacatcacgcgcgatgcgacgtataagttgcgtccgctggcgaccaaggtggtcgaggacacgtatgccaaggcgcgcacgaccaattttgagggcgacgacggactcaagaactacctgtccgagatgctcgacggcgcttctgccgtggcgagtgatgccaccgatcgtgccgcttcggcaactaaggttgtaacgcttgtgacctgtcgttcgctgtcgctgagcaacacacgcgccgtcatggtgctcacgccggtcgaggaataagttgttcgagagtagctaaaaaggccccgtcccaaattggctactcgacgacggtaagggagaaatgatgctcgagagtggcaaattgatgccttcgattgatgcttggctgcgcgaggccaaggccgatgcttcggcggcaggctgtgggatgtatctgacgcataacggtgtggtgcgcgcgacgcccaaggctgaggtgcgcggagtcgagaccgatggcgtggcgccaggccacagggtgggcggcatggtctttgactacgacgccgaaaaggtacggtctgctatcgagactacgcgcgcgatgccgggtatcggctatgtgcgcgtgtggctggcaagcggcgagcttaccgtaggtgacgacatcatgctcgtgcttatcggcggggacattcgcccacacgtggtcgatgcactgcaggcgctcgttggcaccatcaagaacgaatgcgtgagtgaggtcgagcgcgaggcatagaggattgcgtcgatagaaggatcgtttataaaaatgcccaccggtacgtgtgataccggcgggcattttgcgttttgggcgcggcgggcgctaaacgcgcgtggcgtccttggggctcatggtcatgctctggaagcggttctccatgtagtcgttatcgaaatacttgccgtagaactgtgcgacgggaatgtccggctccgtgccgttaacgcgctggtaccagtagtcgagcgactgcagcgtcatgacgccgtcgaccagcataatgacggtaaagatgacggtggccgagtagcggctcttccaggggatcttgttgatgagcttaagcagcctcggtagcagcagcttgatccagatgaggccacctaggccccacaggcaggcaaagcccgtgcaggtgcgtccgcccgtgaggaccacgagcggatcgggcaaaccaaacagcgttatgtgcgagtagctccacgagaccacgccaaacgcggtctgcataaaccagcccacgaacacctcaaagctcgcgccgagcacagcgctcaccaggaaaatgatgatggggttctttttgtagaagcggttaagcaccatggtcatgagcacggcgccaaatccgtagatggggctgaaagggccaaacagcatgccggcgcggtcctggtagacgcccgggtcgttgaccgtcatgtgccagatgtcctccaagataagtcccagtacgcagcagacgaagaatacccagaacaggttgaagtagttgagcttgatgtagccctcgccggtctcatcgcggccgagcatgccctcggcggcggcatcgcggtcgagcatctcctgcaggcggcgctgcagctcgcgctcctgacgcagcgtggggtcgacggtggccgaaagcgcgatgaggatgccgagctgaatagcggggcgcagcaagaagggcccgataccctggagcatcacgtcgaccaaaagctcgacgacggtgaatgcaataaggatgtaggacaggcgggcggcgttgcggcgctggtttttgataaggtccaggccaaagatgattaggatgacggcacttgccgcagagagcatgatgccggcgacgataaggccgactgcgacgagcgtgttgtcgccgagcttttcggtggcgttgccgttaacaagtgccgtgatgacctgccacataaaggcagcgaccgacgggagcgtgcccacgccggaaaggatgcacaggacggcgtacaccttaatgatgaggggaatcttcttgacctctgtggcgctggggacgctagggtcgagttcgtttcgatccatacagaacctttctcgctttgttgtaggttataaggatacgccgccgacctgccaaaagacaggacgaacgtcccaattgcaactttgtaatccccaacggcagacgcggcggccatctgggggcgcgggcacttacactggacagaccgataaaatgtttggcaacaaaactgattattagctcggtgggcttttaaaaagcgctgctcatgcgctggggagcacgtcgcgccgtgcgtataataaggcgggtaacgccaaaaatacgaggctctgaggggataccatgtctcaagaaaccatccgcgcggccgagcgtgccgcgggacaggtgaacaccatgtcgacgtatgatccggactccgaccagctgcatgaggaatgtggcattttcggcgtatgggcgcccgatcgcgacgtggctcgactgacgtactttggcctgcgtgcgctgcagcaccgtggccaggaatcggctggaatcgccgtgggtgacggcggcacggttatggtccgcaaagatctgggcctgctcgaccgcgtgttctccaacgccgacctgtcgacgctctccggccagctggccgtgggccacgtgcgctatggcaccgccggcgccaagagctgggaagcctctcagccgcacctctctaccatcaatagcgtcattatcgcgctcgcgcacaacggcaccctcgtcaacaccgacgagctgcgccgccagctgatcgagctgggcgtgccgttcctctccaattcggattccgaggtcgcgaccaagctcatcggctactttacccagcgtacgggccacctgcgcgagggcattcgcaagaccatggagctcgtgcgtggcggttatgccatgacgctcatcaacgagcaggcgctctacgccttccgcgatccgcatggcattcgcccactggtgttgggcaagctggtggacgagggcctggaccaggccgatgccgcatccgtttcgcagctgccgtcgcaggacggcgccgcgacggttgacgttgccacccatgtcacccgcgccggcggctgggtcgtcgcctccgagacttgtgcgctcgacattgtgggtgccgagtacgtccgcgacgtccgtcccggcgagattttgcgcatcagcgccgagggccttgtgtccgagcaaggcgtgcctgccgccgaggagcctgctaactgcatctttgagcaggtctacttcgctcgccccgattccatcatgaacggcaagagcgtctacgcttgccgttatgacatgggtcgtcagctggcacatgaggagcccgtcgaggccgacctggtcatcggcgtgcccgactccggcctgccgcccgcggagggctattcgcacgagagtggcattccctttggtgagggccttatcaagaaccgctacgtgggtcgtacgtttatcgagcctacgcaggagctgcgtgccatgggcgtgcgtatgaaactcaacccgctgcgcgacaacatcgagggcaagcgcctggtcgtcatcgacgactccattgtgcgcggcaccaccatggtgcagctcgtcaagatgctgcgcaacgccggcgccaaggagattcacattcgcatcaactcgcccgaggtcatctggccgtgcttctacggtatcgataccgacgtgcagtcgcagctcatcagtgccaacaagacggtcgatgagatctgcgagtacattggcgccgattcgctggccttcctttcggtcgagggcctgctgaaggtcatgcccaagggcggctactgcgacgcgtgctttaccggccgctatcccgtggcgattcccgagagctttggccgtgacaagttcatggagggctttaagccccgcaacctggacaagccgctgcactttgacgacgacgccgtggtcgagaaatatgtcgaccgcagctgggaagaggagcacggcgaggcctaaaacctgccatgtagggacaggtttattttggcaggttttatctgccgttttgttgatatgacggcgcgtgctgttatggtgcgcgccgaaatgaacgcaaatatgagcaccgtttggcgcctgcgcggcgccacggtagtgggagaggaaggctctgatgagcgacagcaagcatgtgacgtacgaggacgccggcgtcgataccgccgagggcggccgcgccgtcgacgctattaagcagatggtcaaggacaccaaccgccccgaggttatcggcggcatcggtggctttggtggcctgttctcggccgccgcgctcaaggatatggaagacccgatcctgatcagcggcaccgacggcgtgggcaccaagctcgtgctcgcccagatcatggaccgtcacgagacggtgggccaggacctggtcgctatgtgcgtcaatgacattttggcttcgggcgccgagccgctgttcttcctggattacgttgccatcggtcacattgaggccgagcacatggcaaagatcatcaagggcgtggccgacggctgcaagctcgcgggctgcgcgctcgtgggcggcgagatggccgaacacccgggcgtcatggctccggccgactacgacctcgccggctttaccgtgggtgttgtcgatcgtcccaagatgctcgaccccgcgaacgttcgccccggcgatgtaatcctgggcctgccctccaccggcgtgcattccaacggctactcgctcgtgcgcaaggtcattggcgtcgacggcatcaagccgggcacgcccgaggccgccgctaaggccgaggagctgagccgtccgctcgaggagctcggcggcgcatcgctggccgacgccctgctggcccccacgcgcatctacgtcaagccgattctggagctgctgcgcggcggcgtcaacgtgcatgctatcgcccacatcaccggcggcggtattaccgagaacctcaaccgtgcactcgccgacgacgtcgacgccgtggtcactcgcaacggcgccgagatgggttgggacgttccgcccgtcatcacctacgtgtcgcgtcaggccgagctcgcgcccaacgaggcatgcaagaccttcaacatgggcgtcggcctgtgcctgatcgtcgcccccgaggacgaggccgcggttaccgaggccctggtcgcgctgggcgagaagccgttccgcgtgggcgagtgcgtcgagggctccggtaaggtcgtgtactccgatgagcgctaacgagcagatggctgctgccgagggcctgggctttgtgccctacgcccgtccgaccggcaccgatacggccgagccgctcaagatcggtgtgctcatcagcggttcgggtaccaacctgcaggcgctgatcgatctgatcgccgccggcaagctcaacgcctcgattgagcttgtggtgtcgagccgtccttcggctaagggtttgcagcgcgctgagcgcgcgggcatccagacacttacgctgtccaaggatgtctatgccgaccccatcgcggctgacgagatcatcgcgcatgagctgctcgagcgcggctgcgaatatgtggtcatggccggctacatgcgcatggtgcacacgcctctgctggcggcgtttcccaaccgcgtggtcaacttgcatccggcgctgctgccgagctttactggtgcgcatgcgattgacgatgcctttgcgcgcggcgtcaaggtaactggcgtgactgtgcattttgccaacgaggtctacgacaacggtcccatcatcgcccagcgtgcgctggctgttgaggagggctgggatgtcgacacgctcgaggagcacatccacgcgattgagcacgtgctgtatcccgaggtcgtgcagatgctcgccgacggccgcgtccacgtgctggagagcggcaaggtcgcaattgacgcgcctcgcggctagcggtgcacagtacaatttagttgagtggtcagggtggtcattggcgccaaggcgcgcgtggccaccttttgttttgggcggtcattggggacgttcttaaacgactagccgtttaagaacgtcgcaggtgactaggtgagagaggtgagcgcatggcggataacgaggcgctgtttacgcctgagctggtgttttttgattgggagtgcgcggcgccagatgaggtgtttgcgcggctcgagggcgaacttgccccacgcggcttcattgcacccggttggctcgacgctgtccgcacgcgcgaggatgcctatcccacgggccttgccatgccggcggccaacatcgccatcccgcataccgatccggggtttgtggccaagccctatatcgcggtggtgaagcccgccgcgcccgtgacatttaacgctatggctggcatgggcgctccggtgccggcgcagatcgtcatcaatttgggtattgccgagccgggcggccaggtcgaggccctgcaggcgctcatgaacatctttatggacgccgatgccgcagccgacgtgctcggccagaccacgtcccagggcatggtcgacgccatccgtcgtcacttctaaggtggagctgagtcggcacttggggactgtccctaactgccggcagaaaaggactgtcccctttgcaccaaaatggtgcagattaacctgtctccaatgcaccaagcgtgccgcgggggctgcgttgtgacacaatggcgtttgttcgattcgttatgcgaaaggccaactatggcaaataagaaaaagaaccccgcacccgagccgacgcccgagcagcaggctcgcgctgcctccagctctcgcaagaagcagcgcaagacccgcgtgtccaagaccgccaagatcgtcctggtggttattggcgtgctggcaatgttgctttccgtctcggcgatggcgtgctccggccttatgtcgcaggccgaggacacctcgggctacaagctgaccggcggtgttgctgctactatcaacggcaccaacctcaccgaggacaccgtgaccaagcagatcatgagcacgcgcacgtcctacggctacaccaaggacaaggactgggcgcagtatctggtcgacaacgacctcacgcccaagaagtaccgcaagcagctcatcgactcctacacgcagcagattctgcttcagcaagcgcagaaggaaaacggcgtgaccgtctcggacgaggaggtcgagaaggcctggaaggacgcctgtaagagtgccggcggcgccaaagcctttaagaagaccctcaagacctacggctataccgaggatacctacaaggattcgctcaaggagagtctggcgcagcagaaactcaaggatgccgtcgcgcccacgagcaagcccaaggacagcgagatcgtcgattacatcaacgaaaacctgtccagctacaacgacgcccgccgctcgtcgaacatcctgatcaaggttgattccgacgcttccgacgaggacaaggctgccgccaaggccaaggcgcaggagtgcctggacaagatcaactccggtgagctgagctttgaggacgccgttgagcagtactccgaggacaccggttccaaggagaagaagggcgatgtgggctgggataagctcaccacctttgtcgacagctaccagacggcgctcgaggggctcaacaagggcgacgtgagcgaagtcatcgagtcgacctatggctaccacatcatcaagtgcaccgactacttccatgtcgataatcaggttgatgacatcaaccaggtgcccaaggccatcaaaaagtacgtctccaacgtggtgaagacgcaagcggctagcaccgcgtacagcgagtggctggagcagtacaagaaggatgccgacatcaccgtcaaccccatgcccaaagacgtgccatacaacgtcagtctgaagggcgttaccaagagttcgaccgacgattcgtcgacgactgagtaatcatggggcggtgctcgcgcgcgtaccgcccacgctattagagaggattagcagatgaccaacgaagagctgcagaaggaaatgatcgcggccatgaaggccaaggacaaggttcgcctgtccatcattcgccaggttaaggccgaggtgaagaatatcgaggtcaacgagcgccgcgatgtgaccgaggaagacgtcaacagcatgatcaagcgtctgatcaagcagacgagcgagacgctggagatgtccatcaaggccggcaccgaccaagagcgtaccgacaacctgaccgagcaggtcaagattctggagagccttctgcccgcgcaggtttcgggcgaggagctcgaggccctgatcgagcagctcatcgccgagctgggcgccacgtccaagaagcagatgggccaggttatgggtgcactcggcaaggccactggcggcaacttcgataagccggccgcggcaaagatcgtcggcgcaaaattggcgtaatttgttaagcggttttatcaaaccgcgtaacggctcgacgctgcaaacccgtacacacggcaatctgacgttcaatttcaagggcgcgaccataaggtctgcgccctttcatttcacgtcaccttgctcgcgtgtacgggttttcgctgacttatgctcaacaagggcggttagattatttttgggtctgatgaagggcgcctcccctggctggttattgggcgctcattggggacagacttaaatgagtgcccaatgagcagatactcatttaagtctgtccccaatgagtgggcggaaggttgcgggttctttacgggaatgtagtgtgggctgcggaaacgtggttctttccgtacaatagttcaactcgtgtaaacgcagggaagggacattcatggcagacatgatcgagatcaagcatctcaacaagtactttggcgacctgcatgtgctcaaagatatcaatctcaccgtcaagcgcggcgagaagctcgtaatgatcgggccttccggctcgggcaagtcgacgctcatccgttgcgtcgattatctggaggagcccacgtcgggcgaggtcatcatcgacggtacgccgcttaccaaaaagaatcacctggagatggctcgcaagtatagttccatggtgtttcagcagttcaacctgtatcccaacatgacggtgctgggcaacctgacgctcgcgcccatcaagctacaaaagaagagcaaggaggaggcgaccgagatcgccatcgccgcgctcaaacgcgtcggcatggcgcataaggccggcgagtatccgcagaacctctcgggcggtcagcagcagcgtatcgccatcgcccgcgccctgtgcaccaagcagcccatcatcctgtttgacgagccgacctcggcactcgaccccgagatggtccaggaagttctggacgtcatgatcgagcttgcgcaggaggacatcaccatgatctgcgtgacgcacgagatgggctttgcgcgccaggtggccgaccgcgtcatatttatggaggacggccgcatcctggaggagggcacgcccgagcacttcttcgataaccccgagaacccgcgctgccgcgagttcctgtccaagattctgcactaggcgcggtgatggacatgacggatatgacgagggcggccgtgtcgcgccgtcactttttgcagctggcgggcgccggtatgcttgcgctgacggggaccgcgcttaccggttgcggcaactccaccagcggcgagggctccgacaaggggtccaagcttgcggccattaagtcgcgtggccatctgaatgccggcgttaagaaggacgttcccggctatggctattacgacaccgccaagggccgctttgagggtatggaagtcgatttgtgctaccagatcgccgctgccgtctttggcgtgagctacaaggaggcccgtgcccaggagcttgtcgagtttaccgatgtaacgcccaagacgcgcggcccgctgatcgataacggccaacttgacgtggtcgcggcgacctataccatcaccgacgagcgcaagaagagctgggatttctcgacgccgtaccgcaccgactacgtgggactcatggtcaagaagcgttcgggctttacctcgattgaggacttggacggcaaggtcattggcgtgagccagggtgccaccacgcagggcctgatcgagcagatgatcaaggacaacggctttagctgtaagcccgagtttagggcctttagcggctatcccatcatcaagagttccctcgacgccggcaatatcgacgtctttgccatggaccgctccacgctggccggctacatgaacgagaccgttgagctgctgcagcccgaggtcaagtttggcgagcagggctacggcgtggcgaccaagaagggctgcgacctttcggccgtggtcgatcaggtgatttgcgatcgcctggccgacggctggctcgaccaagaggtcaagacctggggtcttgtataggcgcatcgtccaaggaaggaatcaaatgctcgaaggattatttgacgccgaccgttggtcgacgacatttcaaaacatggggcccttctgggagggctttggcgtgacgctacaggtggtcgttgccggtctgctgctgtcgctggtgctgggcacgctgctgggcgtgttctccaccacccgttcgcgcgtgctgcgcgccataagccgcgtgtacgtggagttttaccagaacaccccgttgcccgtacaggtgctctttatgtacatggccggtccgcagtttttgcaggccataaccggtgccgaccagccggtgcgcatcgcgccgttcgtgctgggcttcttgggtgtgggcctgtatcacgcggcctacatttcggaggtcatccgcactggtatcgaggccgttccgcgcggtcagatggaggcggcccagagccagggcttcacccgtgcgcaggcgtactggtacattgtgctgcctcagacattcaagatcattctgccgccgctgtgtaaccaggcgctcaacctggtcaagaacacgtcggtgctggcgcttgtggccggcggcgaccttatgtaccgttccgacaactttgtgagtctgtacggttacctgcagggatacatcgtctgctgccttatgtacttcatcatctgctttccgctcgccatgctggtgcagtggctcgagcgccgctccaaggagcgtccgcgcggcgtgagcctggccgagctggggctcgacaacgtagaggaggcctagcgcatggaaatcttcaacgcgaccaacctgctctacatttggggcggctttgttaagacgatcgagatctcggcgctgtcgatctttttctcgctcatctttggcacggtgctggcgctcgttaagagctatgcgccccgcccgttccgtattttggtgagtgcctatatcgagctgttccgctgcacgccgaacctgctgtggatcctttttatctactttacggtgcagggtttggatattgtgatttcgaccatcgcctttacgctctttaccagcgctgttatggccgagattgtgcgcggcggtctcaactcgattccgcgcggccagtttgaggcagcgcagagccagggcttcggcttctttgccactatgcgttacatcattctgccgcagacgtttaagacgatcattccggcgctgtttagccaatgcacgaccgtcattaaggacagctcgtatctttcgggcattaacgtggccgagctcatgtacacggcaaacgtcgtgatggcccatgcgatcgacctgtcgcaggtgcttatgctctacggcctggtgtttgcgatgtacttcgtgctcaactttggtatctcgctgctggttcgcgcatatcagaggcgaatggtggcagcgtagaatgtggcaaagggacagtccctttgtcacatagagaaaggaatcgcgatgagcgatctggagaacaagaagagtcctgtggtcattaccatcgcgcgcgactttggtgccgagggccacgagattggacgcatcctcgccaacgagttggggattcctctgtacgacaacgagctgctggtgcgcgcgtcgctgcgtgcgggcgagtcactcgataagatggccgcctatgacgagcgtctggctgtggagaacatggcgtttctgcccgaccgctacgacgcgcgctcgtactcggacaagttgttccaaaagatgagccaggtgattttggacttgggcgagaccgagagctgcattatcgaaggccgtctgtccgattacctgctgcgtaacaaccccaaccacattgccgtgctggtgaccgccccctttgaggaccgcgtcgagattgtgcgcaaaaagcgcggtctcaacaaaaagaagggcgccaagctggtcaagcagcagcagaaggcgcgcgaggcgttctacaagcgctacagcgccggcaagtggaagatgacgagcggtaaggacatcgtcgtcaaccgcgccaagctgggccgcgagggctgcaaagacgttatcgccgctgcctaccgctacaaagtagcgcagctcgaagactaaccgaccaaaaccaccacaaaggggacaggcacctttgtggtggtttttgttttaggccgaggggaaggccttggcggcagtgcctatcctcggcttttgcatagtctcgatctgtaacaccaagccagcgaaaatggctctaactgttacagatttagatgaaccgttcggccgtcagcccaacgtcttgatctgtaacaccaggcggcatatttggtctctaactgttacagattgagatgcggagtgggcggccggcacaatatctcgatctgtaacaactgcagggctcaacggactccaactgttacagattgagacaaaacgatcaggcaagtccaaaaccaccacaaaggtgcctgtcccctttgtggtggtcggtcgaccggcatagggcccgaaagaaaggtaggaggccatgacgaaaggtctgcacgtgccttccgagatcggcaagctcaggaaggtctgcctgcaccgtcccggcgacgagctcctcaacctgccgcccgacgagctcgagcgactcctgttcgacgacgtcccgttcctggaggtcgcgcagcaggagcacgacaccttcgcccagatcctgagggaccagggcgtggaggtcctctacctcgagaacctcgtcgccgaggtgttcgaccaggtccccggcgcccgcgccgagttcaccgaccagtacatcgccgaggcaggcatccgcggccagcacatgccgcagatcgtccgcgagaagctggactccatcgaggacaacctcgagttcgtcaagaagaccatggccggcatgaccaaggccgagatcgacatgcccctcacggcgtccacgaccctcgactccctggtcaactccgagtccgagtccgacctgatcatcgacccgatgcccaacctctacttcacccgcgacccgttcgcggtcgtcggcgagggcgtcaacctcaaccgcatgtactcggtcacccgcaaccgcgagaccctgtacggcaagtacgtcttcaagtaccaccccgactacaaggacgtctcgctgtacttccgccgcgactgccagttccacaccgagggcggcgacgtgctgaacatcaacgagaagaccctcgccgtcggcatctcccagcgcacccaggccgccgcgatcgacgtcatggcccagaacatcttctggaactccgactccaaggtcgagcgcatcctggccttcgacatcccggtctcgcgcgccttcatgcacctcgacacggtcttcacccagatcgacgtcgataagttcacgatccaccccgccatcatgggcaccctgcacgtctacgagctgaccgccggcaagaacccgggcgacgtgaacatccgcctgatcgaggacaccctcgagcacgtcctggaggacgccaccggcgtcgaccaggtcaagctgatcccctgcggcggcggcgacccgatcgcggcctcccgcgagcagtggaacgacggctccaacaccctgtgcgtcgagcccggcaagatctgcgtctacgcccgcaacaccgtcaccaacgacgtgctgtacaaggagggcctggaccttctcgtcgtgccctccgccgagctctcccgcggccgcggcggcccgcgctgcatgagcatgcccttctggcgcgaggacctctaagtctcggaaggcacgtgcagacctttcgtcatggcctcctacctttctttcgggccttactggccgaatttatcagcgcccctccgtttggaacgctgcttgctgacagctctagttatatccaaaacccacccgcaattccacctcgcccccgaacggtcagcaaagttcgatgaacggtatatcgcatacgattcccccatgatgcacttcggttatctaaagtaggttttctaaggtaaacgttcttttttctgaagaatcaagccagatttcataaataccttcgtgtttaggaactgcatagcgaaaacggttttctgcatatatatgacgcttgttcacgtttctgcctgtattcgatgatattcagctcgcaatcattcttattcatatattctcaccagttgagtgaggatatagattgcctgcaatacgagacgggcggttagttgaatgccttggcagcgtaagaagtaggtaaagataccgttcgcgcaatacgtccgtgccacaagtcgactaaattgagacaatagtaaatagtgttaggctaccgtcccccttggggactgaacggacagatgcatatgccgagcaaaatcgaaaagaagcaagccgccgcaaagctgcgcaagccgccgcgcgacttctcgtacacacagaaccgagagctcagctggctacgctttgacaaccgcgtgctcgacgaagccttcgatgagtccgtgccactgttcgagcgccttaagttcgtctcaatcttcgagtccaacctcgacgagtttcttatggtgcgcgtgggcggcctgtccgacctggccgagctcaaaaagcaacccgtcgacaacaagagcaatatgaccgcctcggagcaggtcgaagccgtcgtggcgaagctgcccgggctcctcgaccgctgggagtccattttcaagagcatcgagggcaagctcgacgccttgggcgtccaccgcgcacgcgtcgattcgctcacgccggaggagcgcacctttgtcacccgctacttccaggcctacgtgtcgccggtcatctcgccgctggtgatcgatccgcgccaccccttccccaacctgcgcaacggtgcactctacctggcctgtggcctggatggcgtcaccgacgaggagagcctgctgggcctgatcgagattcccgcctcgatgaaccgcgtagtcgagatcccctcgcccaccggtacctactcctacatcctgctcgaggacgtcatcctcgcctgcctggacagctgctttggctcctataagccgctcgaccgagcgctcatccgcgtcacccgcaacgccgacatcgacccggacggcgagggcgtcgaggaggaagaggactaccgccagcacatgaagcgcatcctcaagaagcgtctgcgcctgcagccggtagtgctcgccgtctcgggttcgctcgagaagcaaacgctcaagaccatccgcaaggcgcttgagctttcgcgtcgctcggtctttacctgcgatatcccgctcaacctgggctacgtctttggcattgagggcaagattcccgagcacctgcgcaacgagctgctctttacgccgtttaagccacagcccaaccccaccatcgatatgacccgctccatccgcgagcaggtgctgcagcacgacaagctgctcttttacccctacgaggccatgaatccattcctggacttggtacacgaggccgcctacgaccccgagtgcatctcgctgcgcatcacgctctaccgcgtggcaaagcagagccgcctgtgcgaatcgctgatcgacgccgccgagaacggcaaagaggtcacggtgctcatggagctccgcgcccgctttgacgagcagaacaacatcgagtgggccgagcgcctggaagaggccggctgcaccgtcatctacggctccgagggctttaagtgtcactccaagatctgccagctcacctatcgcgagggcatggcacttacgcgcctgacgcttttgggcaccggcaactttaacgagaagacggccaagctctacagcgactttatgctcatgaccgcccaccccggcatcggagaggacgctaacctgttcttccgcaacctgtcgctgggcaatctgcgcggcgattaccgtttcctgggcgtggcgcccgtaggcctcaagccgctcatcatgcgcggcctggatcgcgagattcagcgcgccctcgttggcgagcccgcccgcgtgttctttaagctcaactcgctcaccgaccgcgaggtcatcgacaagatcgccgaggcatcgtgcgctggcgtacgcgtggacatgatcatccgcggcatctcgtgcctcaagccgggagttccgggcaagaccgagaatgtgcacgtccgctccatcgtcggacgctttttggagcacgcccgcgtttatgcctttggcgtggactcggacatgatttacctgagctcggccgacatgatgacgcgcaacaccgagcaccgcgtggagatcgccttccccgtgctcgaccccacctgccgcgccctggtgcacaagtacatgggcatgcagctgcgggacaacgtgaaggcccgcagcctgacgagcgacggtacctgggttcccgtggagcgcaaggagggcgagaagcccttcaactcgcaggaagccctgctggagcgcgcctaccgcaacgccgaggctgccgcgcagcagcgtgcgcaggagaaggaacgtgtggccgagaaagctattcagagtgagcttgagcacgaagcagctgtcgagcctgttgccgagccggaggctgtcgtcgctcccccggtggcagaacccgagcctgtcgaggagccggaggccgtcgtcgaggccgtagccgagcccgtcgttgagacggagcccgtcaccgctgccgcccccgagccgcagccggcggcgcccgtggtccagcaggtccaggcgaccgtcattgagcccgagcccgcacctgagcctcagcccgagccgcaggtcgccaagcccacgtccgagacgagcgcccgtcgcgagaagcccgctggcaagaccaaggccatcgagcgccatcgccccggtcgtgtgcgcatgggtctgggcctgattggcttaggcctaaagacgctcattaccggcaagaccaaataaacgtttgtagaagcgccccgtatttgaggaaagcctcggatgcggggcgcttttccctgctaccatggtgcggacaacaacgcgaatgacaggcaggaatatgaagctcaccatagaatcgatgacgtacggcgccgacgggctggcgcacgccgacaacggcaaggccgtttttgtgcagggcgctgtggcgggcgacaccgtcgaggccgaggtcgtgcaggacggcaagtcgtttatgcgcgcccgcaccaccgagattctggagccgagccccgatcgcatccagcctccctgccccttcgtgggtgtttgtggcggctgctcgtggggcaatctctcgcgcaccgcgcagcttgccgccaaggagcaaaacctgcgctccacgctcgagcgcatcggcaagttcagccccgatcaggtcgatgagctggtgcaacctatccgtcacaccaaagacgactggggctaccgcaataaaatcgagctcgagccgaccgttgccaacggtcgcgtgcgtctcggcatgcacggcgtagatcccagcaagatcgtgaccgtcgattcgtgcccgctgttcgacaaacgcttccctaaggcactcaaatcggtcgtcggcgcactcaactatctgagcggcagccacgacttgggcctcgagcgtgtgggcattcgtgcctcgcgccgtaccaaggcgctcgaggtcgcgctctggacgcccacgggctccttcccgcgctcgcaggtctcgcgcgtgctggcagacgccgcgcaccccacgagcgttgtacgtgtgatgagcaagggcgagaagaaggcccgccgcgtctccaaggtcgagatgctcgccggcgagggctcgtggaccgagagtatcgccgagggccagatgcgcttgtctgccccgtcgttcttccaggtcaacaccaagggtgccgagattctgatcgagcttgtcatggaagcgctcgacccgcaggaagacgagctggctgtggacctgtactgcggcgccggcacctttaccctgccgctcgcccgccgctgcgattttgtcgccaccgttgaggcctatggccctgccgtgcgcgacctgcgccgtaacctggagattaacaaactcgataacgtcgacgtcattggcggtgacgccgtgcgcgagttccccgaccaggatgccgacgttttggtggtcgacccgccgcgcgcgggcttggcacccgaggccatcgacctcatcgccagcacgagcgcccgcgatgtcgcctacgtgagctgcgacccggccaccttagcgcgcgacctcaagcgctttgtcgaggagggcaccttctcccccgtcaagatcacgccagtcgacctgttcccgcaaaccttccactgcgaaaccgtcgtccacctcaagcgcaactagcgccctatcattgcccataaaaatcattcggcgattgagcgtggcaagcgggcaccttcggggtataagacggctaattgtatgccgccttacgaaaggaatcctcatgcccagcgttgccgttctcgccgccgatggctttgaaactattgaatgcttgaccatggtcgatgtcatgcgtcgcggcggcgtgcgtgccacgctcgtctctatcatgcccacgcgtgaagtcgtaagctcgctgcagatccccgtaacctgcgatgcgctcttcgacgagatcaactttgacgagtacgactgcgttgtgctgcccggcggtctgcccggcgccaccaatctgcgcgccgatcagcgcgtctgcgatgtggtctgcgagttcgccgcgaccaagcacgttgccgccatctgcgccgccccgtttatcttgggcgagctcgacctgctcgaggggcgccacgccacgtgcttccccggctttgagaagagcttccccgagggagcctataccggcgagaaggtcacgcaggacggcaacatcatcaccgccagcggcatggcccagtcgctcccctttgcgctcgagctgcttcgcacactcgccggcgacaaggctgtcgagaaggtcgcagagggcatccagctatgattttggcttcgcaatcgccgcgccgcatcgagctgatgcgcgaggcgggctatgacattcgcatcattcctgccgatatcgatgagacgccgtttgatggcgaggcgccacttacgcttgtcgagcgcctggcacgagccaaggccgctgctgtcgccgccgagcatgccgagcccaccgagctgaccgtcgcggccgacacgatcgttaccttcgatggcaagattttaggcaagccggcaaacgaggacgaggcccgcaccatgcttcgcgagctttcgggccgcacgcaccaggtcgcaaccggtgtctgcatcgttaaggccggcgacacaaccgccccgcatgccgccgagagcgtgtcgtttgtcgatgtgacggacgtgacgttctacgagcttactgatgagcagattgagcgctacgtcgcctcgggcgagcccatggataaggccggcgcctacggtattcagggcacgggcgggcgcatgctcgtgcgcggtatttcgggcgacttctacaacgtggtgggcctacccatcgcacgcgtcgcacgcgcgattcaaaaactctcgtaattgcatctggcgctgggtatcccccagcgcctacaattttgccgtaccgtacggatcccgaccgggcataaggcccggcggaaaaccgataggagtaaaacatggacacactgcttgaggccattgacgtttgcgatgtcgatggcttttgctttggcaactatacggacgaggaggccggcaccggttgcaccgtaatcgtggcagcagaaggcgccaccggcggcgttgacgttcgcggcggtgccccggcatcgcgcgagaccgacctgctgcgtcccgagaacaccgtcgataaggtccacgctgtctgcctctcgggtggatcggcctttggcctcgaggcagcaagcggcgttgcccgcgagctcgagagccgcggcatcggcctgcccgtcggccccacgcaggtgcccatcgtatgctccagttgcatcttcgatctcgcctacggcgaccccacggttcgtcccgatatcgatgccggcatcgccgccgttcgcgaggcactcgataacacccccaccaggcttgagcagggcaacgttggagccggcaccggtgccacggtaggcaagctcatgggtcctgccacctgcatgaaggcaggtcttggcgccgccgccgtggcgcttggccccattaaggtgggcgccgtggtctcagttaacgcctgcggcaacgtcgttgaccccttcaccggcgagtgggtcgccggcatgcgcgccgcagccgatagcgaccagatcgtcgacatggagctcgcagcctttgccgccgccggctccatgcaaatgccgctcgaccgcactaacaccaccatcagctgcatcgtcaccaacgtggagctcaccaaggcccaggccaccaaggtctcccaaatggccgcagacgcctacgcgcacgccatccgccccacgcacaccaccaacgacggcgacaccatctacaccctcgccagcggcaaactgggcacccaggcaagcgccgccgtacccctagacctgttgggcatgctcgctgtaagggcccttcaaaccgccatcgtaaacggagccaaaaccgccaaaacctcccacggcatccccggcgccgcgaagtaaactagctcgtccggttgcccggtggggcttggttatgtttgctgctctacagtcctggctcgcacgaagagcacattaagtgctcttcggctcgtgcggaactcgcgacaaacataaccaagccccaccgggcaacctaccaaccagcttcttttcagcccaggcccctgtgtaccgcgcgtcaaagattttcaaattctgtagcctgacattaagctggacatagcagaggacccctggtccttaacttgatacgagttccgcaatcagaaccacccttaaaaagggtggtttgctcttagggtataatctcggaaggcacgtgcagacctttcgtcatggcctcctacctttctttcgggcccctgtcagggccgattcgttagcgcccctccgtgtgaggcgttattgctgacgacatatttatatccaaaatcagctcatacttccaccttgcccccgaacggttttttatagagggtgaacggcatacacatatacttcacgcatggcacacttcatcttaataaagcgtatttacgtgcttaaacgcgttttaatcctaaaatcaaatggaactaaactttgttaaaccatcctcaaattgcatatttccaataaagctatgaatagaattagcggttcacaccgcatctcaaccattttcatttttattcagaaaaaagtttgtcctattcatttctggtaaataaattaccgtttaccagacgcttgataccgttcaccggaaactcagtataaggcccagcggataccggctcgctttacggccccatttgtaacaacttgacttctcggtatagaaaaacggacccgcttcccctatgaaacgggtccgttttcgattatcttcggctaatttggataaggcccccgaagaccatcggaatcctagcgatcgaactccgccagtgcctcgcccaaaagcctcaggccctcgcgcagaacgtcctcgctcgcgcagtagcccaggcgtgcgccgcagggaagctcaaaacggccaccggggaccagcagcactcccctctcggacagcaggcgcctgcagaactcctcgtcatcctcgggaatatccagctggataaacgaggtggacacgccctgcggggccgtccaggaaacgcgatgctgcgtatcgatccaagcctgcgcgatatcgcggttgccaaacacgatcttgcgattgcgctcgagaatcttatccttgtgctcaagcacataggtcgccagggcatcgttgaacacgccgccgcagatcatggtgtaatcgcgataggtacgcatgcgattggacacctcttcgtcggccaggacccagcccacgcgggccgcaggcgtcgaataggtcttcgacaacgagttggtgacaatggccctctcgtacacgtcggccatcgacataaaggcctcggtgttctcaagcggcaggtacacctcgtcgcacagcacataggcgctcaccgagcgggcaatctcggcaatctggccgagcatatcggcatcgagaaccgtaccgatggggttcgatgcgttgttgatgcagatgagcttggtggtggggcgcaccaagcgcttgagttcctcgatatcgggcttccagccgagttcctcgcgaagctcccaatactcgacctcggcgcccagcgtgcgcggaatctcgtagagcggcgcgtaggtgggccactcggcgataacgtggtcgccgggctcgaccacagccatgatggcgttgaggtttgcgcccgtgcagccattggtctgcagaatgtgatcgggattgacctcgcgacgatacagcttggcaacctcggccttaaattccggcgagccctcgatccagccgtagttcatcttctcgcggtccaggcgctcgtagaacgtggcgccgtcctgttcatcgagcgcgcgcagctcgcccatggtgagcgacgagatcgtcgactgggcgatgtcccacgtggcgctcttctcccaaacgttgagccattcctcaacgccaatcgtcttgatgtccatggccaagctccttacaaaagcagtcgtccaatcgtgttgacgttcctcatacaagattggggcggtgcgaaaacccgcaccgccccaatgggagacatctaatggcagctagatgtatgtattatgacctgtacgggtccttgaagaccttagaggtcctcgcgccagaagggcatgctcatgcagcgcgggccgccgcggccgagttccgcacgagccggagagcacttaatgtgctctccgtgcgagtcaggactgtccgagcaggcgaccttatatatttgccctccccggggctcctctcccgaatccctaggctagttcttcagcgagttcagcggcgccgggaatcgaccaccgcggtgggcaagcacggtgccggcgttggggttcaccggcatgatgggcgcacggccgaacaggccgccgtactcgacgcagtcgcccacgcccttgccgatggcaggaatcacgcggacagccgtggtcttgttgttgatgacgccgatagccatctcgtcggcgatgatgccggcgatggtctcgaccggggtgtcgccggggatggcgatcatgtccaggccgacggagcacacgcaggtcatggcctcgagcttctcgagcgagagcgcgccggcctcgacggcggcgatcatgccggcgtcctcggacacggggataaaggcgcccgagaggccaccgacgctggagctggccatgacgccgcccttcttgacggcatcgttgagcatggcgagcgcgcaggtcgtgcccgggccaccgcaggtgccaacaccgatgatctcgagaatgcgggcaacggagtcaccgatggcgggcgtgggggccagcgacagatcgacgatacccttctcgacacccaggcgatgggcggcctcgcggctcatgagctcgccggcacgggtgatcttaaaggcggtctgcttaatcttctcggcgacctccatcattgaggcggagtcggggagcgtctccagtgccgcggccataacgccggggcccgagacgccaacgttgatgacggcgtcggcctcgccaccgccgtggacggcgcccgccataaacggggagtcctcgaccatattggcaaagcatacaaacttagaggcgccgacggagtcctggtcggccgtgagcttggcggcgtcgatgatggtctgtgcggccatgagcacggcgtccatgttgatgccggcacgcaggctggcgacgttgacgctggagcagacgcggctcgtggtggcgagcgcctgcggaatggactggataacgcggcggtcggcgtcgccgatgcccttctggacgagcgcggagaagccgcccaggtagtcgatgccgagggtctcggccgcacggtcgagggcatgcgcgatgggggtgaggtcctcatccttgcaacaagcggcgatttgcgccaccggggtgacggaaacgcgcttattgacgatggggataccgtactcgcgctcgaggttctcggcggtctcgaccaagtgctcagctgtgtgcgtcacgtggtcgtagatcttcgtgcacatgcggtcgaggttctcgtcaccgcaacccatgagcgaaacacccatggtgatggtcctgatgtcgaggttctgctcctcaaccatgccgcgggtttccgcgatttctgcaggcgtgatcgccatccttgcgctcctatctgccaaaacgagcatagtcccctctattctaacgtgccgcacgcgccgagtggcacatgcggcacgttttggtgcggggttgtttccgttgtgttaccggccaaagacctcttcggcgatacgcgcgctctcggcggcgtccttggcatagtagtccgcgccaatctgcttggcgtattcgggggtgagcacggcgccgcccacgatgatcttgacgcccggaacctcggcatgaagcaacttgatggtctcctccatggcgacgaccgtggtggtcataagtgccgagagaccgacgagcttaatgtcgcgctcctttacggtcttgagcacctcctgcggatcgacatcgcggcccaggtcaaagacggtgtagccgtagttgtcgagcagcatcttgacgatgttcttgccaatatcgtggatgtcgcccttgacggtagccacgcagattttgcccttgtcggcaatctcgccggcgggcatcagacgcttgatggtatcgaagcccacgcgcgcggcctcggcagaggccatgagctgcggcaagaagaacttgccctggtcaaagaggacgccgacctcgtcgagggcaggaataaagtggttgttgatgaggtccatggcgtcgtggtcggccaacaggcgctcggtctcggccgcgatctcgcccttgcggcccgagacgaccatgtggcggatggggtcgtcgtcggcgctggcggcggtgcccggggcgggtgcggcatcgctcgatgctgcctgagccgctgccgggttcgcggcgattttgtacgggtcggtccaaccggcgtagcgctcgatgtatccggtcgagccctcgtcctcgacgctcaacacgcgatagctgtagacggtgtccataaagcgcttggagcccgggttcatgatgggggcgtccaggccagcgccaaaggcggcggccaaaaagaccgagccaagcagcgggcgggcgggcaagccaaagctgatgttcgacacgccgagcgcgcacttgacgcccagacgctccttgcacagcgacatggcgcgcaggatctgctcggcctgacgctggttggtcgaggcggtcatgaccaggcagtcgataaggatgcggtccgggccgatgccgtagcgggcggcctcggccacgatgcgctcggcgatggcaaagcgggcctcggcggtatcggggatgccgccctcgtcgagcgtgaggccgacgacgttggtgccgtagtgagcgaccagcgggaagatctcgtccatgatctgctgtttgccgttgaccgagttgatgatgggcttgcctgcgtagcggcgcacggcggcttcgacggcggcggggtcggtggagtcgatttgcagcggcagcagcgtggaaccttggagctgctcggtcgcttgctggatgaccttgacctcgtcgatctcgggcaggcccacgttgacgtccaagatgtcggcgccctgctcctgctggctgatgccctggctcacgacgtaatccaggtcgccgtcgcgcagggcctgctgcagacgctttttgccggtggggttgatacgctcgccgatcacggcgattttgtggccatcgcagggaaggtccacaaccgtctgggcactcgtgactgacatgctgggcttgcggtgacgcgggctgggcgtgtgggtgtcgatgagggtgcgaagtgccgccatgtgcgtgggcgtggtgccgcagcatccgccgacgacgctcacgccgtcctcgatcatgccggcgacggcctcggcgtattcgggtgcctggatgtcaaagatggtgttgccgtcgtcgtccacgcggggcagtcccgcgttggcctgcaccatgacgggcttgtcggtgacggtgagcatgcgcgcggcgagcccgcggagctcggccggaccctggctgcagttgatgcccaagacatcggcgccgatggcgtcgagggtgatggcggcgacctcggggctcgtgcccaagaaggtgcggccgtcttcttcaaaagtcatggtggcaaagacgggcaggtcggagttctcgcggcaggcgaggactgccgccttgatctcggccaggtcggtcatggtctcgataataaagaggtcgacacccgcagcgacgccggcgcgcacctcctcggcaaagaggtcgtaggcctcgtcaaagctgagggtgcctagggggcgcagcagggcgccgatgggaccgatatcgccggcgacgtagcgggcgccggcctcgcgggcgcaggtgacagccgcggcaaagacgtcggccacggtggcggcgccgtcgagcttgtgggcgttggcgccaaaagtattggcggtgatcacgtcgcagcccgcctcgacgtactgacgctggatatcggtgataacctggggctcctcaaagttgaggagctcgggcaaggcgcccgccttcatgccggcagcctgcaacatggtgcccatgccgccgtcaaacagcaggtgccccgtgccttcgatggcagcgcgcagacgatcgtccttaatgcgcaggtcttcgattgtgcgcatcttgtactcggcgccgttacgacgggcagcatcaacaggcgccgccagtgcagcgccgtcggaatcatgggtgataagcggagtaaacatcggcggctcctaatggctggaatagcaagtggtgtgggcggcgcggaagcggcagtgttcgcgcatgcggcagatattgcaggtggggcgggtctgggcgtcgtggacatcgccgtcgaacaggccaatcacggcggtcacgctcttggtgggcatgagcaggctggtgggtgtgacggtgagtccaatgagccgcgtggcgttgagcgcgtcgacgatcgagcactgagccgagagcgggcagtcgccgtagccggggctgaagcgccagttgccggcgagcccgtgcgcggcggccgcggctttgatctgctggtccatctgctcaacggcggcttccacataggccgagcatgcggcgtcgagcacggcgccctccaggggctgctgggctccggtggtccgcagacggcgctcggcgtccatcccgagggtgcaggccatgagcgctgccaggcgggcgtcctttaagtgccggtagatatcgcggccccgcagctcaacattggtaccgaccaggcggatgcaaggctcgccctgcccgtcgacacccgtggcgtcgacggcaaacacgcggcgcacgccacggggctcgatatctaactctaggcgctcgaccacaagctcaatacgttgtgacagctcgggttcgatctgctgaccgccgtagcccagatagcgaagcatctcggcgcggtcgacgcgggggtggtgggcagcatcgacacggtaaagcgccggcgacgcaaggtcggccggcacttcgacagcggttgtatcgatgtgcggtttttccattaccccaagcgctccataatggtcgcggcgattgcaggacggttcatagtgtacaggtgcagaccatcggcgccgtgctccttgaggtcgcaaagctgacgggcggcatagtccacaccggcagcctgcaggctctcggggtcgttctcgtacttggcgaggatcttgatgacgggggagggcagcgacgcgccgcacataaagaccatgcggctgatctgggacttgcccataaacggcatgatgcccgcagtgatgggcgcggtgatgcctgccttgtcggcgagctcgcggaagcggtagaagcactcgttatcaaagaagagctgcgtcacaaagaagcttgcgccggcgtcttgcttttgcttgaggtattcgactgagaggttgaggtcctcgcaagcgatgtggccctcggggtaggctgcggcgcccacgcaaaaaccggcgtcgacgagctcggggatgaggtcgcgggcgaaggcgtagtcggaggcgggcttgtcatcctcggtcgcgccggcgggaagatcgccgcgcagggcaagcacgttttccacgccggccgagcgatactcgtcgatcttggcggcgatatcggcatgcgtgcgacccacgcaggtgaggtgcgcgactgaaggcgtatcgaattcgctcgagatcatgtgcgcgatgggagcggtggtggcaccgttgcccgagccgccggccgagcaggtgaccgagacaaaactcggcgaaagcttgcacaggttgcctgccacctcgcgagccgtatcgagggtaagctcgcccttgggcgggaacatctcaaacgaaatgggcgtggtgccctgggatgctgcctgcttaaaaacctcgtcgacgcgcatatcgtgctcctttaaatatttagtgcgatgtgttgtaaggattctacagcaccactatgccacggtggagttttactcgctatttggggataccaatcaaagatgctttgctatcggcattgcctataacgggctagttaaattgggacgtgtctctataaagactggtatctgatgtgaaataccagtctttatagccccgtcccaaattgactaccctaaaatcatacgggtaggtctgcaatttatacagttcgttggctgttaagggtggtaataatcctgcgatgcggtaacctcattgattggtttcgtgacagcaacataacggtaatgttgcggaaacacggcgagtctaatctaaggctcgttcgttagtaatcaacaccgcatctcacgcggtgccgatacgaagggagttccgtatggccgatcttactgaccgcttcgggaccatggtgttctctgaggaagtcatgaaagactacctccccaaggacatttggaagcgcctcgctgcaaccctcgaggacggtgagccgctcgacctggacgtggccaacgccgtcgcccacgccatgaaggtctgggccatctccaagggcgctacgcactacgcccactggttccagccgctttcgggcatcacttccgagaagcacgacagtttcctggagcccaaccataacggcaccgccattaccaagtttacgggcaagaacctcatccagggcgagccggacgcctccagcttccccaacggcggccttcgcgccaccttcgaggcccgtggctacaccgcttgggatcccaccagccccgccttcattaaggacgaggtcctgtgcattcccaccgccttctgctcctacacgggcgaggctctggacaagaagactccgctgctgcgctccatgaccgcgctcgaccgcgaggccaagcgtgtcctggccctctttggcaagacccccaagaaggtcgtgccttccgtcggcgacgagcaggagtacttcctgatcaagaaggacgcctaccgtaagcgcaaggacctggtcatcaccggccgcaccctctttggcgccaacccctgcaagggccaggagctcgaggagcactactttggtgctatccgccccaccgtctcggcctacatgaaggacctggacgaggagctttgggcgctcggcattcccgccaagaccaagcacaacgaggtcgctccctgccagcacgaactcgcgccggtctatgaggaggtcaacgaggccatcgaccagaacctggtcatgatggagaagatgaagctcatcgcctcccgccacgacttggtctgcctgctgcacgagaagcccttcgacggcatcaacggttccggtaagcacaacaactggtctatcggcaccgagtccgagaacctgctcgatccgggcgataccccgctcgacaacctgcagttcatcgtcttcctcaccgcggtgatcgagtctgtcgataactatcaggagctcctgcgtgcttctgtcgcctcggccggcaacgaccaccgtctgggcgccaacgaggctcctccggcgatcgtctccatcttcctgggcgaccagctcaccgaggttgtcgagaagatcatcgacggcaaggcctctgtccacgccacccacggcgtgctcgacctgggcgccgatgccctgcccaagctcatgcaggacaacaccgaccgtaaccgcacctctccgtttgccttcaccggcaacaagttcgagttccgcgcctgcggctccgagcagaacgtctccgaccccaacatggtcctcgacgctgccgttgccaagtcgctcaaggctttcgccgacgcgctcgagggtacgcccgaggacaagttccaggacgccgcgctcgagtactgcaagaaggttctgaccgaccaccagcgcatcctcttctccggcgacggttactccgacgagtggcccatcgaggccgagaagcgcggccttgccaacaacaagaccaccgcggacgctctgcccgcctttgtctccgagaaggctcttgccctgttcgacgagatgggtgttctgaccaaggccgaggcccagtgccgctacgactgcaagctcgagaagtacaacaagctcatgaacatcgaggctaccacgatgattcgcgaggcacgtcgtacctatcgtccggtcatcaccgcctatgccaccaaggttgctaagggcttggaggccattcgcgccgccggtgccgaggctgccatgcagtgcgagcagaacacgctcaacaagctctgcaacggcattaccgccatcaacgactccatcaaggccctcgacgccgtgcatcagaaggccgaggccctcgatggtcaggagcaggccaacgtgtacgctcacgaggtcgctcccgctatggctacgctgcgcgccgccgtggacgccatggaggagatcgtggccgccgactactggccggtcccgacctacgacgacatcctgttctacgtgtagggcgcaactgacatatcgtcacggtattgagccggggtccgcatcgcgcgggccccggctatttgtttgcgaaggacgctttgaagcccgttttgctaccgaattggtaacgggcttctcagattctgcggtgcccccagcgggatgtccgcgtgcggctggcgccgcccgcttccgctgcgtcgcttcgctccttgcgtgctgcgctggaaaacgcttcgcgtttcctcagctccgcaccctgtcgggttcgaatcccggcatcgaggcagaaaaaagcccgttaccgcgagggtaacgagcttcagcttcagatggtgcccccagcgggattcgaacccgcgatatccaccttgaaagggtggcgtccttggccgctagacgatggggacagcgggaaagagtatagcagactttttcgccagttcgtatatcgatgacaaactggaaaaccaccacataggagcggggtatctatcccgatcatcaaacatctcaatctgtaacatctgggcacgtaaatcggctctatctgttacagattgagacaaaaagtaggcgtcgggacgaacatctcaatctgtaacaacaagacagcttttggcggtctagatgttacagatcgagacaaaccaacgggatgggtcaaaaccaccacaaaggtgcctgtcccctttgtggtggtgacttgcagcgacggacctcaggacactcttacaccacgtctgcgcgcgcgaccatttcgacttgctatctggccttattagtccaaaattgctgctaccaaatcggtagcagtactcatatttgatgttttttgaccagcaggtctccctgccttagcaaatctaaggcaaaacgggctccagaccgccgaatcgtgccgcatatggcacgtccgcagtccggaacccggtccaaattgagttattgcgccgcgttagcccaagacacccgccaggatctcgattaggctgtccacgtcggcctcttcgcacacgagcggcggcaggaaacgcagcgtatgagcacctgtagcgttaatcacggcaccggcggccagcgcgcgggcaacaatatcatgcgcgtcgcccgcggcatcatccagatcacagccgagcatcaagccgcggccacgcacctcggtcacgtgcggcagcttggcgagctttgcctccatataggcgcctaccttggcagcatggtcggcataatcgccgcgcacgagcgcggagagcgtcgcggcgcacgccgcgatggccaagcagctaccgccaaaagtcgaaccgtgatcgccgggcttaaacacgtcggcgatctctttctttgccacgacggcacccatgggcacgccatcagcaatgcccttggcaagactcatgatgtcgggctccacgccataggtctggtaagcgaacggcttgccggagcggaagatgccgcactggacctcgtcggcgataagcacggcgcccacttcgtgtgccaggtcgcgcgctgccgccataaactcctcggtcatggggtgcacaccgctctcgccctgaatcggctcgagcatcacggcacaaatttcgctccccagctgcttaaagatcgcacgcagttcatcgatatcgttgggcgtgcaggccacaaagccacccggcagcgggcggaaactatcctgcagccaatcctgcatggtggcggcaatggtctcgagcgtacggccgtggaagccgccgcgcatgcacacgatagtgttgccgccgttaccggcacgcttggagtacaggcgcgcgagcttcatcgagccctcgttggcctcggcgccggagttggcaaagaaggtctcccacacctgctcatccgcagccggggcaccaagagcagctgccgtggtctcatcgccggcggcaatggcatcggcaagcacgcgtgcaccatctacgtcgtcgttggcaagcttggacagcagcgccgcgacctgtccacgctgctcgatgtagaagtaattggagacatgcatgagctttttggtctgcgcctcgagcgccgagagcacagccgggtcgccatgacctagactgcacacgccgatgccggcaagaaagtcgaggtactcacgaccatcgtcgccggtgagcttcataccgtggccttcgacaaactcgaccggagaacgaccgaaggtgtgcataacgtagtgggattcgagcgattgttgagctacaagtgacatgggatacctttcgttaagcgccaggtagcgcggattgtcgaagtaatggcacggcgattgcgatggcctagaccgtctgaagcttctcgacctcgtcgaggttttcggtcagacgcgcagcaaacgtcgaaagcggatgcggatgcgtatcgaactcgtaagccgtctcggtggaatggatcacggtaccaacgccggcgtcggtcagcagctccagcagcagcgaatgcggcgtggtaccgttgatgatgtgagcgcgaaatacgcctccggcaagcgcatcgacggcagcacgcagcttgggaatcatgcccttgtcgacctcgccgccgtagagcatctcattgacctcatcgagcgtcagattggagataagtgaatccttgtcgctaaagtccttgtacaggccgtcgacgtcggtcaaaaagatcgccttatgcgcatgcagcgccgccgcaacggcaccggcggcggtatcggcgttgatgttgaagaaaccgccgtcctcccccgccgcgacggtagcgatgacggggatgtactcgctatcgagcaggcgctcgatatagtcggtgttgacgtgcgtgaccttgcctacgcggccgagttcggggtcgagcggctcggcgatgagcgtaccggcatcgctgcccgacacgcccacagctaggttgccgtggtggttgagcgctgcgaccagctcctggttgaccttaccgcccagcacctcgcgcacgatatccatggtcgccggcgtggtcacgcgctggccgttcttaaactcgacggggatgtcgtagtggctaagcgcctcgttgatggccttgccgccaccgtgcacgataacagggcgcatgccgatgatcttgagcagcacgatgtcgctcatcacatcgcggcgcaactgctcatcaaccatggcggctccgccatatttgataacaaccgtcttgccggtcaggttcttaatccacggcagcgcttcgaacagcagctgcgcggttgcttcgttggattcgctcgaacgacaatcgcgtgcgaatttcataatctgcctcgtctttcgtatcgttatcgcgccgtgctccgctgtccgcaatcgcggcaagatgcgcagcgtccctggaatctaggaacggtagtcgccgttgatggagatgtactcatgcgtgaggtcgcaggtccacacggtcgttgccgcgtcgcctgcgcccaggtcggccgagatcacgatctcgggcgcctcaaaacgtcgtagagcctcgtcctcgtcaaagggaacagtcagaccgttgcgacagacaggcatgcccatcatgtcgatggaaacgtcttcctgattaaactgcacgccgcacttgccgagcgccatggcaacgcgaccccagttgcagtcgtggccggcgatgcaggtcttaacgagcggcgagttggcaacggcacgggcggcgatatcggcctcctcgtcgttcacggcgccggtaacgttgaccgtaacaagcttggatgcgccctcaccatcggcggcgatattgcgcgccaggctctcgcacacctcgtgtacagcaaacgtcaactcgtcaaaggcatcggagccctcgacgataggctcggcatctgcggcagcggcgccggaggcaagcatgatgcaggtgtcgttggtcgaggtgtcggaatcgaccgttaccttgttaaaggtctgcttgacggtcgagagcagcagggcatgaagtgccgcaggctcgacgggggcatcggtggtgataactgcgatcatggtggccatgttgggcatgatcatgcccgagcccttgcacattccgcctaccgtatagacattgcccgcatgacccgcagcctcactgacgtaggatacggcgtactccttggagtgcgtgtcggtcgtcatgatggcgcgagcggcatcggcgccaccgtgggcggagagcgcctcgtaggcagcaggaatggcggtctcaaacgtgtcgatcggcagaatctggccaatcacacccgtggaggcaaccagaatctgctggggctcgcagccgatgacctgcgatgcgatgctgcacgtctcgcgcgcgcatgcaaggccggtctcacccgtggcggcgttagcattgccagagttgaccgaaacgccggcgatgataccgtagcccttgtcggtaccgcccaggttggcacggctcacctgcacgggcgccgcgcaaaagcgattggcggtaaacacgccggcaccgggacagggtttatcgggcacgacgagcgcgtaatccagacgctcggggttcttgcggaacccagcgtggatacctgcggctttaaaaccagccgcagccgtaacgccaccctcgacggcgcgaatcttgatatcaaacagctcggtattcatcgtctttatgactccttatgtcaaacaaaaaaagcggacatcggttggtgcgccatgccagtcgtgatcatgagaccagcttaagagtggcgccccactcgatgcccgactaccaaatcgttaacaatcgaatgtgctacaccgggcacgccactgtgggcaagcctcgtcgctcatcaaaaccaaagacgatgttggcgcactggaccgcttggcccgcagcgcccttgcacaaattgtcgatagcacccgtcgccaccagcacgcccgcgcgcttgttgagcgcgaggccaatctgggcagcgttggtgccgacgaccgaggccgtcttgggctgctggccggcatcgagcacgcgcacaaaggtgcgatcggcgtagaactgcttgtaatggtcgacaacgtcctcaagggtcaaggtatcgatagcctgcggcgtaagcggcagcgtcaccgtggagagcaggccgcgcttgagcggtgccaggtgcggggtaaagacgacgcgatcggtcagaccaaggatttgctcaatctcgggcgtgtggcgatgcttgcccacgccgtaggcctccaagttctcgtcggcgctgcaaaaatgggtgcgggcgttgcaggacttaccggcgcccgtcacgccgctaatggcatcgacaatcacaggaccgttctcggccacccagcccgcgcgcacggcggggccggcggcaaggctcgttgcggtgggatagcaaccggcgcaggcgaccagcacgggtttgccgtcggcatggtcggatgcggcggtctccaagtcctggcagaacagctcgggcagaccgaaggcacgggtcttgagcagctcggggctcgtgtgctcggcggcataccaagcctcaaagacagacgcgtcgttcaggcggtagtcggccgagagatcaatgcaggagacgcccgatgcaagcagcgcgggcacctgtgccatggcagccgtgtgcggcacggccaaaaagaccgcgtcgcagttcttgagctcgggggcatcatgcgtcgtgaagacaagatcgcttatgccggtgaagctcgggtacaccgcagacaacggctggccggcatcggcgttggacgtaatggcagcaagttcaaactcggggtgaccgaggacgaggcgaatgagctcggctccggcatatccagccgcgccgacgattccaaccttcaaagacatatcagactccttgtctgcgatttatgcaccgatgcgcatttcgcagcggtcgttatgaagtgggttgaaactttagcaccaaaagatgcatgaatacgtaaatggcttgcatattcatgcattgaaacattcccgacacattcgcttgaaggaattgacaaatggagcgggccccgtattgaccggcgctcctaacggcgccgggcaatacggggcccgcctatgcgaaaaccaagttgttaggatgagccagctggctagagctcgaccggcacccattcgtcgtgattgcagataaaagcctcgggatcctcgacgctaaagaagacgagcgtggggtcgttaggcccctcatagtgctcgcccaggcgctctagatgcttccacccggcttcgcgcatttcgcctaaagcccggtcatccaagccggcacgcccgcgcaagatgagccagccatggcccggccaccaactcgtggcctcaaagcgctggttttgcagcagctcttgccacacatctttggtgcgcgctgttacaaaccacagcttgccatcctggatctgcgcaaacgaaaacggacgcacatgaggctgtccgtcaacgctcgtcgccaaataccatgccggcaccgacgtcagatactccaacaccgtattcaatccgtccatgtgtcctcctggcgctagctaattcggaacgggtagtttatttgagacgcgctagagctccaggcgctcctcgctgccgtcgatatcacagaagcgcgcggcaatgttgcggaccgaaaagaaagcaaggcggccgtcgttggcactctcgtgttcctcgccaatgcccaccatgtgcttaaaacccgcttgacgcaccttgtcgctcgcaactgcgtcgtcctcaagtgcggcttcgccggtcaatacaatccaacattcccccggcttccagcccgagagctcaaacttgggattcgcactcagctccgcccacacgtccttgtcgcgcgacgtgcaaaaccacaacttaccgtcatcgaccatggcaaaagaaaacggcctcacgcgaggctgatgcccgtcggtcacatcggtcgtggccagataccacgccggaatgcgcctgagatacgaacaggcgcgctcaagctgagccgtgcggtcgttgtcggtcatagggacccctttcttgcgctcgaatcgcgcctaaacaagttgaaggttgacgacgatgacacacgcaaacagcagcatcgtcacaaccgcagccagcgcatccccgcggcgaaatgcaagtgcatgcagacgtgtgcggccctgctcgccgtgatagcagcgtgcatccatggcggcagacaacgtctcggcatgacggaacacgcccgtgaacagtggaatcgccacactgccgagcatacgcacgccgccgagcgggccacccgttacgcgtgcaccgcggcttgcctgcgcgtccgccgtctgcttcatctcggtggcaaactgcggcataaagcgcaacgcgatgcccatgatcatgccgagctcatgcgcagggagccccacgcgcgcaaacggtgcgagcagacgctcaaagcccgcggtgaggtcgagcgtaggcgtggtgagcgtaatggcgctcatgccggccatcatcagggtcaggcgacacgccataaaggcggcagaacgcagtgagccctcgcttatctgcagaaagccgagctgccacaggatgcgcccactctgatcggtaaacaagttgagcaccgcgaccacgacgacgattgccagcagcggcgccatcgacgacagaacgcgacgagccggcacccgggacacggcatagatcagcacgacgaaaattgcgacaggggccagtccgcggaagccactgaccgtgagcgtcgtgatcagaaacacaaagcccaagagcaacttggttcgcgggtccaggcggtggattgcactatcgccgggatagtagctgccaaacgaaaacgcctccattagcagccctcctctcgcgcgaccgtcttggatttagcaatgtccgcgacgttagaaggaccgtctgagcgaccgatcagcaaatctgccagctcgtcggccagcgactcaaccgtatagagcccgccgcaacgcagcggcacgcccgcctccgcgagcgccaacgccatgcgctgagcagcaggtacgcccaagccgatcgacttgagctcatcggcatgcgcaaacacctgcgcgggggttccctcgacaaacaccgcaccttcgttcatcacgacgatgcggtcgcagcaattggccaggtcatccatgctgtgtgaaaccatgacaacggtcaggccatcgcggtgaagtcgatcgataagctcaaggaaatccctgcgcgcagccggatcgagccccgccatgggttcatcgagtaccaggacctcgggctccatggcgagcacaccggcaaacgccacacgccgttgctgaccgcccgaaagctcaaagggactcttgtcgccgaccgtggaaaggtcgaggcccacgcgcgagagcgacgactcgacgcgacggtcgacttcatcttgcggcaagccaaggttgtgcgggccaaacgccacgtcctgcgtcacggtttcggcaaacagctgacgctcgggatattgaaacaccacgccgaccttggccttaaccgcggcggcgtctttcttgtttgacagatcgagccccagcgcgcgaacgaatccctcctgggggcgaatcaaaccgttgagatgctggaccagcgtcgacttacccgaaccggtatgacctgctaagcccaggaactcgccgcgacgcaccgtcagagatacatcgcgcagcgcccacgggctgctggggtcgtttccccagagagcctgtttattcgatttgcccgcagtggccgagcgcttgcgccatcgacggcgctcgcgagcactcagcgagtaactatgcgagaggtgcgaaatctcgatgacgggctccgacacggctgtcccatcggttgcagaggaggcgttgtcgagcacacgagaatcggatgcagaaggccgccctgcggtgtcttccccactccggtcggcatatacctgcgcaacctcggcgaccatatccacctcgcgcacctgcgcatgaacgggcacgcccttcgcacgaagcgccgtgcccaagcagcacgacgccggcatatccaggttgaactgcgcaagttcgtccgcccgtgtcaagatttcctcgggcgtaccgagcatggcaacgcgccccgcccgaaacaccgcgacacgatcggcctcggcggcctcttccataaagtgcgtaatcatcacgatggtcatgccacgatcatgcaacgcgcggcaagccttcatgaggcccttgcgtccacgcggatcgagcatcgaggaagcctcatccaagatgagcacgcgcggttccatggcaagcacgccagcaagcgccacgcgttgcttttggccacccgagagcgcatgggtctcgtggcgctcaaagcccaccaggcccacgcccttcagcgcctcgcgtacgcgctgcgcaatttgcgccgatggaacgccaaggttttcgggaccgaacgcaacgtcatcttcgacaagcgttgccaccagctggtcgtcgggattctggaacaccatgcctgcggtcgaacgaatgtcgtagaccagctcgggatcggacgcatccataccgttgatacgtaccgtgcccgcatcgggctgcagcagcgcattcagatgcttggcaaacgtcgacttgcccgacccattgccaccgaggatgcagaaaaactccccgtcctcgatgttcagatcgacaccgtcgagcgccgacacggcaccgtcatagctaaaggaaacgccccgacactcaatcatgcgcggcctttgacctggtcctttttaggcgtgatgaggttggagactgctttatacaccgctagcgtcaacaccgagttaagcacggtcttgataaggttgaacggcagcacggcaggaatcataagcggggcgatcacatcgaccgagccataccagaaccatacgccaatggtaaggtttgcgaccatagacaacgccgtagcggcaatgacgccgagcaccagaccaatcacggcacccttataggtatgcatcttctggtacacgatagccgcgggcagaatgtagcccagcgtagcaaccaggttcataagtgcgccgacccaatcgcccgtggtaagcgcatggataacaatcgccatagcggcaacagcagtaccggcgccaggaccatacgcaaaaccgcacaccatcgccggcaccagcgacgggtcatacgtcaaaaccggcgccgaaggaaggataggcagctgcacgtacataaacagggcgcccaaggcacacatcagcgccatggtaacgagctgtttggtgctccacctattcgtgttctcaaaatggatatgctgcgactgttcagacataagatcacctgcctctttcatccggactctaaccgttggtactgggatctcaccagttcagccggcatgcgaaccaacgcacacacgggtcgcggactcatcggctcggccgcaggcacctcgcctgcgccacggcacccctttagcaccgcccgatttaccgccagtggggaatttcaccccgccctgaaacagcaattgcaagtgtagcaccagtaggctttcgcgcaagtatgccaagggtaatttatggcgggggaaacgctctagaaatgcggccgggacagagcagcgcgacaataacgtacccgcccatcccaaagtgctgcgcttttcgcggcaaagccgcgaaacagcaaaagggaaaagccaccgcaacaaccacgttccccatccatcccaaagtagcgcgcctttcgcgcaaagcgcgaaacagcgaaggggacacgtatccctatcgaccacgtccttctccgcccgccgacctcaaggccgtaaacgcagggaatccgggggcgcttgaatcgaagaagggggaggcctcgcggcctcccccttttttgcgtttacgcgcaacattccttatgcaattaaatcaatttaatcatccaccgctgaatatagacgttcaccgttctttggtcggttctttgttctcaatggactaatatttgctttagcgtgctactgcgcttgtcctgttttacgggtcgttttattgattgtgacggaaggactcacatggcagatgttcacgagctgcttgatacttggattgccaatgtcaaggacgaggagctcctggccgagctcaacacgatgaaggagcagggtgacgaggacgccatcaccgatgctttcttccaggatcttgccttcggtaccgctggtctccgcggcacgatcggtgccggcaccaaccgtatgaatatctatacggtcggtcgtgcgacgcagggctttgccgactaccttaacgcaacgttcgagaatccgacggtcgccatcgctcgcgatagccgtaataagggcgagctgttcgttaagaccaccgctgccattctggccgccaatggtgttacggctcttgtgtatcctaagatttctccggtgacgacgctttcctgggctgttcgcgacctcgcgtgctccggtggcatctgcatgaccgctagccataacccggcgccctacaacggctataaggcctatggtcccgacggttgccagatcacgagcgaggccgcggatgctatttccaaggctatcgccgagaccgatacgtttaccggcgtgaagtccatggactttgacgaggctgttgagcagggcttggttaagtggatcgatgactcctgcctcgagcgttattacgatgcggtactcgcccgcggcgtgaccaacctttctgccgaggagattgccggcgctccgctcaagctcgtctacaccccactcaacggtaccggtctcatccccgttaccacggtgctcgagcgcgctggtatcaccgatgtcaccgtcgtccccgagcagaaggagcccaacggcgatttcccgacctgcccgtatcccaaccccgagatccgtcaggccatgcagaagggtattgatctgtgcgagcaggttcaccccgatctgttgctcgcaaccgatcccgacgccgaccgcgttggcgttgccgtcaagaacggtgatgactacctgctgctgaccggtaacgagatgggcgttctgctgctcgactatatctgcaagacgcgcgccgctcgtggcgaggacctctccaagaaggttgccgtcaccacgatcgtgtcttccgccatggttgatgccctggctgctgagtatggctttgagctccgccgctgcctgacgggcttcaagtatattggcgacatcatcacgtctctttccgatgccggcgaagtcgatcgctttatcttcggtttcgaggagagctacggttatctggctggcgatcatgtgcgcgacaaggatgccgtcagcacctcgttgcttatttgccagatggctcagtactacaaactgcagggcaagaatcttgccgacgctatgcatgagctgtacgagaagcatggctactatcacaacaagacgatttcgctgagctatccgggtgccgagggtgcagcaaagatggctggcatcatggctggtctgcgcgagaatccgcctacggagcttgccgggtccaagatcgaggccgtcgttgactacaacacctgcgtgaacggtctgccgaaggctaacgtcattgagttcgaccttgagggtggcaacaagggcattgtccgtccttccggtaccgagcctaagatcaagctctatatctttgccaagggcgtagatgccgccgaggcggatgcagcgcttgacgcaatcgaggagtccggtcgcaagctgctggcataaggcatttaagggcttattcctatagataagcgaaagaggggatctcggaaacgaggtcccctcttatatttgtctggcagccgagagatcttactatgtgtaggaaatgtgtacgcccagattcccgccccgcacgcccctccggtctggcaatatatctccttgccgcgcttgaatcgaagaagggggaggcctcgcggcctcccccttttttgcgtttacggggcgtaaatgactcaattacaccagacgatcttgttgttttcggtattgagcctttatttaaagaaaataaatcgtataacaagggcaactgctatggccgcaatggtcaaaagcagaattgtcagctgatgctgcttgcgtcgtttacttgacgaaacgaagattgactttccctgttttggcgtttcgagatagcgagccgaatgcgtcaaggtttgcttgggccgaggccctctttgttgatggacggcggatgctttcatcggctcatcactagctgcgctgtttttagataatggtgcgtctttcagatatacagggtctcccgaggcgacgcccatatgtttacgtcccgtttgggcatcctcgagcgtttgatatcggtttctcgtcacataatcgggctctgggtcattgatgggctcttgcgagatgtgggggcgatggaaccgtggcggctgcgtagaagtatcttcgccctgcgtcggcataaacatattgttctggttttggtcgtccatgatgccctttagctcgttaccaacaacgtgtacgcgctcattgtaagccccttgttatttgtagctgcgaacatacttgttatttaagctctggttcaaagaaccttaaccttactaaaacctgagtcatacacacttagatatgcttatagtactggactcaaaaaactttatagtcgatgtatatatgggcactgggtgggcatatataagagcgtcaaaagaagtcccagtcacctagaagatggctcggcagtccttaaaaggagtggtaaacatggcaagcatggttccttatcgttcggtttttggcgttcgtccttctgctagctcgctgttcgatctgtttgatgatatgaccgaccttgcaaacaactcgattgcctccaaggcgttccccgttgacgttgaggacaagggcgatggctacgaggtcaaggcgtatctgatcggtgtcgccaaggatgacatcgacgttgagctcaatgagggtcgcctgtccatcagcgtgaacgtcgaggagagcgccgaaaacgagggtaagaacttcctccagaaggagtttagctcgtacagcgcgacgcgtggcgtgtatctgaaggacgcttcgagcgagggcctctctgcaaagtatgctgacggcatcctcaccgttacggttcctaagatcgtcgagaagaagaacgtcacgaagatctccatcgactaacgatggctctgcttcaatcgagagtatgagttaagggggctgggaagtgattcccagcccccttttgttgtcttgaggggctattgaatagttgtcggttgatactgacttgcagggcgtatcgagagcttccgtggcccttgaagacgggaggcagaactgccgagttcatcatcgagacttgcatcaagcgtgttggcatagcttttgacggtaaggcttggacgattattgtcctggctgatatgcatggcgatgagctgttcggtgcgatcggtaacaagttcgcgcgcggcttcggcggcctggttgttggagaggtgcccctttgtggacaggatgcgctcctgaagaaagcgggggtacgctccttcgcgcagcatagctacatcgtggttgctttcgagcgcgagaactcgacagtctttgaggatgcctatggccttgctcgataactctccggtgtcggtggcaaacccaatggaatcatcgagagcattaaatcgatagccgacaggattgatgacatcgtgcgatgttgagtaggtttgcacgtggatgccggcaatggggagcgtgtcgccggggtcaaattcctctacgggcaggcgcgcgaggttttctttgcatgaaagggtgtccctgctggcaaagaggggaccatgccagtgcttgcaccatacatcgagccccttgatatggtcaccatgctcatgggtgattacaagagcggcgacgtcgtctgccgagaggccaagctccgccatgcgtttaagtgtctcgcggcgggacaggccgttgtcgatcatgatgagcccctgaggtccctcgacgagtgcgcagttgccttttgagccgctgccgaggatatgaaggtgcaggcgagacataagattccaaaggatacaatgagtgcggacgaatagaggaggaagcgaatgccaacggtatctcagcactatggacatcatgccgcgccgaggacggataagagcgccctggcaacgcggcaggccgctgcccccgtagtgctcatggtatcaggcggtgcggactcgacggcgctgctccttatggcttgcacatcaaagctggatattcaggacgggcgcggcgtcgctcccattgcgcgcgagcgattgcacgtgctgcatgtaaaccatcatctgcgcggggaggcatccgatggcgacgaggcctttgtacgtgacctgtgcgcgcaatacggtttgccgctgtgtgttgagcatgcctattttgatgacgaatcgggcaatatcgaggctgcggctcgcgaggtgcgctatgccgcggcacggagatacgttcgcgaactttgtgccgaatcgggcgcaccgcggacggcggctcgtatctgtaccgcgcatacttcgtcggaccgcgcggaaacatttttgatgaatgccattaaagggtcgggtcccgcgggtctatcgagcattccgcgccgtcggaacattgtggttcgccccttgctcgacctcacgcacgatgagctcgtgagctatctgcaggtgcacggtcagccatggcgggaagatgaaagcaacgaggacgtttcgtacctgcgcaactatgtacgccatcgggtgatgccggtggtggcacagcgcaacgcgagcgtctgtaagacgattggcgccgcttgcgaaattctgggcgacgaagacgcctttctttcccagctttcggcacaggcgtttcgaagctgcctgcgcaaggaagcggcgggcgcacttgtgctcgatgcgcgccgtcttgccgccgctgaggttgtgattgcacggcgtatcgtgcgattggcgattaagcgcatcgatcccgacgcgcgaccggagatgcggcacgtggagcgcgtgctcgcctgcgtcgctgcgggctcgggctcggttacgcttcctgcgggaattgatgcccgtgtggagtttggcacgctggcgttcaaggccccggcggcgcgcgagggtttagtggccgattggatctccgttcccggtcgtctgccgctgggggcggggcatatgctgacagcggagccgatggctgtggagccggggtgcgatatcgtgcaccgtgcccgcgagcttgctgctgccggaaaggttgcggccttggtggatgcggcggccctggggtttgccgacagcgatagtgagcggatcctggcgggctcgcgtggcgagatccctgccgaggcgcgattggcgcgcctgtgggtggacggtcctgtaccgggagacgtgatgtgcccgttagggatgagtggccgaagcaagaaagtatccgacttgctaggtgaggctcgcattcccgtttccgagcgcgccggcgtgcccatggtgaggacggcgccggggggcgccgtggtgtgggtcgccggagttcgcgcggacgagcgttttaagtgcacggccgcaacgcgcgtggcatatctgctccgcgtggtcgatgcggaatagcgtcccacgccagctattctgtgcgacgttgacggtattcccgcgctgatggcgtacgggctggaaaatataccccgtgcgctgctaaaatgtgaagttcgcgtccatacggcggtgtgtgggcgataagcacaagaaagggttgtcatggcttctcaacatccggatatcgagaaggttctgttcacgcaggaggatatcgacggtatcgtctctcgcctgggcgaggagattactcgcgattacgcgggtaaggatctggtgctgattgcggtcctgcgcggcgccgtggtctttatgggcgacctgatgcgtaagatcgagctgccgaccaacatcgatttcatggctgtttcgagctatggcgacggtgtgaagtcctcgggtatcgtgcgtatcattaaggacctggatatcgacatccgcggtcgcgacgtgctgatcgtcgaggacattctggactcgggcctgacgctcaagtatctgatgaagaacctcgagagccgcaagcccgcttctctggaggtcgccgccttcctgtggaaggacgttgaggaccgcgtctcggccatcacgcccaagtatgttggaacccattgccccgatgcctttgtggtgggctacggcctcgactatgccgagcgctatcgtaaccttccgtatctgggcattttgaaaccggaggtttattcgtaagatgcccgacgaccgtaacgataacaattcccagactccccgggacccaaagatcccggggatgcccggaggcaagaagcccacgcgtacgggctggctgtattttattttggcttgcgcgcttctgggctacgccttctttaacatgggctccggctttgccaattccagcaataccgttaagctcgcgacgagcgagatggtgagcgccatcaagcaggatcgcgtcgaagatctgacctatacggttcaagacggaagcgtgacgggtcattactggaagacgaagaaggacaagggcgatacgagcgagctcaagagcttctcttcgacctatgtcggctccgattcgcttgccgagctcatggcggagcaccccgataccaagtacatcgtcaacaccaacgatcccgatttttggggcgacttggcgatgagtgtgcttccgacgatcgcccttatcgccatcatgttctactttatgcgccagatgatgggcgccaacaacaggaacatgcagtttggcaagaccaacgccaagaccaacgaggccacacgccccaaggtcaagtttgaagacgttgccggcgtggacgaggcagtcgaggagctcgaggagatccgtgactttttgagcgatccggatcgctatcgcaagctgggcgccaagatcccgcgtggcgtgttgctggttggccctccgggcaccggtaaaacgctgctggccaaggccgttgccggcgaggcgggcgtgccgttctttagcatctcgggttccgactttgtcgagatgttcgtaggtgtcggcgccagccgtgtgcgtgacctctttaaggaggccaagtcccaggccccgtcaatcatcttcatcgatgagatcgatgctgtgggacgtcagcgcggagctggcttgggcggcggtcacgacgagcgcgagcagacgctcaaccagctgctggtcgagatggacggtttcgaggaaagcgagtcggtcatcctgatcgccgcgaccaatcgccccgatattctggacccggcattgctgcgccccggtcgctttgaccgccaggtcacggtcgatcgtccggacgtaaagggccgcgagcagatcttgcgcgtgcatgccgagaataagccgatggacgaggacgttaagtttgagaagctcgcccagatgaccgttggctttactggtgccgatttggcgaacctgctcaacgagtctgcgctgctggccgctcgccgtcatcgttccgtgatctcgatggacgaggtcgaggagtcgatggagcgcgtgattgccggaccgcagcgcaagggtcgcgtgatgaccgaggccgagcgcaccacgattgcctaccacgagagcggtcacgccctggtgggccacatcctggagcactccgatccgatccacaagatctcgatcgtcagccgcggtcaggctctgggctacacgctgcagcttccgcaggaggaccacttcctcaagaccaagaacgagatgctcgacgagctcgccgtgttcttgggcggtcgcgttgccgaggagctcatgtgcgatgacattacgtcgggcgcgagcaacgatctggagcgcgcaaccaagatggcgcgcgagatggtcacgcgcctgggcatgagcgaggagctgggcacgcaagtgtttggcgaggcgcaacatcaggtgttccttggtcgcgattacgccgatcaccaggattactccgaggagacggcgcgccgcatcgatatcgaggttcagcgcattatgcgtgaggcccatcgccgtgcggtcgagatcctggacgcccgtcgcgatcagctcgatttgatggcgaaggtgctgcttgagcgcgagaccgtcgaaggcgacgccgtgaacgccctgctcgacaacgagtgggatgcgtaccttgagcgcgagggcgatatcctggcggccaaggaggagcgcaatgccaaggcggccggcatgccgaccaagaagcgcgcgcctcgtatgagcgaggaggagctggcggctgatgccgcggcctttgcgcaggcggccatgcaggaggatgccgaagccgcatccgatggtgctgacgatgaccatgccgtcgtcgatgccgatgccgatgccggcaaatagtctttgtggcgaaagcctccgcggggaaacctgcggaggctttttcttttgagcgatatggggccgtctgttgattggggacagacttaaatgagcgttttcacgcatttaagtctgtccccaatcaacattgctgcggcactttgctcggctaaagcgtacaatagcgcctatgcgaaaggggaacagatgatcaacgaaacgatgtatgctcgcggtgcggaaagctccatcatccgcgagatctttagctatggtcttgagcgcaaggcacagatcggtgcggagaacgtattcgatttttcgctgggcaacccgagtgttccggcgccggctgccgtggcggagtccattaagaaggccttggggctgccgagtgaccagttgcacggctacacccccgctccgggcctgccgcaatgtcgagcagccgtcgccgaatcgctcaaccgccgctttggaacgaactatgagggtaaggacgtctttatgacggtgggtgccgcggcttcgctcacctgtacgctcaacgccgttacgaacccgggcgacgaggttattgttatcgccccgtactttccggagtatcgcgtttggattgagaaggccggctgcacgtgtgttgaggcgcctgctgatgaagacacgttccagctgagcgtggacaacgtgctcaaggcgatcaccgataagacggctgccgtcattatcgactcgcccaacaatccgaccggtgccgtatatacatgcgacacgctgacgcgactggccaatgttctgcgcgaggccaacgctcagcgcgattccgagaatccgattatgctcatctcggatgagccgtaccgcgagatcgtgtacggtgccgaggtgccttgggtgccctcgatctacgagcacaccatcgtgtgctactcgtattccaagtcgctgtcgctgcctggtgagcgcgtgggttggatcttggttcccaacaccaatccgcaggctgcccgtctgatgccggctgttgcgggtgctgcccgtacgctgggcttcgtgtgcgcgccggcgctctttcagcgcgtaattatcgactgcatcgatgagccgagtgacgttgaggcctatgcacgtaaccgcaccgcgcttaccgacgcactagcggagtatggctacacctatgttgagccggatggcgcgttctacctatgggtgaaagcgttggagtccgatgcgaatgcgttttgcgagcgcgcaaagaagtatgagttgcttgcggttccctcggacagctttggtatgccgggttggttccgcctgggctattgcgtgagctacgaaacgattgtcaattcgctacccgcttggaaacagttggcggacgagtatcgttaaaagtaaagcgctctgcctacaatgttttacgtgaaacggggtttggtgttaagccggaccccgttgccatggacgttgtgtctttgggatggagtggttttacgactatcgaaggctatgcgtacaatgaatataagcgacggccgtgccagataaggagacctgatgccctacctgctttcttgtgacattcatacccatacgatgttctctgcgcatgcatattcgaccattgaggagaatgtgtactgggcggcagagcgtggtctgcaggtgctcggatctgccgaccatttgagctctatggttacggcttgccccaatgacctgcgcagttaccagttctttatcaaccaggatatctggccgcgcatttggagcggcgtgctggtgctgcgtggtgccgaggccgatatcgtttcgctggacggaaacctgtttggcgaggacactcctgtcacgctcgatatcgccggcgattcgtacagccgtcagcattcactgttcgatttggttacgcgtaatttggattatttggttgcaagcgtgcataatccgcagattgccgagggcgctacccttgcccagacgaccgagatgtacatcaatgcgctggagcatcccaaggtatttatgctgggccacacggggcgctcgggtgtgccgtttgatatcgatgaagtgttgctggcggctaaagagaagcacaagattattgaaatcaacaaccatagccttgagcacggtgatgataccgagcattggggcgtgtgccgcaagattgccgagcgctgcgctgagctgggcgtcggtattggcgtttcgaccgatgcccacattggtatggcgataggcaagctcgaccatgcgcgtaagctgctcgacgaaattcacttcccgttggaccagatcgtgacgcgcgatcgcgagaccctgctgcgcgagatggcggcagctggcgtatgcgatctgcgcaagaggatgtagcgcgcgataaacgagtcaaagaagggacggccccagcaggccgtcccttcttgtatctcagcgggatttaaggcatgtctcaaaaatctaccgggtgggctggcggtgttcgaggaccgcgacggtctctgtgtggtcggtatgggggaacatatcgaccggcgtaatgctgagcaggcgatagccgccatcgagcagctggtgtagatcgcgctcttgcgtgacggggttgcagctgatgtaggtgatacggcgcggcttgagtgcgcaggcggcctcgagaaactcgggggtggagccggcgcgcggcggatcaatggagagcacatcgacacgctcgttgttgtcggcggcgtcgaggatatagtcggtggcgtcatctgccataaaccaagcgctgcgggtaagtccgttgagctcagcgttgcgacgcgcgtcggcgatgccggcgggattgcgttccacgccgagcagcataataccgacgcccttgtcttgcgcattcttcgccgcacacaggccgatggtgccgctgccgcagtaggcatccatgagcacgtccccctgctgcaggtccataccgtcaatcgcgagctgatagagcagctcggtctgctgcgggttggtctggtaaaacgcggtaggggagatatcgaactcgcagccgagcagctgatcgcgcatgcactcggcgccatagacaatgcgggtctcctcgcccaggatggcattgccaggacgcccgttaatgttctgggcaacggaaacgatatgcgaatcaagtgcggcgatggcatcgaagaactcccgagcatgcggcagatcgcgctgggccgtcacgacggtaaccataatctggtcggaacgccagccacagcggacaatggcatagcgaagcaagcctagatgcttgtcctcattaaaagcggggatatgcagtcgctcggcctcgcgggcaataccgttgagaatctggcgagcgcccggcgcctcgacagggcattcaggaacagcaacgattctgtgtgtcccacgttcaaaaaagccgcagcggacagcgccctctttgccgggagcaaacggagtggcagccttatgacgaaaaccacgcggcgcaggatatttacccgggtcgcccagggtgacgcccataccgcgaatggggtctacagcaatgccttcacgctcgcaaagcgaagcaaaaagctcctccatagcagcttgcttggcggcgagctgcttcttataaggacgattgagcgccgtgcacccaccacaagccttcatgatggaacaaggcgacttgggatccacggctttacgagcaggcttggtcgaatccttatacgagcgcttagggcgaacctcagaatctttggttccaccctgacgagcgccagaacacttaccctttgccttgcccttgttagatttaaccttcgcatccttagacgacttagatttcttagaagatttcgtctcccccgacccctcagccgcctggatcaaagcacgccgagccttacgctcagcacgagattctgccatgaattaactccactaattaatgtattgaaagccacaagcattgtaccgtgccaggccaacagacgatatgcaagcggtctattggtgtcagtgataagtacaacgacgattgcccgctgggctccggggcgggggttaagtttatcgcgagttccgcacgaacaggaggccacttaatgtggcctccgtcgtgggtggtttaaagctggccgctgcgcgcccagcagactaaagtcttgaacaaaaagggcatcggcgtaagccgatgccccaaacaggacgcgtagtatgtcctggcgaccatacctaaaacgaacttagtctattcgtcccaggaaaggctctttccggtcttcttggccagcagcaagaacagaccgatgatgacgttgcaagcgatgcagaagatgaagacgccctggaaagagccagcaagctcatagaccttcatcataacgggcatgccgaaggcgccgacgatatagcctacggagcaaatcagcgcgaagattcgaccgaaatcgcgggagccaaagacatccatgaccaaaacggtcagagcggtgccggcgatgacatacatgacgtcgtttacgcctgccgcgaggatgctaagcgtcgagttgtcgctgctcatcatgagcattacaaaggagagaatggagacggcaagccagcccaaaatggccttcgtgctgccgaacttatcgcaggtggtgccgacgatcgggttaaggaacatgtcgaagagcgatgcggcggaaaccatgaagccacccaccatggggttgaaaccaacctcggtagcatacgtcgggaagagctggttcatgcagcaggtgagctggacgaggcagaggaagccgatgcagaagaagaaagcaggcgacttgatggcgcgtgcatagctgacgccacgtgcgctatcctcggccgtctcctcagtctcggcgaccgtctcaccttcgacgtagccatagggcaacatgcccttgtcctggggcttgtagcggatgatcaggatagaagcgggaaggatcagcacggcagagacgccagcgagcaccagatagccagtcctccaaccggcggcctcaataacagaggtgatgacagggctcatgatgagcatgtaaatcgagtttacagcccaagcgaggccaattgccaggccaccggattttttgaaccactggtcgataacatcggacatggcaacgccggtggtgaaggcgaagcaaacgccaatcagggcgccagcagcgatgaacatccagacttcggtgtagaaagccatgcctgcgccggcggcgagcaggataagctcgacgacggggagccaaaccttgccaacgaccttggggatgagttttccgacaaacggaagcgccgccgcaagaccaatgagcgtcgcggtgaagtaatacgagaagatggagtagtcaaacccgaactcctcgcacacgggcgcgacgaaggaaccggcgattacgctataggatccggtcgtgccagcagacatgaggccgagcgcgattacgagaacccatgcgtagaccttactgctctttaactttgtattatccattgatgctgctcctagagacccagaagggcgcacataacggccttgatggtgtgctggcgattctccgcctcgcggaagatgacggaggcgtttgcctcgaagcactcgtctgcgatctcaaagccctcggtgatgatctcgcgatggaggtcgttcttgcactggtcgaggagcatcttaccgacacggtggtctgcgttgtgaacagaggggagctcatgcatgcagaagatgttggggttattggtgcgcttgcaaagctcgctggtgacgcgatagggatacagggactcggcatcgcccagccaggaatcatagtcgtcgggatccagaacctcgtcgccgcactcggggttgatgtagcgccactcctcggtaacgataacgtcaacgccatccagggcatcgaggtcagaggtgatggtaaaggtcctattgggagcgtacttggcgtagcaggcctcgacctcttcgatcatttccttgcacatctgatgacggaggtcgtcggggccgatggcgaggaagtccatgtcgagcatagcgcacaggcggccataccacaccggagcgccggcgcagttgccaacgaaagccatcttcttgccacggctcgtgcgcaggccgccccactgctcttccatcgtgagggcgtcggcgagcatctgggtcgggtgatcgccaagggtaagggcgttgatgaccgggatgtcaaccaggtcggcgacgtcatagaggaactgctcgtccttctgtgcgcggtagacgatgaggtcatacatgccgttaaagacgcgcatggcatccttgatggtctcgcagtcacccatgtgggagttggtcagataggtgaaacccatgcccaggtcgttgcaggaggtctcgaacgcgcagcgagtgcgggtcgaaccccactcaaagttggcgagaacgttcttgccggggaagtagcgctggtcgacgccggacttcttctgagccttaaggttccaggcaagatcaatgaggtagcggaaatcctcggaggagagatcatggatgttgaggtaatcgcgaccgcggaggctgttgttcatgtttatttcctttctattgatcaatagataaatgtcgaatgtgtccccgagggaaacacggatttccctcggggagcggtatatgtggcgcctaagccaaagagcgcaggctctgaggctcgctagcagctggctgccacgtccttagtccagcagtgcacgccgccgccggacaggttaagcgcaagagagtcgatcatgatgaccttgcgatcggggaagcagctctcaagaactgccttggcttgctcgtccttttctttcacgatttcgttcatgccctcgtggtagtaacgctggccaagaacgacgccgttgcagatcaagaagttgcagtagctcgctgcggcgtagaagtggacgggtccttcgggccaaggagtgccatccatgaacttgccgcccatttcatcaatgaagcccttgtacagctcgtaatcctcatcgccgggggcgatgatgacttcgatcggctcggcggtgggcatgcggacgatctcgaaaggcttaccctcccagtccgtctctttgctcaaaatctcgtaggctgcctcaatgcggcggcgagactctgcgccagccttgctcgaagcggcttcttcgtcggacacctcggcaagaagaatcttgttcggggtgataaagcggcacatctcatcgatatgggccgcaaaactcatgccaaagacgggggttccgtcttccttctcgtcgagaatgcccagtcgataatcatcgtcctcgagcataggctgcggcagccagataaccttgttgaggttgtagatgcgcttatactcggcctctacctcctctttcgtaaactcgggattgcgcttgcggcattccgtgtcctcaatggcgatcagggtgccgtgaccgtcaaactcgcggtcgccgccctcggagaccatttcggagttgacgatatcaaagcaaccgagcgcaacggccatgtgaacggctgccttgcgtgcagactgacactccggggaattcttgtcccacacgccgtagtacgtccaggcggggttgaccatataggaatggcccttgtcgtcgaccatgatgctggggccgttgtcgcggacatagaagttggagtcttcgaactgcgtgatctcgatacgatcgaggtcgaccccctcctccttcagacgcgagctggcttcctcgtaggagcccggggtgccgcagttgaggttgaccgtaacgtcgccatactcgagcagagccttgattacatcaacgcagggctggcggttatcgaagccctctgcgcgaatgtaatcgggaagccatgtcacatagacgttggagcgcttctcgaactcgcccggcatacgatagttctcgtacatggttggtccttccgtcgtgtttcccgcgatgctgcccgaccgcgacaatagcggggtttcacctgctatagtactactatacctaccgttcggtggattattttgaataaatgccgctcgcctaccaatacataccgttcgtcgtttatagtgatcatgtttgagcccgaattgatgtcccattgccatgcttaataatgttggtagtgcggaagtgatttgcaatggagaaatgctacgtgagtacaaagaaaaaaatactggatgcaatgtacgatcttgtggcggaggtcggctacgacaaggcctcgattggaaaaatctgcgatcgcgtcggcatctccaaaccgtctgtgtactactactttccctccaaggaagaaatcttcactacacttttggatagcatgttcccgtccattgattatcagcgcgactattcgctgattgtcgatcgggacggctttaaagcggcgcttattgagctcggcaatacggttataggcggctatcgaagcgatgaaaagcgacgtcgcgtgttggcagaggtcagtattcaggcaaaccgaatacctgcggtccaagagcgtcaggcaacggcaaccaatcgaactatgggggcgctaaaggacatcctgtcgcatggcgttgagattggcgcacttccggacggcaccgatgtcatgctgtacgtgcaaatcctgtataccgttcttgagggaacaagcaatacggtcgcgcaggacgaggatattgacgaaaaggcggtttgggccggggtagtcggactcatgttcaaataggctagtcaagcagaagtgcacgctgatgctcgggtagcttgctggtggtcattgaaacgaaaaagggccgattccaagctagtttggaatcggccccgttgcgtagagttctgcgaaggtgaaaatcggcccggcctatttcacggtagctttattaagaagcccggagatgatggcaaatgcagcaatcataaggttgcagacgatgcagaagataaatactccctggaaagatcccgccatgccgtagaccttcatcatgaccggcatgccaaacgcaccaacgatatatcctgcggagcagacaatcgagtaaatcctcccgaagtctttcgatccgaaaagcgaaagaaggagcattggcattgcggttccaacaatggcgaacatgacgtcgttcacgccggcggcaacgatggagacggtctcgctgtttccgccaatgatgagaagcaagaaagaggagatgctaactgccgtccacgcgaccgttgccttaatggcgccgagcttatcgcacgttttcccatcaaagggatttaagaagatatcggagagggaggctgcggagaccatcaggcttcctacgatgggattgaatccaacctcgcttgcgtaagttggaaacagctgattcatgcagcaggtgagttgcgccacgcaaagcagcaagacgcagaggataaaggacggcgtcttggcagcatcccggagcgtcatgccggtgagaacatcatcctgtttttcgaggctgctgtcctcggaggtttcgatggcggtttctccgtacggaagcatattgcgatcggaaggtttaaatcgaatgataaaggcgcttgcaggcagaatcatggctgcggaaacggctgcgagtacaatgaatcccacgcgccagccttgttgctcaatgacaagcgtgacaacgggactgagcagaagcgtgcaaagggagttgacgccccatgcaaggccgatagcaagaccggatgatttgctaaaccattggtcgatgacgtcggacatgcaaacaccggttgtaaacgaaaaacagatgccgatgactgcggcggaagcgatgaacatccagacttcggtgtagaacgccatcgcggcaccagcggcaatgaggacgagttcaatgcctatgtgcggcggtttgccaattacttttggtatgaagcggctcaggagtgggagaccgagcgcgaggccaagaagaatagcagtgaaatagaaagagaaagaggtgtagtcgaagccgaggtcttcgcataccggagcaacgaatgagccggcaacaatgctgtatgtgccggttgttccggcggacatcaagccaagcgcaataacaacaatccaagcaaatgcgccgctctcgtgggggcgatccttttcggttgatgcgatctgagccatagctactccgtttctatcggcagtgcaacctatatgcctaccgataggtatataaaccaaaggacgccccgtcaagcattaagcggggggaaggtcacttaattcgccaaacggtagcacgagcatatgattcatgttggtgggtattggttgaattgaatcatcatttccgacaacggtttctaattgccggggcaatccccagttgcggcactgtggagaaggcacccgatgccggcaggcccatccacacgctctcccccgccgttcgtattcgacgcgtttgtcctactctattccgttttttagtccacaccagtgaggaatgtaacgaaccgggcaaaaacgaacgggacggcacgccacacagcgcaccgtcccgcacacaacatcgacaatgtgacaaagggactgtccctttgtcacattacgtgtactcagcctttactgctcgctcttcgcaatcgcctggtcgataagcttgtcgagcgctgcgcgctgctcagcggagctgatggcgcccacgatgggttcccctacgatgttgccgttctggtcgataacgtaggtcgtcgggaacgagaacagatttgacgtaaacttgccggcctcgctatccgacttgaaccagatgttcttatatgtcacgcccttcttgctcagcacgtccttggcatctgcaatctcgtccttgttgccatcgagcgtaaaggaattgacgcccacgacctggccacccttctcggcaagctccttattcaggttctcaagatcgcccagctcgcccacgcacggcttgcaagtggtaaaccaaaagttcataacggtgaccttgttcttagagaacaactcgtcgctgctcacgtcgttgccgtccaggtccttgcccgtaaagctagggaacttcgtcgcctcgctcgaagcatcggcgccagccgtcatgccagcggccgaagcgtcaacgctctcgcctgcgctcggcgtgcttccacagccgggaaacttcttttccaggctctcgagcttgtcctcgatttccttgatctgctgcgcgccggccttgagcgtcttgagctcatctgccgcaaactcatccttggctccgtcgatggtcttgagcaggaagtcgccgtaattgctgccgtcctcaatcattgtcgactctttatttgctgcattgaataccttttcccacagcgcattatcgctcgaaaggatatcgttctctttttgcatgagcttcgcatacagctcggcggcctcgtcggcattggtcggcttctgcgcagtgagttctgcgatcttaggatcggagctcgcagattcgctcgcattgccaccgggcgccgaacatgccacaagacacaaggccaataccggcaccataaacagggccgcaatcttagaaagcttcatagtcattcctccgttttgtcgaagcttgttttactttttatcagcggtcagagggagcttttctgccgacacatccaggccatagcgatagctgatggcatcgacgggacaggccccaatgcactttccgcaccggatgcattcggcatgattgggcgcgcggaccacatcaacgtccatctgacaaacctttgagcacttgccgcacgaaacacatttgcatgcatcaacccgaatccccagtagggataccttattcatgagcgcatagaatgcgccgagcgggcaaatccatttgcagaaggggcgatagaacaaaacgctcagcagcaccacggcaatgagaatgaaaagcttccaggtgaagagctgccccagcgcagatcgaatgccggcgttggcgatggccagcggaatggcgccctcgagcacaccctgtggacagatgtacttgcaaaagaacggatctcccatccccagatcgttgaccaccagcacaggcagcaataccacagcaaacagcagcacgacgtacttgatgtacgtgagcggcttgagctttttcgtggagagctttttgccgggaatcttatgaagcagctcttgtagccagccaaacggacacaaaaacccacatacaaagcgtcccagcagcacgccgagcaaaatgagcgtaccggtgacgtagtaagaaaagttgaacttggatgaacctaccaccgcctggaacgacccgatggggcacgcacccgatgccgcggggcacgaatagcaattaagtccaggtacgcagactgtttttcccgcgccctgatagatgccgcctttggcaaagtttggcaggtgaatgttggtgacgagcgtcgccgccgcctgaatgaatccgcgaaatcgggccaaaacatgcgacgcagtgttttctcttttatccaattccgatacactccaagcacagcctaatcgctttggccagcacggcatccgcctcgccacgcataacgccaaagcacaccatggcaattccgacgatcaacaaagcgacctgtaccacgggttttaccgctttgaacaagctgatcactcctttcgttacgcgaccattggaccatatcgactataaaatccgtgttaagcgcgatttggaatgtgcaaggagactgttatgcgtattttgatcgtcgaagacgagcgggcactgtgcgacacaatcgcacgtagcttgcgaaacctggcatacagcgtcgactgctgccacgatggacgggaggcgctcgacctgctgggcgtcgaggtctttgacctcgtggtactcgacctcaatctcccccgtatcgacggcatgaccgtgctcagggaacttaggaaagccgactgcgagaccaaggtactgattctgtccgcgcgtggcgaagtatccgataaagtcgctggactcgatgccggcgccaacgattacctcaccaagccgtttcatctggacgagcttgcggcaagaattcgcagccttaccctcagacgctttacacaaagcgacatagttttaacctgcggaaagctccgctttgacaccaaggcgcgcatcgcttccgtggacagcgaggctctatctcttacgcgcaaggaaacgggaatcttggaatacctgatgtttaatcaggggcgtccggtaagccaagaggagcttatcgagcacgtttgggatagcagcgtgaacagctttagcaacgcaacccgcgttcatatctcgtcactccgcaaaaagctacgcagcgttttgggatacgacccgattcgcaatcggattggagagggctacgttatggaggatagcgaatgaaaaggctttcgcttcaatggcgcataacgattatgacggcactgctcacgtgcgcggcatgcgtgctgacgaactgcctggtcggctatacgggtatgcgctacatggatgccatcggcagtgacatctcggcctttaccgcaaccagcgaagattcgccccaggcgttcgacccaacgaaagcgaccctcgataacgaggttacgatcgtcgtaaacgacgcacaggagtcttttggcacgacagcctggcgcatcacggctggagtcacactccttggcggcgtgctggcatactttgtgagcggccgcgcactcaaaccgctacgggcttttgcagaccaggttgagcgtgtgcagcctgacaacctaagcgaaatcagactcagtgaagatgtgcccaccgagctacaacgatgcagcgcctctttcaacgacatgatcgcccgtcttggcgaagggttctctgcacagcgtcaatttaccggcaacgccgcgcacgagctgcgaaccccgctcgcccttatgcaggcacagatcgaactgtttgtctccgagcgctccaacttacaacccgaaacagccgagttgctcggcctgctacaagaacaaactgagcgaatgtcgcggatgaccaaggtgttgctcgagatgagtgagctccgcagcgttccttgcgaggacgatgtggaacttggtcccttgtccgaagagatcctcaccgaccttgcgccacttgccgaaaataagggcatagccctcaattgtgctgggaacgctttagtaatcgggagcgacacgctcctctatcggctggtgtttaacctggtcgaaaatgccatccgttacagccaccccggctcgactgtcaacgtctccatctgcgacaacgacagccacgtgttcctgcgagtcgaggaccagggcccgggaatacccaagcagtaccgtgagagcatcttccaaccgttctttcgcctggataaatcccgcagcagggcatacggcggcgcaggactcggactagcgcttgtttgggagattgcagcgcttcacggtggcacggtagaggtcgaaacaagttccgagaacggaaccaccatgctcgtaagccttccaaaacgatccgtagcgttaaccgaacagtaaaacgaaaggggtcccgagcaacaggagtacaattgctgctattgttgccagctgttgggagatggatgatggactgcgatggctacccacgcgttcccatgccgttgatgtgcaccgcctttgtgccggggcagattgacgctgcggttgcaggcatttccgaccccgattcacgcaccatcgccacggcagaagcgctgtactttcgcggacaggccgccctcgccgccgagacggcacgcccccatcttgacgcaactgatccgtcgctgcgctattccgcatgtttcatctgcggatatgccagtctgtcgctcaaccgtatccctgacgcccgccgttgccttgcgggcatcctcgatacgccagctgacgaggaatcgcccaccgttcacgccgtgcacgttctgttcgcctcggccgcaagcgtcctgctgcacctgccttccccgtattctgccgatgagttctatccgttcgcagcgcatctgcccgaaggcctgcgcctgttcgccagctacgtgatggcgcatgccctgtatctgcgcggcgaatacggccgcagtctgggcatggcagaaaacgccttggtcatgaagcagggaagctatcccatatcggagctgttcctgcacctgtcagcttctatggcatgtatgagcctcaagaacatcgacgccgcaaaggcgcatttcgaaaccgcgtggagcatagcgcgtcccgacggccttatcgagctcatcggcgagcaccatggccttttgcagggacttatcgaggcatgcctaaaacagcaatatcctgacgatttcgcacgcatcatcgagatcacctatcgctttagctacggatggcgacgcatccacaaccccgactcgggcgaggatgtggccgacgatctaaccaccacggaattcaccatggccatgctcgcctgtcgtggatggaccaacgccgaaatcgcacgccatatgggcgtatcgccaggcaccgttaaaaaccgcctgtccagcgtatatgcaaaacttggcatcggaactcgtgccgagttggtcgcgcatatgttgcgctagcgaccgaaccgtcaagcgcatcgaacgtgctccggcgtcccctcacattcgcatgctcaaattggacattttgcccctcgaacggcactaccgcgacaggacaccttctcgcataatttgattatttccaccgatatttgcgggatgggagcccaagatgcttgatcgccgttcgttacttgttgccggagcgtcctcgctggcgagcattatgttgccgcgcgtgccgggcacctcaaacgccttcatactgccgttcgcgcccaccgaagcctatgccgacgaagaagaccccttcaaggtcctggtgctctcgcgcaccatgttcggcgtggtcgtggtcgacatcgccaacaagatgaaccccatcgcgggtgcccaggtcacactaacgtcgcgctatgccgcgggcaaacaactcaccgccacaaccgatgacgagggcacagcgatctttgaggttgccccactttcggaaggctacgtggacgaggcgacgctccttgacgcgtatgacttcaacggcggcatctccatcagcatgccgggctaccgcgatgtcgagatccctctcgcgcgcatccagggcggcactgccattaccgcgcccacacgcccgctctccgacggtgagccgtactttcgccagcttacgttcgatgagtgggacatccaatacgccaacgccacattcatggcaatgcccaaagacgatgtagcaaacgaacagcccgacgtgcatgcctttgccgtacaggcccacctgccgcagggtgggcaggcaacgctgcgcatcaacaaagtgacgcctgccgcgggcagctcacccgaaaccgtcacgcagattggccaggtcaaggccagtgcaacgggtgcggacaatctggcgacgttcacgctcgaagacaagttcctcgatgcggcatcgggcattctggaagaaggatgcaagctgcgctttgccctcgactatcaaggcaaaacctacacgctctcctcccccatggccgttgtcaccgcgccggccgcaaaggcggaatcgggctcgaccaccatcattcccaccaccatggatcaagagatcactccgtttgatttccctgcggcgtttcccggtatcggcggcaacaagttcacctgctggatgcccacgtttccaatcctcttcgatttctcatttgccgggtatgtgctgtttggcggaggatacaaaccagccagctatatgaacgattcgggcaaccctgatccggaatactggaagaagtcgccgcgcgaatcgggtgccaagcaggcaaaccgctacctcgacgagatggagggaaagtggaatcagtacaaaagtatgagtgccggttcgggcaccgatccaagaaacaccaagctccttcgccaccattgcacgctgctgttcacgatggatatcgccacacaggtgtacggatcgcttgcctacgactgggtaggcaaaacttggggcaacaacaacgatccggcgttcggcaatattaaggccctcttccaagtaaaaaccgacctcaactggaccgaacagtttaccttgggcccggtgccgtttttcctaaacgtcaatccttgggtgttggcaaagctggcactcgcggtaggcgcccacacgcacggcagcggtgcggcgttcttcaaaaacatttcgctcgactattccaatacgtcgggatcattcaccatccagattgggcttgccgtcacctttggagccggcgttgcaggcgtcgcttcgtccgccgtgcgcggtgccgcgtccctcacgctgttcattgggtacgagaaggcggacggccaccagcttccgcggctgcgcgtgggtgcagacgtcgatgtcgacgtgatactccagttcatcatgttcaagtggaccaccaaggcctggtcggggtcgtggcccacgctcctcgattcgtggaatatgtcggtgaacaacggcgaccagtatgtactccagcgctctgagctggccttgggtggagatacgccttatacgctgggtgcctgctttggcgcagccggcaatgccgagtcgggcggtgtagcgcagtttatcgcgtcggccaccatcgtcaccaatgccgagctgctcgcatgcgccgaagttgcagccacccccgtaaacgtcgtaccgatcgtacgcgattgggaccaagcgatcacacgcattgagctcgacgcggatgcagagagcgatgacacgggacaggtcgagcatttcgtccatgccctgatggaggatgacgaaaacgccgcgccgatgtatgagtacacctacatcggtcagtcaacgaacgccgttgcggacccgaacgccaattctgccggcgtgtcggaggacgagcgtggcggcataaaaccctcgagcgacaacgtgctgttttccggcgtgctcagcgaagcccacatgaagctaacgatgattgccggcgtagaatgcctgttccgtatcgcctcggtgcgctacggcgacaatggccgctcgcgcctggtggtgcacacaaaggcaaacggcacgtggtccgctcccacgcccgtggactttccccttgggtttggcgagggcgacgtggagcgcgacggcatattcgattacgacttcgacgtggtggaatatacggacggaagaggaaaccaggacgcctacgtgctgctggtctcgggcgagcgccccgccggcgacaacacccttttcgatacggcaagcacagccggcatactgtccgttgtgcgcctgcgcataagtaatgacgagatccgcgttgtgtcgcatacgtcatggcgcagcatctcgcgcggccgcctgcaagaggatggctaccattgcctgcagtgcccgcgcatcacggtaggcaagacgctgatcgacggacgcctgtcgggtgcctacctccaccgccgcggaaccaccgcagaaaaggcgctcggcagcgaggccgaggttgcgctggaatgctttaccctgtggtcggatgatttgggcgacagcctgacgttccgccaagttcttcgctttccgcaagcaccgtcgagtatcgagctgagcgagcccgagaatatcaacggcaaaatggtggtgcccgttgcgtacgagaccgcagacggttgcggctgcgcatcgtacgccgtgatcggccagtccattgcgggctggggcgttatgccaccagacgccacggtgccccatgcggtgccgtggccacaacattcgggctttttggccaccgtcaacgagcagctgcagcatattacttggacgcgaggcgcatcggcatttgcaacgcagcccgtgggtgccgcaggctgtggcccggcatcgtttagcgtaagcaacaacggcaggtgcgcgctctatgtagaaaacaccgatggcaaggtggggcaaacctacgacgaagaaggcaacccggtagcagtaatgggcaagcacttccgcatcttcgccagcaccttggcaggcgatctgttcacggagccgttcgtgatgtgcgagctggaccatcccgtcgatcagataacgacatttttgacgtcgggaggcatgctctccgcgctcgccacgcacattgtgagcgcggagaagagcgaggcagagctgcacggcatcgaagtgcctctggtggcgtgtgccactccgacgggcgcggtcgctacctcgggcgcggtggtgcccggagcagcaggcgaatccttcatggtcacggtgcgaaacgacggcaacactttgctgactgccggcacaatcgatctgtaccgagagggctccagccagccgttctccagcgcatccatcggattcggagcgaacgcacgcatggcttcgatctacgatccagagcttgccgaagacgcttcggccaacgacatggcacacgtaaagtacgcgctcgagacgctgggcgcacgttttgcaacgcacccgctggtagccgacaacggcaacgccgtgctggcaccgggttgcacggcacagttccgcatgagcttcgccatccccgagagttggagcgacgaagtgggcaaacgcgtcacgctgtatgcgaaggcgcgtaatctggtggcgctcgatcccgtaacgctcgaggagatccgaccgggcgcaaactcggcgctgagtgccgttctgcacgagcttcatgtgcccgacgcggcatgcgaacgctcagaagttcaggtcggcgtatgcgacagcgcggatacgacaggacttcacgacgccccgatgacagcagacggcgatggtagctcgagtggcggcggtactgacgagggcggcggctccggcggaagcagctccggcagtggcaaggaccacggcaataacaagcgctccggaaaagcgggcgcgcttgcgggcacgggcgacagcaacgtccccctaaccgcagccgcagcagcgctcgccgcagttggtgccggccttgtcgcctacagcgcccgccgcacggcgctcgaaaaagacaccgccaatgaggacaattcggataggcctcgctagctcctagttacttttgtgagaggcgccgactcggctcatcgaacatcaaaatgggctggttctgaatacccagagccagcccattgcgcattaaatgtcgtctgaggagtcgagttctgcctcgagcttggcacggcgtcttttcgccgtgaaaaacgttgcgcacaggacagcaaacgtggccgcgaaaatcgtcgcaccgcagaacacgcccgtgaccaggttcgccaaccaaaagacgctttcgagcggtacgatctgcgcctcagcgatacagcgcattgcggcaataacaagcgcgaacgcggcgccgctaagaccgctgacaagcaggaaatatccaacaggaagatgctcggtttgcccaaaacgattggtatcgacatagcccttccgcgtttgcagtcctgcgcaaatcaacatcacgagaacgagccacaaatacatggctgcctcgaacggcgttgcaaagccatgcggcatttcactagcgtcgctgtgaacccacgtaacctgtcgagctataaactggtagaaaaagatcatcaacatgccaaacgaaagcagcacgaagccaatcttgtagatcttcgcgttctcagcctccaggcgttcatcctttgggccggcatattcacgccacttttgcacgattttcagatcttcatatttcatagtgaactcctaaagagcattagggtcggcgtcggtttcgtcttcccaaaacaagtcgttcaacgtaacgcgcagcgccttacagattgccacgcacaaattgagcgtggggttgtagccgcccgcctcgataaggccgatggtttggcgcgtaacgcccacggcttgggctaagtcagcttgcgaaaggccagccgccgcgcgtgccgccttcatgcgtaggttctttttgcccggcatggagttcctttcgtagtaatggacagatatccgttgcaacatgacagaaatatattgcatccttcacaagatgtcaactatatctgtcattatggaaaccatgtccgccatcgccatgtggacataacaatttcgattcgctattcaatcttactcggacaaaaccgagtcggaaggacccgagtaagtggaacttatcagcatggccaacgcgcacgccaataaccggatttgccggaaccatgcgtgccccatcgtttaatagctccgttattgttcgatgatcttcttgacgaccgcgggaacgcctgccgccaccacgttgtccggaaggtcttccgtcacgacgctgcccgcggcaattacgcaaccgctgccgatggtaaccccctgcaacacggatacgttcgcgccaaaccagcagttatcgcctacaacaataggcagagccttctcgagacccaagttgcggtcctttgcctttagggggtgcgaagcggtgtagaagccgcaaaacggcccgataaacacgttgccaccaaaggtgatagagccgccgtccataaagtagcagccatggtttacaaagcagccctcaccaaagctcgtcttgctcccgtagtcaaagtaggcaggcgaaaggaccgtcagcccttgcggaagatcggtatcgagcaaggatttcaaagcgtcaagctgcgcgtcgcttccgggttttgccatattaaagtcatagcagagcgcctccgcctttgcgcgttgcgccaggagctcctcgtcaaagttggcatcatgccactccccgcgctccatcttctctttctcagtcattgcgccccctcaaacaacatgcagtcttgatgcggcaattctaccagccgataagccacggttttaacacgagcaccacgccgcgcagggaatgaccgcagaagctaaaggtcaccgactccgaacgcgcgttcgatggaattcgtgttagttggaatcgtccgaggcctgggctatgctaccttgactatctatatgactacaacgcagcaaaggagcatcgagagagcgagcatggcaaaaaacaccgcaaactatggtaacgacagtattcgtcagctcaaggacgaggagcgcgtacgcctgcgccccgccgttatctttggctcggacggactcgacggctgcgcgcatgccgccttcgagatcctgtccaacgccgttgacgaggcgcgccagggctacggcaagctcatcacccttaccgcctttcgcgatggttccattcaggtagaggacaacggccgcggctgcccgctcgactggaacccctccgagaagcgctttaactgggagctcgtcttttgcgagctctacgcaggtggcaaatacaacaacaaccagggcggcgactacgacttctcgctcggtaccaacggcctgggctcgtgcgcgacccagtacgcatccgagtacatggacgtcacggtttggcgcgacggcaacaagtactccctgcactttaagaaaggcaaggtcgttggcgccaaaaagaaagcgcttgagatcgagcccagcgacgaggaccgcaccggcaccaccatcaagtggcgccccgatcttgaggtctttacctcgatcagcattccccacgactggtatcgcgagaccatgcgccgccaggccgtggtcaacgccaacgtgaccttccgcctgcgcattgagggcgacgatggcgagttttccgaagaggatttttgctatcccaagggcatcgaggactacgtgctcgagaaggtcggtaccgactaccttaccgagcccttctttatcgaggctgaccgtcgcggtcgcgaccgcgaggacctgcccgattacaacgtcaagatcaccgcgtgcatgtgcttctcgcgcaccttcatgatgcaggagtactaccacaactcgtcatggctcgagaacggcggttcgcccgaaaaggccgcccgtagtgctctgaccagcgccatcgatgcctacatcaagcaacagggcaagtacaacaaaaacgagagcggcattaagtggcaggacgtccaggactgtctggtgctggtgaccaactgcttctccacccagacgtcctacgaaaaccagactaagaaggccatcaataaccgctttatccagcaggcgatgacggcattctttaaggagcgcctctcgacctatctgatcgagaacaaagacgccgccaacaagatcatggagcaggtgctcatcaacaagcgctcgcgcgagaacgccgagaagacgcgccagagcatcaagaccaatctgcagcagaagaccgacatggccaaccgcgtgcagaagttcatcgactgccgctccaaggacaagagccgccgcgagatctacatcgtagagggcgactcggcagcaggcgccattcgtacctcgcgcgatgccgagttccagggcgttatgcccgtccgtggcaaaatcctcaactgcctaaaggaggactatccacgcatctttaagtccgacatcatcatggacctcatgcgcgtgctgggctgcggcgtggagatcaaggacaagcgcatcaaaaaccttggtgcctttgacctggacaacctcaactggaacaaggtcatcatctgtacggacgccgacgtcgacggttaccacatccgcacgctcgtgctcaccatgctttaccgcctggtacccacacttatcgacgagggttacgtgtatatcgccgagtcgccgctctacgagatcaactgcaaagagaagacctactttgcctacaccgagctcgagaagaacggcatcctcaaggagattggcgaccagaagtgctccatcaaccgctccaagggtcttggcgagaacgacccggacatgatgtggctcaccaccatgaaccccgagacgcgtcgcctgatcaaggtggagcccgaggacgtcaccaagatggagaccatgtttaacctgttgctgggcaacgacgaagcgggccgcaagcgccatatctccgagcacggcaaggaatatctggaccagctggacctgcagtagcagcaaatcgataacgacggcccttaagaagttcaagaggatatcgtggcaaagaagaagacgaagaaccagccgaagaaaaagcaggtcaacgccgagaacgtcatcggcctgcactccgaggtcaccgaccagccgatcacgcagacgctcgaggtcaactacatgccctacgccatgagcgtcaacgtctcgcgtgcgttccccgagatcgacggctttaagccctcgcaccgcaagctgctctacaccatgtacaagatgggtctgctcaagggcgagcgccagaagagcgccaacatcgtgggccagaccatgaagctcaacccgcacggcgatgccgcgatctacgagacgatggtgcgcctggcaaccggcaacgaggcgttgctcgcaccgttcgttgagtcgaagggcaactttggcaagtactattcgggcgacctgagctacgccgcctcgcgttataccgaagccaagctctcccccatcagcgccgagatcttcaaagacatcgacaaggacccggtcgacttcgtcgacagctacgacggtgccatgaaggagccgcgcctgctgcccaccacgttccccaacatcctcgtctcggccaacaagggcatcggcgtcgccatggcgtctgacatctgcggctttaacctcaacgaggtctgcaccgccaccatgcactacctgcaggatcccgactgcgacctgctcgagtacatgcccatgcccgatttctccaccggcggcgagatcatctaccgccgcgaggagatggaaaagattatcgagaccggccttggcagcttccaaatccgctcccgctggcgctggattcccgaagagcgcatcatcgaggtctacgagatcccctacaccaccaagaccgatgtcatcatcgaacgcatcgtcaagctctccaaggagggcaaggtcaaggagatcgccgacatccgcgacgagaccgacctttcgggtctgcgcatcgccatcgaccttaagcgcggcgtcgaccccgacaagctcatggccaagctctatcgctcgaccacgctgcaggattcgttctcgtgcaacttcaacgtgctcgtcgacggctatccccgtgttatgggcgtgcgccagattctgcacgagtgggtcaagtggcgtattgcgtccacgcgtcgccgcattaactttgacctgggcaaaaagtccgagcgcctgcacctgctgcacggccttgaggcaattctgctcgacatcgacaaggccatcgccatcatccgcggcactaagctcgaggcagaggttgtacccaaccttatgaagggtttcgacatcgacgagacccaggccgagtttgtcgccgagcttaagctccgcaacatcaacgaggagtacatcctcaaccgcaccaaggacatcgccaagctcgagggcgagattgccgagcttgaggagatcctctccagcgaggagaacatcaagaaggtcatcagcgacgagctagcagcggtcaacaagaagtacgtgatgccgcgccgcacgggcaggatcgagccccatgaggttatcgaggtaagcttggagcccgaggtcgaggagtacccggtcaccatcatgctctcgcgcgatggctacctaaagaagatgacggaccgcgtgctcaagaaggcgaccacgctcaagtacaaggacggcgacaaaccctttatcgagttcccgtcctccaacacccacgagctgctggtctttaccaacaagagccaggtgtacaagtgcaaggtcgcggcgtttgaggacaccaagtcggcccagctgggctcgtaccttccgaccgatcttgagatggaacccgacgagagcgtcatctgggtcatcgaccccgaggactacaaggccgacgtgctgttcgtctttgagaacggccgcgtggtgcgtgtcgcgctttctggatacgctaccaagaccaaccgcaagcgccttaagaacgccatctacggcggcagcaagctgctgtatgcgcaggtgctcaaggaggaccgcgacctcgcgctggtctcgagcgactaccgcctgatgaacttcaacacgtcgctgctcaagaccaagacgaccaccaacacgcagggcgtccaggcctttacggccaagaagggccgctcggtcaccaccgtcggcacgaccgaggaaatccttggcgccggcgtctcggccgagaagttcaccgcgcagagcctgccctccgccggcgccctcatgaaggaaaatgacatgccgagtttgtttgactaaaacaacggcgactaaaccgtcatggttatacaaagcagcggggcccggagcgcagtaaacgctgcgccccgggccccatgcattacaccagcatcatccctatagacaaaatgccgcataaagcggaacagacataagcccatcattcattccaaagggcttagtcgatagcctgataaggcgcacgcccggatgggtctttttaagtgaggacagacttcgagatcttgtgttctcccccgccttgacttcaatcgcagacaagcatccctgcttctctactacaaagtcgatttccgcacgattatctcgcgcccaataatgcagtggataacccatggctgaaagctgttgggcaacgtagttttcggtaagtgcacccatgaatgtgccgccgataccggcaagaatatcggcgcgttgagcaccggccttggagaccagcagccctgtatccgcctgatagattttaaaagcagaagggttaacgaaggcctctaaggggctttcgatctgcccgactaggctgcagcgcgccaccgtacccgacaatacaagccaatcgagagcatctccaaagagagacgcattgccccccgctcgcactaccttgtattgaaatttacgattctctttggcaagctgctgtggaatggaatcgaagcacgcacgcgtctttgcactcaagcgttcatcagcatatttattggtgtcggcggaatatccgtcgagaataatccgatgcttttcggccacatcaatgattgactgatcatcgatgtacgtttggaccgcctcgggcattccgccaacaacaagatactgtcgatagagcccaagcgccttttcatgaaggcttggcgcaagaggacccattatctcgaatgatgagcgtatctcgtcgaccagctgatcgtgccccatcgcccagagaaactcctcgaaatcgagtggagccatctcaatcaagtcggtctttccgacggggaacgaatacgactgatggttaatggcaaccccaagaagcgacccggcagccgcaacgtaatactcgggagcatcttcgcaaaagtatttaagggaagtgagcgcttcctcgcatgcctggatctcgtcaatgaacagtaaggttttgccaggcacgatacgctgtcccgtacgagcctcgatcgcacgtacgatcgaatgagggtcaagaccgcccgaaaaatccgctcgcgccgaccggtcgttctcaagattaacgtagacaaccgattcgaaaagatcctgggcgtacgttctgagcaaataggtcttgccacactggcgcacgcctttgaccagcaaaggttttctatcagctctgtctcgccattccctaaggagctcgtctgccttgcgacgcatacgtaaccttccctcatgaacttctatttgacaatattttaacgcggattaatttgttttcagttatttttctgcgtttaaaaattgttctatacggcacttgagggaattcgcccctatctctcggtaaggacagcaagcatttccaccaacgctgattgccatgcgttcttcttgtccttaggcaagcttgcgagcgagctctcgcacctctttcaacttgggcgaggatgccatgctgtcgcgctcggtcataccgctgatggtgacaatgccctggtcctcccacttgcagtacgcgcaggttgacttgtacatagcgatcgccgcatcatagacaccctcgctgtggctatcgagtaaaagggccgtcttggtgaacgggaatcccgtggcaccgaaggcgtacaggcggtcgatggcggtcttttcctgcgcagtgatatcaaaccagtagataggcgaagcgaagacaaccatgtcggtgtctttcagcgactcaatcacgttggccatgtcatccttctgcacgcagacgccctcatgggcgaagcagtactggcatcccaagcagccggcgatcttcttgctggcaacgcggatgacctcgaccgtatggccgccctcacgcgcggtctcggcaaacgcctcgaccatggtatcggtattagcgcccttacgcgggctgccgctcaatacaacgatattcataggattccctctccctcatgctgcaggcgcgcagcatgctttcttgtaaccaaaacgaatggtgttaatcaatcgccagcaggccatatctcttgttcaagttccctaaagaagctcaagacgattgcgattgccttatacaacgtcgaaaatcaaagagggcccatagcaacgccacctacctgaaatgacatgcggtcaagacgagctacgaggatcgtgacgagccgataccgcccgcatgcccccttcggaataggcgctgagcagctcctgagcgtgagcaaactcgggccctcgcctccaaccgagcaggcggttgaccgcgagatttccctggacgttgtggacgaagagcagataggcgtcctcgcgcgaaagcccagtctcctccatgatcgagggaaccatctgctcggcgccgcgctcgacgacgcgctgtgccacccgggcgtacgcgtcgtcatccgagtagagcagataatagtcatcgtttgccggcggacgctggcagagggcacccgcctccgttccctcgagcggcggcaccgccgccaaggcctcgtcgataagcgcgtcgagcagggcgaacttgtcctcgtagtgcagatagaacgtgccacggttgatatcggcgcggcggcaaatatccgctaccgtcatcttcgcgaagccgacctcggccagcagcgcgaagaacgcctcccgtatgaccgagagtgtatagcgtcggcgacgatcgatcttccccgcttccattacccctccaattgcaacgctcgacaatgcccggcaaacgctcgtttatcgacagcaggccgaagctgttcattgctcttaagcaaatcgacatggatactttttatagacacctgtttataatagctgaaagaaggtatccagtgaccctgtacgagcagctcgttatcgagctcaccaaccgatcgttttcccttcatgccgcctaccgcagcggcagcacgccctatgagctgagtgaccgcgagcccgagccctacgaccagcaaatcgaggacttcgcccgtatgatcgaagaagccgattgcgtgctggtgggcggggcctccgggctctccgcggcgggcggcggcgacttctactacgaggacaacgcgacctatcgcaagcatttcggcaaattcgccgagcgctacggtttcaagggcgctttcgaggggtcgttctaccgctggcccaccgccgaggcgcgctggggatacctcgccaccttcctcgacaccacgctcaacgccccgctgcgcaagccctacagggacctcgacgccattctcgccgagaaggatttcttcgtgctcaccaccaaccaggacacgcagtttgtgaagctctatccctgggagaaagtggcagagatccaaggcgaccaccgcttctttcagtgctcccgctgttgcaccgacgcggtgtgggatgcggtcgagccggtctccaacatggtagaggccatgggagacggccttgaggttccgacagagctcgtgccgcgctgcccgcactgcggggcagaggcgttcccctgggttcgcggctacggcaacttcctgcagggcgaactctacgaggagcagtaccgcaaggtgtccgaatggctcgacgcgcacgcacggcagaggatcctcttcctcgagctgggtgtgggccgcatgacgcccgcgtttatccaggagccgttctgggccctcacggcgcagttaccgcaggccagctacatcgccgtaaacaacaagacgcagtttctcccccgcgcgatcgaggatcgggggctcgccgttcgcgccgacatcgccgacgtgcttgccgacgtgcgcaagacgctggggaggtagcgcatggagacggcgaaagcagttcgcataggcagggcgctagccgaagcggatcttgtcatcatcggcgctagcaacggactcgacatggcggaggggctcaaccttttctgcgccgatgctcatttccaagaggcgtacggggacctcgcccaggcagacggcatcggctgcatactgcaggggctcgcttccccggatgccagcgtgcgacgccgatgggccgagcggttccatcaaaaggagtatctcgaatatgagcccggctcgctcatgaacgggctgcggcgtcttacggagcacgccgacaccttcgtggtcacatgcaacatcgacgggcacttcgcgcgcgccgggttcgacgagaaccgcgtgctcgagacggaggggggcatacgcacgtcgatcgacgagcggcgcctcgcccatccagacgccctcgccacggcccagctcgaggagctcgagcgccttgtgcaagcccatcgcaacggcagggtcgccatcctcgaacttggcgtgggactgcgcaacggcatcataaagcacatgctcgcccagatcgcgaacgtctgcgagcacgccacctacatcgtgttcaactacagccaggctatggcgcccgatgcatcgtgcgagacgattctcgttgacggcgatatggccccggctttcgaggagattgcccaatgccgtctctagagagggaagcgtataggcttcgaagccttatcgacgatgccgacgccatcatcgtcggcatcggctcgggcatgtcaagcgccgccgggttcaaccattacaaccgcgcaggcatggcgcgcgccggaatgacggactggcagcaagcctttggcttcaagagccttttcgacggcttctaccacctctaccccagcctcgagcagcagtgggcatactatgcgcgatacatcgacttcatgctgcgcgagccgacctcgcagctcgcacggagagcacattaagtgctctccggctcgtgcggaactcgcgatcgaccaaaccccgcgccccaccccggcgagcctctggctagcagcaacaatcaaaatgcaacaaggggctcccccgttcatcaacgggggagccccttgtcatacatggcgaatcaaggtgtctacaaatagaccctttcgagaaacgatagcgtgtcctgaaggcgtgccctttccttgcggtcggtttgccgatttacataaaaagcaaagtccgtaaagaaatcctcggcatcaaccctcatttgctccgatagcttcaaacgggctgaaggcggcaacaaaccagcaagtcgagcaacatccgaacgatgctttcgtcgatccttgtcgttgcaatgacgcccttctttataacttttgttgatatcaatgtgtgcgcgcatcttgaggggaataatatggagcgcatcgagcaacgtaataccttctagattcgttgcgttatcgcggataaattcatagtagccatcgtcgagaataatcgccgaaagacttgatacgaccccgtcaaaggagagaggcgccacctcgctcgcttcatcttcaagcgtaaaatcaggatgccgagcaaacagctcgatttgaccaggacagtccaaaacccgcttcgacccttccggcagacgaaatcgataataggtgcaccctccaccgccgcctttaccgatcttatattcagcgtctttaataaacgcccataatgccgaagcaaattcgacgctctccccatcaacgattacgacaacatccaaatcctctgtagccctaaaagaatcgccttcgatatcaaataagacgctgcaggcgcctccgccaataagaacatagccgcccttgcaatttctcatggcttcggcaaatcgctctattcctcttacttttggcatatcgtcctcctgagctgctcgatcgcatcaagcaagcgatcgtctttgtagtccgcttttgcgcaggcaacgtataaggaatatgggtcgacacattgcaaacccgttgtgtcaaaactgatatcggacggttcatccacgggatacgaccagacctcaatctcaattgccgccggttcataccactgggcctccagccattcgtcgcccaaatgttcttttaaggcatccacctgatgtttttcgagagcaatagtcggagcggagtcgtcatgagcgaggtcggacatataactaagggcagacactccggaaagcagcgcatcgacggcacgcaattctggtctgtcgattgccctcttgagccgtatgtgctcaacgacgggcgtacgaagatagtcctcaaacccatttaacagtgcctcggtcgacaaatcggcatcggacagcacacgctttttgccgtcccgtgcgattagcccaggagcaatagcggcgatttccgaaagatagccgctgacgcttgccgcgcttttgccacacagacgcgctaggtcgccggcggagcagtcaacccatcgtcccgcgatgagatttaggacgattcgttgagattggggcgaaagcggagcagcgggagaagcacccagcacctcatcggaaataacagcaccgataaacggcagaaacgcatttcgctcatctcggatatatgcgatcccctccgaagaaagcgcgcgcataaagcctaaatccatagcatcccagcaaattgccaccgggcgagcatctatcttgcgcactgcattgacgagatttcgcgccgaaatgacactgggcagttcttttggttcggcaacaataaaacggccttgctcagacatgccgagccgtgccaagcgaagcgaataccgctcaagatacatgcgaggaatctgcatctcaattggctccgggtcgatggagagctctaaagagaagagtctttttgggagacaatttagcagcatgtccaatcaccattttcattttagttacattttagtatatatctgaaattatactgaatcgtataaattgctcaatccctgaagccataagaaacaatccaaaacgcaacaagaggctcccccgtccatgtacgggagagcccctactcacatctatttatctatcagcccacccggctctccagaccaaaaagcggacgagcagagcgacgttcgcaagcaacgttgcctgaggacctgggagggcgtatggggcaacatcgatcgcgagttccgcaatcagaaccacccttaaaaagggtggtttgctcttagggtataatcgcacggagagcacattaagtgctctccggctcgtgcggaactcgcgatcgaccttatatatttgtcctccccggggctcccgcacaacgggacctcggttgggttctatcccgattgcagttgcttcgctcctgcaccacttggttggtatggcggtttggcgttggaacggttctttttctgatatatgctggttgcggttcttcttttgggaggggccgcttttttgttgtgagggggatggcccgtggctgatggggtaattcgttctgagctgctttctgtggattggaatgatgaatggatgcgtttgcaggctgctcggcatcgggctgatgactcttttgagtgggataaaagagctcggcattttcggccgctggagactgccccttatgcccgggattttatggagctgttggcgctccggcctggtgagtcggtgcttgatatggggtgtggggctggttcgattgctattccgcttgcgcaggccgggcatcctgtgattgctgccgacttttcccctgctatgttgggcacgcttgatgctggcattgaatactatgggctcgagggtcgcattgcaccgcttgagcttgcttgggatgatgactgggatttggttggaccggtcgcaaaagcggtagatgttgcctttgccagccgctcggttactacgaccaatctgaaaggtgcgcttgccaaactcgatcgtacggctcgccggcgttgtgctgtcacgatggtcgccaattccagcccgcgctacgatctgcatctgatgaatgccatcggcgcctcgtttacctgcagcaatggctttgtgtatgcctttaatatcctcattcagatgggtgccctgccgcaggtttcgtactttgaatcgcctcgtcgcgacactttcgatagcctcgaggcgggtgtggcggacttttcccgcatgctcgagcatggcaacgaggataaggtcgaccgcctgcgcgattacattgcccaacacatgattgagaacccccatgccggcgagccaggctccaagggtgcgccgcagggacgcttcatgctcgatcatatccgcaaggttcgctgggcgtttattgcctgggagccggtctccgcgagtcgtccgtagcccatctataaactgctcgcagcccgcaccggccactcacccggcatccgcattctttttgaactgggcaaacgcgctccacaccacgccgttcctgcgctatcgtgggacagctcacgtagattaaggccccatcgcggggcgcccatacatagaaagcgagaacccatggcactgacaggagcacaggtcaagcagcttcgcagcatggcccatcacctcaaccccgccatcatcatcggcaagtccgacgtcaacgagggcaccgtcgagcagacggtcgcctacctggagaagcatgagctcgttaagtgctccgtgctcgacggctccagcctttccgcccgcgaggccgccgaggagctcgccgagcgctgccacgccgaggtcgtccaggtcatcggccgcaagttctcgctgtatcgcgagtcctcgcgcaaggacatcgaaaagatcaagctcgtctaagagccaacgatccggcaagccagcatacagcaagcctgcgggcgtccgagcaattcggacgcccgttttttatcgctcgaccagcacgcggttaagcctaccctccaccaagcgctcgtacagacgccgcgtttcgggctcgggcacgccattgacctgctccctcaggtggtgcatatgcccgctgtacagctcgacaatatcgcgccgccgccccgccgcgccgtagacgcgcatagcgcaacgcaccatgtcctcgcgcgctgtctcttggcgcagccccgactccaccagccataccgccgactgcaggtcgttttcttctagggcggcattcgctccccgaatcatgcagtcgatatacttcgattccataatgcgccgcatgcgcaaaaagtaggtgggattgcagccattgggaacatacaacggaccggcgtagagctgctcgatcttgaggcacagctcgaccagatggggtccgcgcgcacccgtgcgatttcccaacacctcacgactaatctgatcgaatagcctcacatcagtcttaacatagtcaccgttaagcccaatgcactcattttggatcagcacacacgatttgccgtccggcgtcggccccaaggccgagcgcaggcgtgatatcgtcgaatacaggttgttacgggcgctattgaactctgcgtggggccatagctccatggccagcgtctcgcggtcgaccagcgcatccatgcccagcgcaagccgttcggcgagcgttgccgctttcttgcggcgccacatcttgtccgtgatgggaaacccgtcgcgctcggcgcgaaacgccccaaacatgcgaatctcgatatggtcgacagtatcgacggcttcgacctcgccagcctgaaacaggcgctcaccctccccttccagatcgtcacgcagcgaataccgcgatagttcgcgcaccgggagtttcttgcggattctggccgccggctcgcccagacaatgcatggcaaggcgcgcaaagagccgatacgatgggtccaaaatccctgcgcggttcatggacatccaagccgcaagatcgctgtctcgccctgcacaggccaagtgcagcgctaccatccaagcctccgcaccgccaacctgcgtctgacttatatcgagcagctccgcctcctcgcgcaccgaaaccatcgaggtgttacgcagatacgccgcacgctccagcagcaacgcgttgtcgcgcatgtacgcaattggctcctcagccagtttgagtacctgaaccgcgcggaacttcgcattgaccggccgtccttccgccaacgattgccagccttctagcaacaggccaaacagctgaatctggttatcgcgcatgcgcacggcaaaacgatcgagctcgttgaacgccgcatcgtcggttaccggcaagccggaaaggagccgccgtgccgccagcaccatgcgtacccagatagccggcgccttaagtccgcgcacatcgagcgcgtcccgcaccagcgccatctcgtcgtcgcgctcgtcgatccccgcaaacgacccatcgaagagctccaccagcatgctatcggcccgtataaaagtccccgcgatatcgagctcgcagtcataggccttgcgcgttttgagctgctgcagagcaccaccgccatctccccgctcggccaaccagtgcttgaccccgatatgcgcaaagagcatgtcgagcgccgtgtgttccgtctcgatttccggcacagcaaggttcatgggaagcccaagcccgttgtccccatagcaaactgccgtaagggcctgggcgaccttccacgaaacgggatctatttcacaggctgcctgatcgcccgcatgctcaatgagcgatgccatacagcgggcgagctttgtgttggacacgctgactgccgccaaatatacaccgagcgcctcggcaggcgttggctctggggcgggatcgtcggcatcgatcgtgctcaacgccgcccggcagacatcggcaccgtgccccgtcagagcaagatcgaccccatactgcccggcaagttcaaggaccacgctacggtccaaaaaggcgtcggctaggtccatcgccgcatcacatcgacctgccttgagcaaaattcgagctgcccgcggaacaagctcgggacggatctcggccaccaacttacgcagacgcagacgtccgttgtcctcggcgcccaggcacgtaaagctccggtcggcgggatctaaaccaaagatcgggtaatcgcgtacaaggtaagactggtcgatcatcgacagcctcaccccgcaagcctcgagttctgcaatattgccctcgcccatcaagatcatgaggcaggcgacgcagaacagcgcattattatcgagcgaagcaagatcgacaagtgccgcaccatacacgttgacaatctcgttttcgagcagaccggcaacatcgccctggccgtacagacccgtctgcaaagccgaaacaagctcgggcacaccctgtgtgagctggtaaaagtcaagcgatgtgctaatcgaaaacgccgatgcccacgccgaatactcataggcatgcaccttgagcatttgcgcattgatcttaaccgagtcacccagcccatgaatcagctgacgatttgaaggacggcaggagataaagacccctacccccatagcgcgcaggccgcgaatcctgtcaatgaggtcttcggtatcatgctgatcgagatttggcacattatcaatcgcgacaagggaatgcggcttgtctttgagctcttcggttaccacctcgagctgcataaacacctcgcgcccaatggctcgatccgcctcgataatccgaacggggcctcgcgtcggatcgctttttacctcttgggtgtactgcagcagcaccgaggttttcccaaagccatcaggcgcgtagagaaccacgatgccggcctttcggcccttggcgataagctcattcagcagacgctcgcgtcgcaccatatagcctccgcccagcggcatcagttcgaggtcgtctatactatccaaatcgtttaccatgcctgctcctctactcgaccgtatggacaccgtaaccgcaagaccatacaagccgcaccatgaatagggcggccttgtgttttaagttgtctatcggtacgcaagcggcaagttttagtacagcgagggccgattgttattaatcccccgactaatcggtctttgagcaggtaaatgtacttgtcggcttgtcccatcccagtggcagtgtaactcatatgagcatggttcacccatgtcattcaactcgcctagcacccgctaccgtctgcgaccttttagtggcatttttgcatagaatctggtatggaatgaatcaagctgttgggtatccgtcatccgtcaaggcttgcggcaagattttggtcaagcatacgacaaggacagcaaaaggcccccgcaaagcggaggccttcggcaaagctatgtcgagatgacgggcgcgcgctactcgcagagcgaaagggctgcctcgtcggcgaccacgacgcagttggtgtgcagctgcaggatcgaggccgggcactcgggcgtaaccggaccatagcacatgtcatgcacggcctgggccttggcctcgccgttggcgacgaccaggatcatgcgggcatacatgatggtctgggtacccatggtgtaggcctgacggggcacgtcgtcgatgctgtcgaacagacggctgttggcctgaatggtgctctcggtaaggtcgacgcagtgcgtacccttggagaagtggtcatcgggctcgttgaagccgatgtgaccgttgttgccaatgccgagcagctgcagatccgggtaaccggcggcagcgacgatcttgtcgtactcggagcaggcagcggcggcgtcggggttagaaccgtcgggcacatgcgtgttgttcaggtcgatgttgatgtgatcgaagaagttctcacgcataaaatagtgatagctctggggatcgtcatgcgaaaggccacgatactcgtccaggttataggtgctgacctcggcaaagtcgacgtcgcccttctcataccaagcggcaagctgcttgtaggcgccaatcggggtggagccggtggcaaggcccagcacgcaatcgggcttgaggatgacctgcgccgagatgatattggcggccttacggctcatatcctcgtagtctttagctttaatgatcttcattacgcgtcctttctcgtacaagagaggcaaggctccccttacaagcgcttgcccgcggcccgcgtcggccgcaaccaacgtgtgcggccaccagggcgaggtcgcgtaatgtatgtgtctcgtgtctagccgcgtcgaggcccctgcccgtccacggtgacccgaagccctttagcttcggacaaatcccatcttgccacggagggcgccctctttcaagggcgccctccgtaaacgtgtttgaattgtaggctaaaggccaagcgcgctcctagcgctcgcgagcgacgatgagttggtccatctcctcgacatgctcgccaacggagcccttgatgctcgagaactcaacagagttgcacaccaagataggaaccgtcacatcgtagccctcggcagcgattgcttcgcgatcgaactcgatgagcacgtcacccttatggacaatatcgcccacctgcgcatgcacggtaaagtgcttgccctcgagctgaacggtatcgagtccaacgtggataagcacatccaggccatcgaccgtgttaagcgcaacagcgtgtcccgtgggaaaaatagcctcgaccttggcatcggccggtgcgatcacacgcgttccggtgggctgaatcgccacgccctggcccaaaagaccggtggcaaacgtttggtcattgacctcggacagtggaataacgtcgcccgagatgggagcatccagcgtaaggactcgaccacgcataccaaaagaccttaggactttagtgaacatgctccccctcggacataccaatcaaccaaatgaactttaccagtttaccacttggcaaccgtttttgaccattagggaagttcgcgcttgacaacctcaacgatgtcgtcgacaacacgctgggtcagctcatgcgtttcggcctcggccataacgcggaccagcggctcagtgccactcgggcgcaccagaatgcggccgcggccgtcaagctccttctcggcggcagcgacggcatcccagatgggccggcagtcgtccaggccggccttgttgtcggaatgcacgttgacgagcacctgcggatacttcttcatgatgccggcaagatcggtgagggtgcgaccagtgcgcttgagcacggccagcagctgcagggccgtcaccaggccgtcgccggtggtgttgtgctccaggaagatgatatggccggactgctcgccgccgatgacggcgccgtctgcgagcatgcgctccagaacgtagcggtcgcccacggcggtctggaccatctcgaagccctgctccttcatagcgatggagaagcccagattgcacatgacggtcgagacaatctcggagttggcgagcttgccacgagcggcgaggtcggagccacagatggccaggatgtagtcaccgtcgatctcgttgccctcgctgtcgacgaagagcacgcggtcggcatcgccatcgtgggccaggccaatgtcggcgtgggtgcgcaggacgagctcgcgcaggggctcaagatgggtggagccgcactcgacgttgatgtcggtgccgcagtagtcggtgttgatggcatggaccgtggcgcccaggcgctgcaatgcggcgggcgtggtctggcaagaggcgccgtgaccgcagtcgacggcaacaaccaggccgtcgagcctcaggccgtcgagcgtatcgatagcgtggtcgacgtatgccttgcgagcatccttcatcttgatgatgtggcccacaccggcgccagtcggcagcgtgtcggcagccatggcctcctcggacatgacccatgcgctgatctcctcctcgacggcgtcgggaagcttcatgcccttgcggctaaagaacttgatgccgttgaactccggcggattgtgcgaagcggaaatgacgatgccgccgtcgagctcgttctgaacggtgagcagcgccacggccggcgtagggataacgccgcagcagtgtggacggccgccctcggccatgatgccggcggtcagagcactctcgagcatggtgcccgaaaggcgcgtgtcgcggccgacgcagatatccggaccaaggaacttggtcgccgcgcggcccaggcgaaacgcgaggtcgcacgagaggtcggcattggcgacgccacgaacgccgtcggtaccgaagatgttctggggcataggattgctccttccctagcgggcgatatgcaaccgcccaccctagtcgaaaaagaaaagcgggacccgccgaggaatcggcaggccccgcttgtacattgtatctcgtaaggagataaaaccttagcgcttggagaactggggagcgcggcgggccttcttgaggccgtacttcttgcgctcgaccacgcgagcatcgcgcgtaaggaaaccggccttcttgaggtcagcacggtagtcgccagcgttcaggagagcgcgagcgatgcccaggcgcagagcgccggactgaccggagatgccgccgccatcgcacagagcgataacgtcgaactgaccggcggtgtcggtcaccttgaagggagcaagggcgttctcaacgagctgatgacggccgaaatactgctcggcgtcacgcttgttgacagtcaccttgccggtgccggggacgagacggacgcgggcgacggcgttcttacgacggccggtaccctggtagacaacggtgttctcagccatctttaagcctccagctcaatcttcgtggggttctgggcagcgtgcggatgctcggcaccagcgtagaccttaagcttggtcatctgggcacggccgagggtggtcttgggcagcatgccgcgaacggcgcgctcgatgaccttctccgggtgcttctccatagcctggcggaagctctcagccttgaggccgccgttgtagccgctgtggcgataataggtcttcgtgtcggccttgttaccggtaagctggaccttatcggcgttgatgacgacaacgaagtcgccgcagtcgctgttgggcgtgaactggggcttgttcttaccgcgcaggatcattgcgatctgggtggcaagacggcccaggacagcaccatcggcgtcgacgagaacccagttgcgctggacctcgccctgcttggcgtagtgagtcgatttcgaaatcacttagactcctccatgtacagtacgtgttgttacagagattcacggggctctgcaagtaacccgtccatattaccccgctcgccgcccgagtcaacaggtattttggctccgaccagagtttctgcacatgtcgtccacgcccggtgttttcacgggacggggcctagagatccctcgacgagcaaatggccctctaggcccctatctgttatcgctttttgcgggtcgaccaccttagcgctcgacgaactcctgaatttccgcgagcaggcgctttgcctcccggcggccctggatatacaggtcgagcagcttggccgtgtcatgctccacatggccgacctcgaccggcttttgcggagccacgattagcgcacgatcctcgcgctcatacttccacaggtgcatgcgctggacgttgtagcggtcgtggcgcgcctcgatggcctcgagcagataggggtagtcgccatagcgcgcacgcgcggccggcataaactcgtagggccccttttcgtacgagcggtcctgcgtgagcacgacaatcgcgcgatcgtatccggcctcctccagcacgtgctccacgggcaccgaatctgccacgccgccatcgacgtacttgtgaccgtcgatctcgaccggcggcgtcaccagcggcaacgaggttgaggcgcgtacgcagtcgatatcgagcatggcgtttttgacgggcaggtaggcagcggtgccaaacagcatgtccgtcgcgacggcatacatttcgatgggactcgcgtcgaaggtctcgttatcgaagggatctagacggtcctgcacgtcgttgaagataaagtcgtagccgacgatagagcccgtggatgcaaacgacgcggcacccatatagcggttgtcattgcagaaggccagattgatgcggttaacgcggccgatctggtgcgacttgtagttcacgccgttgagagcgccggccgatacgccgaacaccgccgggatctcgacaccggcctccatgaggacgtcgagcacgcctgcggtaaattgcccacggaagctgccgccctccagaacgagcgcgaccttgccggcatttttcgccttatcttctgcagtcatgttgacctcctgccattgcgttttggccttcttctacccagttttgcgatggagggcgcactagtttttggagttgagaaacggggcggaaagcgcgtcccgttctgagcgtggattctgggacgtagtttccgctgggcgacagttgggaaagcgcgtcccgccctgcgttgccgcggcgtttgcttaacgctcgcgccctgcacagagttcgattctccgcggtctggggcttccgttgacgggttggggccggggccagacacccgatcggcatcgcatctatatctggttgaggctttgcgcggagaatccgcgtatttgcttcgcaaatacgcgccggcttcggccgcctgccggcgtcctcgcccgcgggctaaaaacgctcacgccctgcacagagttcgattctccgcggtatctgataagtaataaaaaagcaggtaggtgcgtttacctacctgcttgtaactattggtggagctggcgttcattcggtcgaacacctcgccacctggacctatagcgccaggcagcgacggattatcgcccaagccggcagaatcgtcaaacgtgaacgccacgcgcaggccgtcgtcatcgtcggggccgcccagcaccacgcgcgccacgaacgtgcgcaggagctgcgcgtcgtccacctcggcggcggccatgccctcaagccagaacagcgcgcggtcgtagtcaaggcgggcggcctcaagggcctcggccgtgcgcagctcgtccttgaggagcgcctgccgctgcttcagcgcgtctatgcgctccttgccgcccggcggcgcgatgcccgactcgatggccgcccatatgttggagaacgccgtctcgatcttggccagctcgccctttatggtctcgctcaagggcttctcgtcggcgcgctcctcctcggcgtcggccagcatgcgagcgatgcgctcgcggctgtcggcgctgcccagggcctcgcgcacggcgtcggccacgcgcttctccacgacatcgcggcgcacggtgcgcccgcagctgcggcagcggtagtagtgatagggcctgcccgacttgcccgtgccgctggtgccggtcatcagcccgccgtcgcgcccgtcgtagagcttgcccgtgagcgggaagtcccacgcttcggtcttggcgcggggcctgtgcgagtcctcaagcatccgtatcaccctctcctcgtcatccatgggaacgatggcgggcatgccgccgggcacgaccacgcccgcgtagtggtactccccgccgttctcccgccgcatcagtatgcggcgcaccgtctggaagcgccacttgccgccgcgcttggtgcggtacggctcccaggcgcgcaccacgtcggccaccgacttgcccgacaagaccatgcgcacgcccaggcggatggcggcggcctcctcctcgttgaccacgtagcgcccgtccgctatgtcccagccgtagcgcacgcagccgttggccatgcaccgctcggcgttcttctgtatgccgtcgcgtatgcgctcgccgtcgagcgcgctctcgtactccgccagcacctccagcatgcccagctgcagcacgcccgccgagccgtccgagatgtcctcgcccgcgtacagtatctcgacgcggcagcggcgcagcatgatgcgcgccatggccatctcgtcgcggttgcgcatgatgcgcgtcaccttccagatgaccacgaaatcgaacagcccgcgcctggcgtccgccatcatgcgctggaactccgcgcggtcggtgttggtgccggtctgcgcgtagtcgcagtacgtggccaccacgcgcaggtcgttctcggcgcagtaggcgcgggacttctccacctgtatctctatggactcgccgcgctggttgtggctcgagaagcgggcgtatatcgccgcgcgcccgcccacggctactccatctcgtcggcggcctggaaccacaccaccgtgccgatcacgcgcacgggtccgtcgtccatgccgaaaatcatgtcctcgtagtcctcgaagctatccgccgacagcatcagcttggtgctgcccttgtaccagcggcgcatgaccgcgcggtagtcctcggtctccaccacggcgatggacccgttggcgggctggcggtcggggtcgaccagcacgtggctgccctcgggtatgacgcggttcatgcagtcgccctcgacctccagggcgaacgcgcgcggatgcccggcgcacaccgaggcgggcacctcaacgcggtgcgctatctcctcctcgtcggcgagcgcgccggcgtgcacgcgcccgagcgtgagcagcggcacggtggcgctgctggccaccacgggcatggcaccagcgggcatataggagctgcccttgggctttttggtcacggggtcaatctgatccattccgccgtcttctataaggtgtgacttactaatctgatagcaggccgccatgcgctcaatagctcccatacggggttcggagcggccattttcccactgcgaaacggcgttacctgtcacacctgcaatctcacccagttcatcctgggtaacgtcgaaaatctgccgtaacttctttatgttgtcggatatcggcatcttaactccttccaggacttaaatttattttcaattttaccaaaattaatcttgaccgtgttctgaagattaattacagttatggacagaaaggagggagtatgaagtcactcaagcaggcgcgcatgagcaagggcgtaaccaagaaggcaatggctgaacatctgggcatttcaggacctacatacgatgtttatgaagaccaccccgaccgtatgcgcatcgagacggctaaaaaggccgccgacttcttgggctacaaacccgaagaaatttttttcgcttcaaactgtaattagatttacctatcagaaaaggagacaccccatgaccaccaagagccaccagcccgagttcgtcgatgagatcatcggcaaaacgctcgaccacctcatcgacgaccgcaagcgcgtggccgtcaacttcgagctggccgagaacggctgcatggaggagacgcacgtcagcctcaagcgccgcatcgcggccatgtggggcttccagacgagcggcatcgaacttttggaggcgagcacgacccggttcgagctcggcggcatgcagttcaacgtctacagctccgtgcagttcagcgtgaacggcaagggctggagcaccgacttcaagcgcatcgagcgcgacagcgcctacgacgtgaaggagtaggccatgctgaacgaggtgaccgtacgggggggttcaccgccctcaacgtgaagagcggcaagtgcgtgctgcagtttgagctggacccgaagttccgcgacttcatccccaagctggtggagttcacggggcagatgctcaacatccacgtgtacgacgaccaggaggtgatgttcgtggatagggacaccggtgaggtcgcctacgaggacgccccgctgcttctgccgggcgtcgcgggcgaatgaccccgatacagcgcgccatgtgcgacgagtgcgccgccatgatgcgcgagttctacaaggacccagagaacgagaggaagttccaggaatggaaaagatcaagggaaagagggtgcgcgtcgcagccggcaagcgaaagacgcgcaccgcaacggttcacttccgaaccgagaccagtgtaacacccgagcagcgccgcgagaggctgcaggccgttttcgccgccctgttcgtctgcgcgtgcatcgccgccacatgggcgctggaggcaacggtatggccgaggtagacgccaaggcccaggccctcgtggccaaggcgtgcggctgggttgcctcgaaccccgatacatgggcgaagctgcgccgcatctgctaccgcctgatgctggagggccacgtcatccagcgcgacaacgtgtacaccctggcgtgccagaacggcatgaccgtgagcgaggccagcgagttcaagcgcgaccacaacctgtggagcgtgctgtcccgctacatggtgctgcagcgcccctccatgctggccgccgtgagcttccgccgcacgccggtggactccgtggacctggtgggcacgtgggaggccatcgtgggcccagccgttttcgccgcctccacgctaaccgaggcgcagggcatctacgacaggggcgcgcaatgaggtgcaccgtcacggtcgagggccgaatgccgagcctgaacgactacatcagcgccgagcgcgccaaccgctacaaggcggcggccatgaagaagcgcgagacggcgcgcgtgagggcggcggccatgcagcagcgcgcgccgcgcttcgagcgccgggtgaccgtgcgcaccacgttctacgagcccgacatgcgccgcgacgccgacaacgtgggcttcgcgcgcaagttcgtgctcgacggcctggtggcggcgggcgtaatcaaggacgactcccgcaagtacgtggagcagtgccccgacagggtgctcaccgacagggcgcgcccccgcgtggtcgtggaggtgagcgacgagtgacccgccgagacaagggcaggccacacagggcgtggcgcaaggccgacctcgaccgcatagccgagctggcgggaaaggtgcccgcccgcgagattcgccgcgagctgcggctgtccaagaaccagttggataacgcgcggcgcgtgatcaacgccagcggcggccacgtgtccctgcgctgctaccgccaccgcctggagctgtgcccgtcgtgcgggtgccgcagggcgaccctcggcaaggacggcatctgcgaaccgtgcagacgccagcagcagcttgaggccatagaggcccgcatagccgagctgctgccgaggctgaccgcagaggagcgccgcacctacgagcgcaccgagtgcggccgagagagccgcgccgaccccatgccgcaggccccggacacctcgggcatgagccgctacgccgccgacaaggcagcagaggcgcacgacgaggccatggagcggtggctgtgccgctacctgtaccgcagggtcaaggcggcgcagaagcgcaaggagcgcatagagaaaaaagttccgaaatcctgaaaagtttttatcacttttagttttcccagttaggagaccaaaatgctcacggaaatcatcagcaagaccgtcgcggacaagacggtggacagcatcctgaagcgcatcgagcgcgccgtccccgtgcccgagccgggcgacggcggcttcgacgccgccatgcgccaggcgttcaacatgggggccgcctgcatggccgcgcaaatcaagaacggccccgtgcccaccaagcgcatcgcgctcatgggcgaggtggcccgcgtggcgtgccgcgcccgcctggtgggcatggagtgccgcgtggtcgtagacgaggaggcccgcgcatgcaatcgctagaggaggtcgcgatctgcgacgtgtacccctacgagcgcgccgacggcgagccgatgaacccgcgcgacttcaccaccaaggagagcgccgagcacatcgcgggcctggccgcgcagttcaaggccaaccgcctcaaccccggccagcccgtcatgaagcccatcctgtacaaggagggcggcatctactggatcatcgacggcgagtgccgcgtgcgcgccatgagggccatcggcaccgagcgtttcctcgccgaggtctacgacgacctggacgacgccgagctggcgcgcgtggaggccgccaaggccatggtggagaccgacgccaagctggggctgaccgccgaggagaagtcgcgcggcgtgcagaccatgctggcgctcgacattcccgacgaggaggtggccgtggccgcccgcaccgacgcgggcaccgtggccaaggcgcgccgcgccacccgcagggtgcaggacgccgcctacgacatgacgctcgaccgcctggccgccatcgccgagttcgagggcgacgacgaggccgtggccgagctgcgcgactgcaagcagtccgaatggcagcgcgtgtacacgagcctgaaggccgaggccgagaagaggcgcaaccgcgccgaggtggtggcggtgcttgccgacgcgggcgtcgagttcgtcgacgaatgccccgagggcttcgccgcatgccgcacgttttccgactaccgccccgacctggcggcgctggacgcctacgtggccgacaacgcgggcgcggggcttctggccgaggagacgccgttcggcgtgaccctgctggcgccggtggccgagggggccgacgaggccgcacaggccgcagcccagcgcaaggccgacttccaggccgcctacgaggacggcgcgaaggcccgccgcgagtggcttgccgcccacgcgggcgacctcaagtcgatgcgccgcacggctctggctctgaccgcgttcgccatggaggccgaggccgtggaatcgttcgaggagctgctgggccgacccatcgaccgcacgcccaccgagctggccgtggccatgggctggcgggcggcgtggaacatgagcggctggacggcctggagcctcatggaaggcggcagccccgtgtacctcaaccgagcgacggtcgagaacgtgaccatcatctacgaggccatgaaggccgacggctacgagccgaacgcggccgagacggaaacctacgaggcgtgcatggcgcgcctgggaagcgaggagtaaatgagcgaagcagttgaggccgagatcatcgagcccgaggaggcgtcagagctgaccgtggcgtactcccccgccgtgatcgaggccaacttcgacgccctggaggcgcacgtgcgcaggctggtggccgactacgagggcgcgacctacgacatgggcaaggacgagaacgtgaaggccgccaagcgcgaccgcgcctacctcaacggcatcgccaaggagatagacgagcgccgcaaggcagtgagccgcgagtacacgaagcccctggctgcgttcgaggacaggtgcaaggccgtggcgggcatcgccaagcaggcggccgacggcatcaaggcgcagctggacgatgccgaggccgagcgccaggcgcgcgcatacgcgaagctgcaggagcactacgaggagttcgccgggctgctggcccccgtcgtgccctatgagcgtttccacgagaagcagtggaccaacaagaccttcggcgaggtgaaggcattcaaggccctggaggccaaggtagagcgcctggcccaggactgggaaaccctcaaggcgcagttccagggcgagccgttctacgacgaggccgagcgcgagctgttcgccaccctggacctgggcgcggccataacggcggcgcacaaggccgccgaggagcgccagcgaatcgccgagctgaaggcggcaatggagccggaacccgtggaagagcccgaatccgaagcggtgcccgagcccgcggaatgccagcccgcagagttcccgcagccgcttgagcagatgcccgagccgcagcccgcgcccatgcccgccccggtgccgccagcgccgcccgcaccggcacccgtggccaaggcgggcgacccgtggacggtcgtggtgccgtgcgccacgcgcgagcagatgcagggcgtcgcggcggccctcaaggcgcagggcgtcgtgggcaccatcatgcacggcacggttggccaggtttacgagcgaatgaacggaggctactagcatgacccaggaacagcagcccatcgacctcatggcggccgttgcccgcgtgcagcgcgccgtggtggtgcccaaggccaagtacaacgctttcggcaagttcagctaccgcagctacgaggacatagtggccgcgctgaaggagccgtgcgccaaggagggcctggcgttcttcatgaccgacgagctggtgcagataggcgaccgctactacgtgaagtccacggcgtgcgtgttccccgccgagggcggcgagggcctgctgcaggtgagcgcctacgcccgcgaggacgagcacaagaagggctccgacgacgcccaggtgaccggcatggcgtcgagctacgcccgcaagtacgcgctgtgcggggcgttcgccatcgacgggcagagcgaccccgacgccatggaggagcagcccgcgcccgaggagaagcagccgcccgcagacggccccttcacggcccactgccgcagctgcggggcgcgctaccagttcgccagcatgccgcagtacatggagttcgtggccaacagcccgtgctgcccgcgccccgactggcaggtcgagtagatgcaggcgctcaccgaggagctggacgagctgaccgacaggctggaggccgagctgaagacctgcaaggagtccggctgccagtacgccgagaacgaggccgagtaccgcaaggccctgcgcatcgccatcctgaacgagcgccagaagggcacgcccgtcaccatcatcggcgacgtgtgccggggccaggagcagatagcggaggccaagcgccgccgcgactgctccgaggccatctataaggcctcgcaggaggccatcaacgtaatcaagctgcgtatccgcatggtagacgcgcagatcacccgcatctggaacagcggggacgtaacccaaggagggtatctatgagcatcaaccgcgtatgcatatccggcaacctgacccgcgaccccgtgctgcgctccacgtctggcggcatgtccgtgctgtccatgggcgtggccgtcaacgaccgccgcaagaaccagcagaccgggcagtgggaggactacccgaacttcgtggactgcacgctgttcggcacccgtggcgagaagctggcgcagtacctcgccaaaggcagcaaggtggccatcgagggcaagctgcgctaccgcagctggaacgaccagcagaccggccagaagcgcagcgcgctggaggtcgtggtggacgagctggagttcatgagcagccagcaacagcagcagggctacgcgccgcagcagtacgcgccccaggcggccccgcaagcgccgcaggcccgcacgtacggccagggacgccccgccccggcacctgcgccgcagcagcccgcctacgcgccgcagccggccactcagcaggcgtacgcgccacagcagcccgcgccgcagcagcaggccatgcccgatctgtacgacgaggatatcccgttttagggaaggcgacggcgacactatgggcatggttatacacgacgacttctgggcggccgcgcaggccatgcccgagaagcagcgcgcgccgttcatctacgccatcgtcgagtaccggttcacgggcaaggagccgcagggcagccccgcgtggctgcctaccttcctggtgctcaagggcaggctcgacatgggcgacgagaagagcgagcgcgcaaggaaggcggccaacgcccgctggggcaacaggccggggaaggaagacgcggtggacgatgcggcggcacgggcgcaagccgatgcgcaagcacatgcgggagcatatgcggatacagatgcagccgcacatgcgcaagcagatgcggatgcacatgcaggcgcatcgagttgcggcaatgcagaggttgaggttgagtatatagataaccccttaatcccctttgacgaaatcgtgcatgcgctcaacgaggcagccggcacccgctaccgctcaagcagcgccaagacccgcaggctgatacacgcccgctgggccgagggctaccgcctccccgacttcctggccgtcatcgacacgatggcagccgagtgggcgggcgacccgaagatggccaagtacctgcggccctccacgctgttctcgccgaagttcgaggactacgtgaacagcggcccgaggacccggaaggaggccgacggctatgccgagtacgactgagtgcccccactgcggggcgcagctggaggtccgctacgtggtgctggctggccgccgcaccttctgcggctggaagccgtgcggctgcccgggtgccgtggcggagcgcgacgagcgttcgcgccttgaggccagggccaaggccgaggaggccgcagccaaacgccgccgggcctacgagcgggccggaatcaagccccgcttcatgacagccgcctcccccatggccgagggcattgccgcgaaggttgagcaagggcgcggggcgtacatctgcggccccgtgggaaccggcaagacccacctggcgagcgccgtggcgcggctcctggtggacggcggcaccagcgtgagggtgaccgacatgctgggcgtgctggccgccatcaagggcacctacggcggcgacggcaccgaggacggcgtgctgtccaggctctcccgcgtggggtgcctggtgctggacgacctgggcaaggagtcccccaccgactggacgctggggcaggtgttccgcgtcgtgaacgacaggtacgagaacatgaggcccgtggtcgtgaccacgcagtacggcaagggcgacctcatacgccgcctggccaagaacggcgacgaggagacggcggtggccatcgtgagccgcctgtcggagatgtgcgacaagtacgagctgcaaggcagggacaggaggctatcgaatggcaaacgttgacacgctgcccgagatcctgcgccccctcatggaggggccgagcatcgagacgcccaggtgcgccgtgtgcggcgcgccgtggccgctcaaccgccaccacatcgtgaggcgcggggcgggcaagctgttccgcgacgggcgcgaggttcccaagcccacggtgatgctgtgcggcagcggcaacggcagcggctgccacgggctggcgcacgccaaccggctgcacttccgctgggtcagggccgagcagaggttcaaccgccccgccccgccgggctcggggcactgggagtacctgctgctgccggaaccgaccaagtacgcggatgccctggccatggacggctgggggcggctgccgaggggcaggcggtgcatgtgagcgggtacgagccttcaagcgggtggaacctgccgccgggctgcttcgagtccgaccccagggcaccgtggaaccggcccgacccgtgggagggctgcacgtgccgggagtgccgcttctgcggccgtgtgcagggcgctggcggcgaggccgtgtgcgcctgcgacgccatgactggcggcggccccgacgtggaggcggtggacgagacaagcgaggcatgcgagtgcttcgagttcgaataggagacgaaacgatgaagaagatctacgcggtggccacggagagcgacgtggtgctggcattcgagagcagatcggacgcagacgagtacgcaggcgagcacgacggcatggcggtgctgccggtgccgtgcgtgggggcctacgagtacccctgcgagaggccggccaccgactgggaccgaatcgccgacgctctgccgaagggaggcgagcaggcatgaggctgtacatgtgcgcatgcgaacgctgcggcaaggaggtgccggcgaccctggcgggttacgccaagatggtgctggggaacagcgcgcgaatcgacggcaaggcgagggccttgtgcccggagtgcgccgagagcctgcgggcgtggttcctcgcaggcgcggtgaagccggaaggaagggagtagacatgggaatcatctgcgatacctgcgggcgcgatatcgacgccctgcggcaggacaacatgggcgtagacgcgccgctgtgcgaggactgctggggcgagcagcaaagtcatacggtagcagtgccgcgtcgcgaggctcgcaacctgaggttcgagaacgccctactgcgcgaaaagctggacgccggaaccgaagagacggccgtgcagaacctgcgcaagggcatcgagacggcctacgaggcgagccgcgagcgcgccctggcgctcacgaagctggacgagtgcgagctgtggctggggcgctgcgagccgagggcggcagcgtcaccgacgctcaagggcgcggcccaggacgccgccatgccttgcctcaaggccgaagaggcgcacggtttcgcgatgcccgacgtgaacgtggaggtgaaggccgaggtaacggccgaggagctggccaagagactgcgcggggccatgaagccggccatgcggatggcggtggagtagccatggagcagcagaccgagaagccgaagcgccgacccagtatcgaggtgcgctgcccgaagtgcggcatgcgcgagatctggcaccacctgcccaagggcggcgaccgctgccgctggtgcggccacctgttcgaggacttcacctaccgcaaggtcgggccgagcgcgaaggagggggcgcgatgacgaactgggagcaccttttcggcacgcccgagcgggccatccacacggagacggagttccactcgtggcccttcttcatcgccgtgtatgagacgagccgcatgagcagctgcactaccagcaagcggctgctggccagcttctgcgaggaggccgactacctggaatggctcaaggccgagtacgacgacggcaccatcgagtgggaggagcgatgaaccgcccgggatgcaactgggggtgcctgctgttcatagcggcggcaatcgccatagacgcggcggccatctacgccataagggcgctggcgctcgggctcatggccatggccgtggcggcgtgcggataggggcaaccgaatacggaaacaggcagagggccgtccttcggggcggccttttccgtgcccggcgacacgcttgcgaccatatgggccgagagataagggaaggaggccgcaggtgcccaagaaggacaagccgctcacggcgaagcaggaggcgttcgcccgcgagatggccaagccccgcgcaaagcagcaggacgcgtaccgcgcggcctacgactgcaagcgcatgaactacaactcgataagctgcgccgcctccaagctgatgcgagacccacgaatcgcgcacagaatccaggaaatccgcgacgcggccgccaaggactgccgatgggagctgcaggacgccgccgccccgctgttcgaggtgctggacggcgcgctgcccatcttccgccgccaggcggccgagggcagcatcaacggcgacgcacgcctggccataaccgagagcgtgaagctgctcaacgacatgttcggcgtggacggcgcgaaggccgccatggcggaggcgggggtgaccatcgttgacgacctcggttaggctctcggacgtcgtggcctccgtgttcgccggcgtgtggcgctccatcaaggcgcacgagttcacgcactactggttcaagggcgggcgcaactccaccaagtcgtcgttcatatccatcgccatcgtgctgctggtcatgctcaacccggaggccaacgccgtcgtgctgcgcaaggtcggcaacacgctgcgcacgtccgtgtacgagcagataggctgggcgtgcgacgtgctcggcgtggcccgcctgttcgacttcggcctgtcgcccatggaggtgacgtaccgccccaccgggcaggtcatacgctttgtgggatgcgacaagcccaagaagctgaagtcggcgaagttccgcaccggctactgcgccgtggtgtggttcgaggaggtcgacgagttcgacggcatggacgaggtgcgcagcgtgctggccacgttcctgcgcggcggcgacatgttctgggtcttctacagctacaaccctccccgctcggctcgcaactgggtgaacaaggaggcgcgcgacctggaggcccacccgggcgaggacgggcgcttcatatgccacaccacgtacctggacgtcatagacgagcaccccgagtggataagcgccacggcgctggcggaggccgagcgcagccgccgcaagacgcccgagtcctaccgctggcaatggctcggcgaggtcatcggcacgggctccgaggtgttccccgacgagctgctggacatacgccccataacggacgaggagcgcgcgtccatctccctgcgctcgttcggcgtggacgcgggcagcgtgcacccgtgggtgttcatggaggcgggatacgacgagaacgagcgcgtgctgtacctgctggacgaggagagccgccagggcaccgaggccatcgacgtcaagaccgccgagctggtggcggccaagctgcaggcggccgaggaccccgccgccgacgtgtggtgcgacagcgcggcgcgcggcatgatcctctactaccaggagcagggcatcggcgcgcagaaatcgctcaagcagggcctaaacgcgcccaagaaccgcatcaggtggatgcagaacctcacgcgcatagtcatcgaccccgaccgctgcccgctcgccgccaaggagttccccgagtacgagtacgtgtcaaacgggcagggcgacataaccgagacactgccgaaggtgaacgacgacgcgatagacgcggcgggctacgccgcaggactgtggataaggagcaacctctgatggagaagcgaggcaacacgggctacgccgaggcgtggctgcgccgcatgggataccagccggacacccgcatgcagggcatggtgggcgtatggttcggctggttcgcggcgaacaacagctggtaccactacagcgagcggcgcggcttccgcgtgtacaagcgcgagcgcgccagcctgcacccggcggcgctcgtggccgacgagtgggccagcctgctcatgaacgagagcacgatcatctccagcacgagcgacgagcgccgcgcctggatggcgcgttacttcgccaaccccacggcgacgggcggcgtcggcgacgaggggcccgagggcggccaggacgcgccgcagccgacagaggacggcgacgcgcccacatcgttcgccatggacaacgccgacttcatagcccgcgcgttcgccatgggcacgggcgcgtgggtcatcgagccgcgaggcgtgaccgacagcacctacacgcccgacgccgagctgcgcatcgtgcgctacgacgccacgcagatagtcccgctcacgtggagcgccgacgactgcacgcagtgcgcgttcgtgggccgcgtggaggtcgccgggcgcgactacgaccagtgccaggcgcacgtgctcaagggcggcacctaccacatcctcacgcagctgttcgacacccgcacgcacaagcaggtggcggtcgagggcatcagcgccgacatggacacgcgctgcacccgcccgcttttcgcgctggtgcgccccgccgtgtcgaaccgcttctacgactactgcgcgatgggcgcgagcgtgtactgcaacgccgtgggggccatgaaggtggtcgacgaggccgccacctccctgctcgaccacattcgcgtgggccgcccgcgcacgttcgtggacaagaccctcatagagtccaagaccgacaaggggccggacggcagcctcacgaagacctactacgccttcggcgaggccgacgacaccatcttcagcatgaaccccggcgacgaggggtcggccaagattcagaccgttcagagcgacctcaaggccgacgagaacgccagcgccatcaacacgggcctgcgcctgctgtcggtggcgtgcggcttcggcaacggctacttctcctgggagtcgcacacgggcctgaagaccgccaaggaggtggcggccgacaactcgcagctgatgcgatccatccaccggcacgagaacgccctgcgcaagtccatcgtgcgcctcgtgaacggcatggccgacgcgtgccgcagcatcaagggcgaggccgtgccctacggcgacgtcaccgtggacttcgacgactccatcatcagcgacacgcagagcgcgcgcgagatggccatgagcgaggtcggcgcgggcatcatggccccgtgggagtaccgccgccgcttctacggcgagaccagcaacgaggccaaggccaacgtgcccgagcagcagggcggcgcgttcgacatgctgggcgacgggctcgcctgatgctggggccggactacatagagcacttcaccgacgcagcgcagggggccatggacgaatacaccctgcgcctggtgtgcatctacgccgcgctcataggctccatcgacttcgagggcgacagcgcctactcgcaggccgcccgcaaggcggcgcttgccgccaaggacgtgcagaaggccatgaacgaggagggccgcagagccgcgcgcgaggctgccaaggctgcggccgaggccgtggccaagagcgccgaggccgacctggccacgctgggcacggccatgggcgcgctgtccaagacgatgcagtggagactgcacaactcaacgcgggccacggcggcgggagtgcaggacgtcgtgagccgcgacaacctgaagatgcccgccaacgtgcagcgcgcctacctcgaagtcgtggcgcaggccgtggctcgggtgaactcgggcatggcgggctacgagcaggccacccgcgaggccgtgctgaagctggcgcggcgcggcgtgtccgtcgtggactacaagagcggggtgtgggcgcagcccgacgtggccatgcgccgccacattcgcacgcaggcggtgcaggccggcagccgcaacacgctggagctgcttgaagagaccgggcacgacctcgtgcagacctcctcgcacggcggggcgcgcgagagccacgccaagtggcagggccgcgtgttcagtctgtcgggcaagtccaagaagtacccgccgttctaccgcgagacgggctacggctctgtcgatggcctgtgcggcgcgaactgcaagcacgacttcggcatctacgtggagggccagcagctgcggtacgagcgcgatcccgatggcggcgacgagaagcgcgaggagcgataccaggcagagcagaagcagcgcgagcttgagcgcggcatacgcgccgccaagcgcgaggcaacggccctggaggccgccgggctcgacaacaccaaggagcgcctgcgcctgggcaagctgcagaagcgccagcgcgagcacatagccgcccatccctacctgtcccgcgagcgcacgcgcgaggccgccgtggaatcgaaggagcgcatctacccgcttgccacggacaagacctgggtgcgcgagaagttcatgccgggcaagggcgcgggcaccgccgcagacgtgagccgccgcgccgtgaacggcagggcctaccacgacaaggtggcgtccctccccatcccgaagcgcgcaagcgaggccgtgtacgccgagagccgccgcatcctgcgcgaccgcgacggcacgggatacgaacgcatgtccgtcgtgtcgtggaagaagggcgagcgcgtcaccgacaccttcggacacggcctgaagagccaggcgtgcggcctgaccgccaagcaggtggaggcgtgcaggcgcaccaagggcggcgtggtgctgattcacaaccaccccatgagctcgccgccgtcgtggaccgacattcgaacggtggcggaaaacgactgggtgcgcagctcggtggtggcgtgccacgatggtacaatctacgaaatcaaggtgaacgaccgcagcgtcgtacaagcgtacgaggagctgcgagagctggcgaaaagagagtgcccgaacgcgggcggcgacgttatcgaccagcttgccaccgaaatgctctacgagcgaaacgaggaagcgaaatggttcaggctgacaaaaaagaagtgacgccagaggactgggtgctcgtcatagatgacagcgcctccgagtcgaaagccgccgaaaagctgaccaaagaagagcgcgaggagcttttcgccaagtcccgcaaggttctgcgcgacgcggggctgatgaagtagaccaagcgacaaccgagtagacgcacggcatcaaggccgcccatcacgggcggccttttcttttgcctggcgacacctcggggaagatgcggtcacgcgatggggcggcgacaacatgccccgcacgcgaccgcggcgacaacggcgggccatccaagcgcgcagggaagcgcgacaaccaaacacggaaggagcaagcgatggcggacgacaacaagccccagggcaacgagggcggcgacaacggccagcagaccgagcccgcgaaggaggtcgtgtcctacgcgaagtacaagcgcgagaccgacgagtaccaggagcaggtgaaggccctcaaggccgagctggagcagcgcgacaagcagatcgaggagttcaccgccaaggcgggcaacgccgacgaactgcaggccgcgctcgacaaggccaaggccgacaacgaggcgtacaaggccgacgccgagaagcgcgaggccgacatgcgccgcgacttcgccatcgacaccaagctggcgcagatgggggtgcgcaacgccaaggcggcgcgcgcgatcatcccgaacatcgctgacgcgaagctggacgagcagggcaacctcacgggcatcgacttcgaggccctgaagaaggataacgcctacatgttcaccgaccagccccgcgagagcgcgggcggcgaccccaagggcggcgcaggctccgacggcctggccgacttccgcgcagctttcggactcaccgacgaatcttcaaaggagtaaatcatgccaaacagcatcgaactgcccaagggctacgagaacgtgctcatggaggcgtaccgcaaggaatccctgaccgcagtgcttgagagcgccgcgccgcagggcaacatcgcgcagatggagcagctgggcgagttctactaccccgtctactccatgggtggcctgggcgacgtgcaggccaacgggcgactgccgcagaacagcggcgcgtccctgacttggaagcccatcagcgccaactacgaccgcggcaccatcctggaaatcgaccagaaagtggacgcccagtccttcaatctggcgttcggcaacgccgccgcgcacttcaaccgcaccaaggtggtgcccgagggagacgcgttcgtgttctccacgctgtgcgcaggcaccggcatcaccaaggagcagaagacctactccgacggcgcggacatgctcaagggcctgaacgccgccatgtgcgacatggacgagaaggaggtgccggaagagggccgcgtgctgttcatcacccccaccctgctgggtatggtgaaggacctggacaccaccaagtcccgagaggcgctggacggcttctcctccatcgtgaaggtgccgcagtcccgcttctacagcgccatcgaccttttggacggcaccaccaaggacgaggagatcggccactacaagaagggcaccggcgcggtggacatgaacttcctcatcgtccacaaggacgccgtggtgctgcgctggaatttcgcgcacggcaaggtcatcgacgccgaggacaaccagcagggcttcggccacctgttcaagtaccgcaagtacggcgtgtgcggcgtccgcgagaacctggcgcactacatcaccgcaggcatgaaggccgcataggaaggaggcgcgacatgcgcacagttggactggccttcgagaaggaggccccgaagaaggccaagcccgccaagggcaaggcggaaaagcccgaggcgaaggccgcagacgagcagcccgccaagggcaaggcggaaaagcccgaggcggccgaggacgatggaaactagagccccgacccacgaggactacctggcagccgggcgcggggagctgtccgccgaggagttcaaggcggcgctcccccacgccacggcagccgtgcgcgacctgatcttccccaacgagccggacggctccgaggagtgggcgcgcgcggtcatggcggcctgcgaggtcgacgccgcatacggatgctcgggcggcatcatggagggcggcggcttcaccgtcggctcgttctcgtggaaccccggtaccgaaggggccagcacctaccgcagcgacatggaggccgccgtccgccgcgagctgcttggaacgccgctgctctacgcgggcatcgggggtaccagatgatgcgggtgccgcgctcggcgcggccctccaccatgtccgtcaaggtgcccagggagggcggctacggcggcgagttcgagcagcccgtcgaggtgcgccgcgtgcgcttcgagcccgtctcggcgtggctcgtgcgcgaatacgccctgggcgacggcgcgcagggcctcgtgatagcagacggcgcggacagccccggcatgttcgacgtgcccgtgggcagccgcgtgagcatcgacgggggcgagtggatgaacgtggcgaggtgcacgccccgccgcgcgttcggcacccgtccccaccactgggaactggaggtgaggtagccatgcccgcagcagttacggtcgacctgaccaagctcatgaagcgtttcagcgcgaaggagctggaggccaagcaggtgaagttcgccatgagcgtggccgaggacatgaacgcgttcacgccagaggacaccaagcgcatgcacaactccatgcaggccgcctccgacttcaggcagggcctcgtcatatgggacgccgactacgccgcctacgtgcgcgacctgcccgacagctccatcaagcacggcaagaacccgagggccaaggccgactggccgaaggccgcgaaggaagcgcacggcgaggactgggagcgcctggccgtcgacctcctgaccgagggggcgtgacatggccccggacgtgatggaggcggcgaaggccgccatagaggccctgggctacggcccggtgctcctcacccgcctggcagcatcgcgcggccacgacgacgcggtggtgctgaggcccatgcccacggccgacgcggtgcgccacatggacggcacccgccgtgtcggatacgtgctgcaggtcatcgtgaaggacacctccgaggccaaggccatgggcgacgcctacgacctggccgacgcgttggacggggccgacctgtcctcgcccaccggctcctacggcttcaccagcgcggcgctgtacacagagccgcaggagataacgccgccggagggcgggccgtacctgtgggagttccgaatcaaagcgaccataaccatagagaagggataacgatggcaaagaaccaagacctgggcttcgcgcccaactatatgagcgcgctggagatcgacaccacgccagacgcggccagccccacgtgggccatcttctcgcgcggcatcaccgaggtgaagccgaccaccaacgagaccaccgagaccaaggactactacgacggctacggcactcccaccgacaaggtgaagagcgtgcagccgcagtacgaggtcacaggcgaccgctgctacggcgaccccgcgcaggacttcgttgccagcctggcgcttgagaccggcgagggccgcacgggccacttccgccacaccgaccccaacggcgacgtggtggagggcgactgcacctacctgggcttgaccgtcggctcgcagcagggcgcggcgtccgaccccggcgcgttctcctgcacaatctcgggcgctggcgctatgcgctacatccccgccaacaagctcaagcagcccacgggcgtcacctgcaccgcgccgaccggcccggccgtgggcaagtccatgaagctcgcgccgaccgtcacgcccgccgaggcgaacgccaagtgcttcttcgcatcgggcaacaccgacgtggccaccgtcgacagcgacggcaacgtgacgggcgtggccgcaggcgaggcggtcatcaccgtgcgctgcgcgtccaagccgagcatctgcacgcaggtgaaggtcaccgtggcggcgaagtagccgcaggcgacaccagacataacctcctggacatgggggcgcgggctagtgagcggcccgcgccccttttctatgcccgacgctcaccgctcacgaaaggggcaacaaatggagcttctgaaaaacatccgcgcgtacgaggacgtgttcttcgaggaccccgaggagaaccccgacacgccgcgcttccgcgtgtggttcgacgacaagcacatcgaggagtacctggccaaggtcggcaacgccatcgaccgcgcgcaggccaacgagcagatggcccgcgaggccgacacccccgagaaggcggccgaggccaacgccgcgcaggcccgcctcatgaagcgcaccatctcggcgttcatcggcaccgagggctgggagcagctgctcgcgtggatgggcggcgacgagggccccatcgcgcccgaggagaacatccgcatcctgggcgaggtcttcgccacgttcctcaacatgttggcgcgccacgcgaccagcgagcagctgatggcgtgcggccttgcatacagcgagcgcgccgatcaggtccaggcgctcaaccgcgcccagcgccgcgccaaggccaagcgcaagaagaagggcggcaagtaatgctgccagccgcgctcacggccgagcgggtgcggctgcccgacggcacgagcgccacgcgctacccgtggaacggcgaggaggtgctggtgcgcgacgacgcgctcacgatcatccgcgtcatcgaggtgctgaccgacgagggcaagtccgacgaccagcgccgggacgagttcctggcgctgttcttcgtggactgggcggacgcgtggtgcgcatgcgactacgacgccgccgagttcgtgcggatgcgcgacgcggcggtatgggacatgtgcggactcgacctgaccggcgaccgcccgcacgagaccccgctgtgggacttggaggaggacgcggcgcgcatacgcaccagcttccgccaggcctacggcatcgagtgggacgaggtgcgcggtcgcatcagctttgccgagttcgtggcactcgtgggcggctgcccgcaggacacgccgctcggcgcggccatccactaccgcaacccggcgaccaagccgaagccaaccaaatacaacaggcaggaggtcgaggcctggaacgccgcccacaaggcgttcgaactcggcaaaggccgcagctcacacggctctgaggaaggaagcgacgcggcgatgcgcgatgtgttcgccgcgctcaagagagcgacgaggtgagcatggacggcaacgtcatcatcaaagcggtgctcgacaccgttgacgtatccaagaacatcaaggccctggagcgcgacctccagggcatctcctggaagaacataaccgagggcgacgagaaggccgcgaagctgtcgtcctcgttcaagaaggccggcacggccgccacggtgacgctgaccgcgcccgtggtggccgccggcaaggccgtattcggcgtggccagcgactacgagcaggccaacgcccgcatagccgccgcgttcggcgtgtccggcgaggaggccgagcgtttcagcggcataggcaagcgcatatacgagggtggctggggccagtccctggacgaggtcaacgatgcgctgatccagtgcaagtccacccttcgcgacgtgtccgacgaggacctgcagaccgtcaccaccaacgcactcatgctgtcggacaccttcggcgcagacgtgaacgagtccatacgcggcaccaacgccctcatggagggcttcgggctgtccgccaccgaggccagcgacctgctgacggcgggcatgcagcgcggcctgaactacaccgacgagctgggcgacaacctgagcgaatactccgtgcgatggggcgaggcgggaatgagcgccagcgagtacttctcgctgctcgaagcgggcacgtccaacggcgcgtacaacctggacaaggtgggcgactacctcaacgagttcctgacggcgctgtccgacggccgcatggaggaatccatcggctcgttcagcgagggcacgcaggaggtcttcgagaacttcaagaacggcagcgccaccgccaaggacatgctgcaggcggtgctgggcgacctcacgcagatgccaaacgagtacgacaaggccgcgctggcctccaccctgtggtcctcgctgggcgaggacaatgccatgggcatgatcgagtccctggcgggcgtgcaggacagcttcggcgacgtggcgggcgctgcgcagcaggcccaggaggccgcctccgacagcttcgccgtgaaatcgcaggaggccatgcgcgagctgcagggctccatcgagccgcttggcgagccattgctcaacatcgccaccaacgtggcgggtgtcgtcaagtcgttctccgagtggttcgccggcatcggcgagggcggccagaccgccgtgctggcgatcgccacgatagcggccgccataggccccgtgctgtcgacggtcggcaccgtcgtggacaccgtgccgaaaatcggagcggccttccaggtggtcggcaagctgggcaccggcgcgctggggctcatagccgcgcatcccgtggtagcggccatagcggccatcatcgccgccgtggtgctgctgtggaacaactgcgaggagttccgcgacgcggtgaccgccgtgtgggatgccgtgtgcgccgcgttcgaggtggccacccaggtggcgggcgacgtggcccaaagcgtcggcgagttattctcgcagctcggcgagacgctgggcggcgtgtgggacggcatctgctccacggtgcagggggccatcgacgccatagccgggttcttccaaggcctggccggcaccgcctcgtccatctgggacggcatctgcaacgtggtgcaggtcgccgtgatgctgctgggcgagattctgaacctggccatcgagacgctgctcataccctggaacttcatctgggagaacttcggcgagcagctgacggcggcatgggacgcaatctgcagcgcggtgggaagctacatcgacgcggtgagccaggtcatcaccgacgcggtgacggcgctctccgaatggtggggcgcgacgtgggaaggcatcagcggcaccgccagcgccatatgggaggccatctacggcgcggtgagcgcatacatccagtacgttagcgacgtgataggcgcagcccttttggtcatccagggcgtgtgggacacggtgtggggcgcggtgagctccaccgcctccagcatatgggatgccatcagctcggcgataggcgcggccatcaatgccatcagctccaccatatcggcggtgctgtcggcaattcaggcggtgtgggactccatatggggtgccgtgagcagcacggcgtcgagcgtgtggggcggcatcagctccaccatatccagcatcgtgaacggcatccgcgacacgatctccagcgtgttcaacgccgccaaggacaccgtgagcagcgtgtggaactccatcaagagcgccatcgagacgccgatacagaacgcccgcgacaccgtgcgcaacgtcatcgactccatcaaggggttcttcaacttctcgtggtcgctgccccacctgaagctgccgcacctgtccatctccggcagcttcagcatcgccccgccgagcgtgccgcacttcggcgtcgactggtacgccaagggcgccgtgttcaacggccccagcgtcatcggcgtcggcgaggcgggccccgagggcgtggtgccgttcaacgagcgcggcgcgcgcccgctggccgagggcatcgccaagctgctcgacggcaagggcggcgcggcccatggcgacacgaacgtgacaatcaacctgtacgcgaccgtgcgggaggaggccgacatcgagaaaatctcccgccagatagccaaggaaatcaaacggcaggagtgcttcgcatgatatacaacggcttcgacttcgcgccgtggttcgacacccggctcgtgacccgctcgctgctgcccgagtacgaaatcgccacgcgcgacgtgcccgggcagcccggctcgcgcttcatgcgcgcagagctgaaacccctgacgatagacgtggcggcggcgtggagggcgcgccccgccgacgacatggcggcccttcgccgcctcatggcctcgcgcctgctgtgcctcaaggaggccgagctgtggctggacgacgagaggcacctgggcctgcgctacatggccgtgctgacctcgccgggcgcgctcgacacgttgtggcacaccggcgaggccacgctgacgttcacggcatacgaccccgtggcctacggggccgaggggcgcgcaaccgtgtcgggcacctcgggcgtgcaggtgggcgggacgttccgcacctaccccaccgtgaccgtcaggcccggcggcagcacgtcggcgctgcggctgacgaacatgggcacgggcgagttcgtgcagatcgacaaggcggtgacggcatcgagcgcggtggtcatcgacatggccgccccgcaggccacggtggacggcagccccgcgcccgtgaccttcgagagtgacttcttcccgctggagccgggggccaacagcctcaagctgtccagcggcaccgcgacggtacagtggacggaaaggtacgtgggctgatgattctgtgggtatgcgaccgctgggaggcgtacaagggacccatcaagacgctgttcgagtgcgaggacacgcgcgaggtcaacggcgagaacgccctgagcatcacaacgctggcgcgcctggacaagggcgaccgcctggtgtggcgcgacctcaagggccgctggcacgagaacatcgtggacggcgtggaagaggagcgcgcaagcgcgggcatcctctacacgtactactgcccgacctcggcgcaaatcgagctcctgggcgactacctggaggacaagcgcccctacgacgtgagcgcctacgccgcgctggcctcggcgctgtcctcctcgcgctggcaggtcggaaccgtggccgacctcgggcaggccggcacgaacttctaccacaccaacgcatgggcggccatccacgacgtggcagacacttggggcggcgagctgtcgttcgaaatccaggtgagcggcaccaaggtgaccgcacgccgcgtgtgcatggccaagcaggtcggcgaggacaacggcaagcgtttcacctacgccaaggacctcgtgagcgtcaagcgcagcgtggacgagggcaacgtgtgcaccgccctgtacggctacggcaagtccctgcagaccgccgacgaggacggcaacctgacgggcggctacgaccgcaagctgaccttcggcgacgtgaacggcgggcagaactgggtggggtcggccgacgcgctggcgcgctggggacggcccgacggcaagggcggcaaggcgcacgtgttcggcgacgtggagttctccgactgcgaggacaccgccgagctgaagaagctcaccgaggcgcagctggcgcagtcgtgcgtgcccaccgtgtcctacaccgtggacgccgtggcgcttgcgcgcgccggcgagggcttcgagggcgcggacgagggcgacctggtgaccgtggtggacaaggtgtacgacccgccgctgcgcgtgcgcacccgcatcaccaaggtggtggaggatcagctgcgccccggcgaggtcacctacacgttcggcaactaccagacggtcgccgagctgatggccgcgcagaagtcggccaccaagtccaccgcctcgaccatccgggcgaccgtgaccgaggccgtgaacgcctcgaacaaggcatcgaccggcaaatggggcgagagcctggcggccgccgaggagcgccagaaggcgtacgccaaggaggtcggcggcgccgcccaggactacaccgaccagataagggacgagctggacaaggccctcaaggagtacgccgacaacggggacaccacgctggaggaggcactgaagaagtactccgacgacggcaacctggacctggacgaggtgctgcgcctgtacaccgacacgtcgatagagcaaagcgagagcgtgctcaagcagatagacgaggccaacaaggagtacctggaaggcgtcacgggcaagctggacgaacggctgacgagcgccgagggcgaggtggatgggctgcagaaacagctcgaccagctgccgacggatatccgcaagaagatcgttggcatgctcaacagcgaggtgaacaccacgggcggctgggtgtacgaggagcccggccaaggcatcctggtgtacgacaaaaagcccgagagcgccaccaagtgcgtcaagataggcggcggaatcatcggcgtggccaactccaagtactccagcggcgcgtggaagtggcgcacggccataaccggcgacggcgtgaccgccgacgagctgaccacgggccgcatcaaaggcgggaactcgtactgggacctcgacagcggggccttctacctgcgcgacggctccatcttcatgaccgacagcaacggcaacagggtctatatcaacgccaccaacggcttccagatatacgacaagaacggctccatcatcgcgggcaccgtgctggtgggcagcacctccatgttccgctgcaacatggtcggcacgtcgtcaaccaactacatcaccaccggcacgacgacgaacaaccacccgggagcgtcgttcgtgaacggctcgaccgagtactgcaccatcgaggccgtccacgcgaaggacagccccacggcgagctcgaccgacggcgtgggcatatccacctgcggctacggcttcctggcagtcaaccgctactaccgccagacgtggctgacgaccccctactacgcgggctacatgagccatcccgacgagcagctgtacatgaagagcggcaacagcaacgcgggcggctcggcgtacgtgaagctgcaggagaactccaacaactacgtgtacctggatagcagccgcgcagacattgggtcgtcgggcaccgccaggatactcgccccgaagttcgccataggaaccagtccgagcagcggcggcacctacgggtacacgggctccacgcagttcatcgggtgcatcaccaacaacggcaacaactggacgtggggcaccatcaacgtggtgaacggaatcatcaccggcatgagcagcatcacgggaaactagaccagcgagagaggaaacggaatgttctaccaccttgtgcagcagcccgaagcgccgcaggcgctcgacggcgcgccgaagccgcccgaggcgcttccggtgttcgagtgcatcagcgacccggccacggcgcgggccatcgtggaatcggaagacgtgttcgagttcgacggcaagggcggcttcacgctcgtgtccagccccgtggccgtcatggacgcggaaggcggcgaggccaacgccgtggacttctcggcgctcaccgacgaggagatatgcggggtccacagagcgcagcccggcgacatatcgcggacacttgcggccgaaggaaaggaatgaggcatggcaacgcacgagcttacgctcaacctcaagaagaccaacatagcgccgcccgtcatcaccgtgcaccagggcgacagcgccgaggtcctgaaggccgccatctacgacggcgacaagaaggcggccctgacgggctgcaaggtgcacctcatggctgcgaagcccgaccacacctacgtggagcagcagttcacgggcatcagcgacaacgtggccaccgtgaccgtcaaccccgccgtcttcggcgtggccgggctgctcaaggtgtgctacgtgcgcgtgcggaacgcggcagggctggacgccaccaccgagaacgtcctggtgaacgtgctgccctcggcgagcgcgtcgggcgagatatccggcccgtacgtcgatgcggtggaggcgatcatcgcgaacctcgaagggcagctagccgacgtgagcgcgctgaacgcgcagatgcagaaggccgaggcctcccgcgcgagcgcggaaaaccagcgcgccacgaacgagaaggcacgccagaccgccgaaaccaggcgcgcagaggccgagaagaagcgagccacggcggaaagcgaccgcgtgaccgaggcgtcgcagctgaagacggcctcgcaagccgccacggctgcggcaaacggcgcggcctcgaacgccggcgcggcggcaaacatcgccctgcagatagccaacagcgtggcgcagggcagcgcgggcagctcggacatggccaagcagaagcagcagatagccgacctgtacggcaagctggccgacgccacggacgcgttcatctacgacgacggcaccgtgtactgccccgcctccaaggccagtgcatctggcagcaccatcacgttcgggagcacctgcacggcgtccggcacaaccctcaacctcaagtagaaaggcaacgaaatggcacaagcgaaaaccctgtcagtgggcggcatcggctacgaggtcatcgacgataccgcgcgcagcaacgcgcagacggcgctcaacaacgccgagtacaaccgccagggccaaatcggcaagtacggcgggcagaacatcgccaccatcctggcgggagagatcggcagcggcagcgtgtacgacgcgctgcataagcgcatcgccgccgcgaacttcgcaggcctgcgcgtgggcgactacctggacgtgccgcttgtgagcgcatccgccgtcaccacacagcaatctgtgcggttcctgcttgcccacatcgacccgtacctttactgcggcgacaacagcaagggacaccatatcgcgttcgtggcctccgcgcccatcgccgtggccaagaccgtgaccggcgttgccaacgacagcttcctgatgtggaacacgaccaacacgaaccagggcaccgccgaccagaaatgcccctaccccaacagcaacctcaaggcgtgggagacggccttcgaggcgtgcctgcccgaggggctgaccaagtacctgcttacccagcgcgtgctgcttgaggagcggtacagcgccagcggcgcgctcaacgactccaactcgtggagctggcaggatatcggcaaggtgttctcgctgtcggagatggaggtgtacggctgccccgtgtgggggacgccaggctggtcggtcggcttcgactgccagtttgacctgttccgagacacggcgcaccgagtcaacggaagtcgggacggttggtggctgcgttccgttgcgtcgggctccgcgtccagcgtgtgctatgtcagcgacaacggctatgccacctgccactcggcggcgtacgtctgggttcgcccccgccccggcttcctcgtcggctagccagccgagtgctctatactctgcttttaggcgaccgccttgcgcggtcgcctcctgcccgcgaagcgggccgtttttttcgccagtttccccaggaggtgcacgtgagcggcgtctaccagcgcaaccgcgaggtgtccgagtacaagttcttcacgcaggccatcgccatccgcgtggaggtcaacaagctgatggcgtcctcctccgtggttccgaaggcctaccgtctgctgaacgcggtgccgaccgtggagacggcacgcagcatcgtgtacaacgtcaaccgcgccgactgcttctatcccaacagctcgttcaacgcgctggagaggaaacgctacctgacgctggccatagcggactgcgagcagcttatgctggacatgcagtgcctcatggatatcggcctgcccgtgaacgccaaccgcttcgaggggctggcggccatggtcgaggaggagatcaggctgctgaagggcgcgcgcaagaacgtgcgcgtcaccggcaagaagtccaccgaggagcgcatagccgaggccgaggccgagctagagcgcctgcgttcgctataatgggcggcggtcgcgccttgtttatcggtacaattggtggctgcgttccgttgcgtcgggctccgcgtccaacgtgtgctatgtcaacaacaacggcaatgccaactacaactcggcgacgaacgtctgggttcgcccccgccccggattcccttattgccagaccgagtaggccccagggccgaaagcagagcgcgaagaggaaggaaggcgcgaccgtcgggcatgcgcccgtaaatacgcaccccgcgagggtggccggacgctgcttgcatggcgcggcgctccgtggcttcgccgcgtttcatggccatacctcaagcggctgccagagccacattgcaagccgcgcggggtgcctcctgtgaactccgagcaaaggcgggcggcgcgccgcaagcgccgcgaggagaagcgcgcgcaggccaaggccgagcgcgtcaaggcgtgcacccttgagacggtggccgacctcaacagcctgtgcaaggcatcgaagcaggccgcgcggggcgtgatgtggaagtcgtccacgcagcggtacatgagaagctacctgcgcaacgccgtcctgtcccgccgcgaccttttggaggggcgcgacatatgccggggcttcatacggttcgacctgtgggagcgcggcaagctgcgccatatcagcgccgtgcacttccccgagcgcgtggtgcagaagtccctggcacaaaacgcgctcgttcccgccatagcccccaccctcatagccgccaactccgcgaacataaaggggcgcggcaccgactacgccctgaaactgctcaagcgccacctggccgacaactggaggaggcacggtggcgatggctacatactgcttggcgacttttccgactacttcgcccgcatagcgcacggccccgtcaaggagcaggttgccgccgcgctgctcgacccgcgcgtgatcgcccttgagcaccgcctgattgacgcgcagggcgaggtgggcctggggctgggcagcgagccgaaccagatatgcgcggtggcacaccccaaccgcatcgaccactacgtgaccgagatgctgcgccccgaggcgtacgggcggtacatggacgacttctacctcatacacgagagcaaggagtacctgcaggtgtgcctgctgctgatagggcgcaagtgcgccgagctgggcatagagctgaacccgcgcaagacccgcgtggtgaagctgtcgcgcggcttcacgtggctgaagaagcgcatcttctacacggagacgggccgcatagtcgtgaagccgtgccgagactccataacgcgggagcgccgcaagctcaagaagatggcccgcatggtcgccgatggcatcatgacccccgagcaggtggagcagagctaccagagctggcgcggaggcatgaagcggctggacgcgcaccgcagcgtgcgggccatggacgcgctgtaccgcagcctgttcggaaatcccgcggggggggttgctcaatgcaatccaaacctggaggcgacacggatgggaacatgcccctaccctagcaacagaaggagcgacccatgacggaacaggaaatcgccggggagatcaacggctacaaacagcagcttgagcagagcgactacaaggtcatgaaggcggtggagcgcatcttctccgcatcgtccatcaccgacctgctctcggccatcgccgcagctgccaaggaggtggccgagatcatctcgcagcgccagacgtggcgcgaccgcatcaacgagctggaagccatggagcccgaccagccggaagcgccgcaggagtagcgagcgccccttcgggggcgcttttcttttgcccggcgacacctcgcggacaatcgcggcagcgattcgaggaggtgagaaaacgaatgaccgacgtgctggaaatcttcgcgccgtacggccccgggtcgcttttcggcgcgctgctcgtcctagtggtcctgtacttcggcaagcagttcctcgaagagttcaaggcccagaacgagcgcaaggcgaacatcgacctcaagcgcgaagagcgaaagcaggacgaggtgaacgagcgggcgcagcgcgaccgcgagcgcagccagatggagggccgcatcgccgcgcagatggagcgcagcaacgcgctgatggaggctatgaaggcgctcatggagtccgtcgtgacctccaacgaggtgctgcacgccgacctggcgaacagccaggcgcgcagccagggcatggcggcgaaggtcgaccacatcgccgaccgcgttgacctgctctacaaggaatcggctcgatagaaaggaatccgaaatgacagaaatgcaagcaatcgcagccatcgtgctgtctttcgccgtgccgttcgcggtgcagctgatcaagaccgaggccatgaccggcaaggccgcgcgcatcctggcgctgggctgctcgctcctggcgggcgtcgtgaccggcttcgtgggcggcgtgcccgcagacccgggcgcatgggtcacgtgcgccttcgccgtggtaggcggcgtgcaggcggcctacacgctgttcaagagcgtcggcatcacgtccaagtggctcgatgccctgctgggcgtgaccgtaggcgggaaggagtaggcaatggctaaactgttcatcatctgcggccacggcgctggcgaccccggctgctgcgcaggcggctgcaccgaggccgagcgcgttcgcgccctgggccagcgaatcaaggaactgggcggttccgaggtcgagctgggcgatacgtcccgcaactggtacgccgacggcgggcttaaccgcctgagcaccgacgcgccagtggtggagctgcacatggacgccagcggcatcgccacggcccacggcgcgcacgtcatcatcaaggagggctttgagcctgacgagtacgacaatgcgctggccgacaagctggcggcgttcatgcccgggcgctccgagaagctggtgcgccgttccgacctcgcgaacccgaaccgagccgccgcgcgcggcatcaactaccgcctgtgcgagaacggcttcatcgacaacgacggcgaccgcgagaagttcaacggcaacctggacgagctggcgcgcatctacctggaatgcttcggcatcactgctggaagcgccccagcagccgtcccgcagccgcagcctgcgcagcaggaaacgaccgagaacttcggcggcacctaccgctgcactgtggactacctgcgcgtgcgcgacgcccccggcctgggcggcaccgaggtggcgcactattccagcggcgagaccgtgacgctggataactggtacaagatcgccgacggctacgtgtggggccgatacacgggctacagcggcgcaacgcgctacatcgccgtaggcaaggccacgggcaagccagaggccgacgactatctggtgaaggtgggataggccatgccgtacccgagccccgcagacgaggagcgcaacggcgggtgcggccccatcctcgcggcggtcgtcctgctgttcatcgtcctggccgccgccagctgcgcgtcgcaggccatgggagcgcaagacgtgaccgtgaggcaagcccgcacggacggccccatatacgacctgcccgagggcatcggccaggaaatcgtgtgcgacgagcacaaccgcgagtacctgctgcttaccaccgagcagggcggcgtgttcctcatgccgtacatggacgaggacggcgagcaggagatcatgccgcaggcctagaacgcaaagaagccgccccgtatggagcggcttctttctatctgacgagcaatacgaacgcccgcctaacgacgaacacgcgtatgtgttcgcctactgaacagttggtggagcttatgagaaaaacggcgaactccaccaataccgccacccgcgcggctatccaactcgatacttgcattgtaagggtatcgaaaaactggtttgttgtcgttggaacgtgccagaaatagccatttctggtgtttgcaaaacaccagatgggcggcttgctgtaagcccgtataacggcataaagcggggcaccccttgtcagggtaccccgcttgaacactaataagaaagcttctggccggggtagatcgtataaggtgccccaatgccgttcttgcttgcgatggtgtgccagtcgatgccgagcgaagcgccaatctcgctgagcgtgtcgccgctcttgacggtgtagacgcgcgcagagccaacgcccgccctctggttgacgattgcctgaacctctttgaagcggtcgcccagaacgtcgctgcgcgtcggcacaacgccgaacattccgcgctccacatcgtctgcgagctgagaagcggaagcgccgtcaatgtagttgatgaggtcttgcacctcttggtaacggtcgccgagcttttcgcggcgctcatcatcaacgccatactcgccgcgcatgaccgccgctgcaaggtcaagcgtcgtgccctccggcgaaggctcggcgacctctgcgggcggaacgtcgggagctgccgcgccggacgggttggcgaacttgccccacgcttcgcgcgtcatataggcgatatcgagatcaagcggcgcgttgaagccatcgagacggccattcgaagtgtattggtggattgcgcagctaccccaagcgccgaagccgccatcgggaagccacggcgaagattggtagccggtgcggttgttgttggcgtactgcgcaacccatagcgcgtgattcggtgcaatcttcgaccaatcttcttcggtgcaaacgctacggctcatgtagacgatgcagcgaacgccggtctgatcgtagacgtaatcgaggaactgctttgccttgtcggttccgatgcgcccgtacatctcataatcgagaacgggaataccgttgccgaagtagttacggcagcttgcgacgaaatgcttagcctgagcgatggggtcttctccgttcatgaagtgatagaagccccagagcttgccgagcttgatagcctgctgaatccacgggtcgcaggtgttgtgaacgatagtggttccctcggtcgccttgcagataacgaaatcgcaaggcacctgcgcgaggtcaagcccgcgctggtagttggaaatgtcaatgccgttgagtgccatagaagccccctctgatgcagtagaagtaatgaaaatcgaccttctctagctcttcgagcgtgaaggcgcgcgccgagttcccggcgctcgccgggtcgcgtatccagtagccgtcatcgtcggcgcgccagatcagcacgacgtgcccgccgtagtccctatcgcctagcgttccgctcatgccagcgaaggcaagccatccgtcagacacgttctgaaggacgggcgcgagatcgtaagaaatcggcgtgctctcaatgccgtattccgggtaatgctcggcaatccacgcgcagaacttgccggggtcgttcacgccatcggtaaggcaggcgtcgcccacgaacgatgcgagcgtgagcggcgtaatgtcctgaagcgtcatgtatttgatagccatagcggcgcacgtaaggccgcagccgtagtcgccgatggtgccgcccgcatagggtatgtagtcccattgcgggtctgtctgaagccatagcggcatgctgttaccctcggcaatcggcctatcgacaacgattgctaggcggtcttcctcagccgccgcgtatccctcttcgcgcgcttcagcgagcgcgcccgcgtcgctctcgatatggccgacgatgagccagccgcagaagagcattgacgcgagcgcgccggaaagcacgagggcgacagcctttagcctactcatcgcgcttcggctcggtgtatgtgagcgcttgcgcggaatcgcccacgccagccgtggtcgggtcagtcacgatgcccagaatcgcgagcacggcgaaaagcgcgttgatgatcgctgccaactgctcgttcagaacgccgaagtcccactgatagccgaacggcgcggcgacaacctgcacgagcagcagaacagcgggaatgagggtcagccaaaacgtcttgttcttaattcgtgcggtgaagttaatcatttcagttctccttttcatagatgaggtctacgcggtcgtagatgtgatcgactttgtttgccatgtcgtgcgagtgctcgcgcgattccctgatttcgtcgtgcagcgcttcagtggaagccctgagagattccatagcggcttgcagcccttccgaaatgttgttgcttcgctccatctgcgcagcgatacggccttccatctccgagcgctcgcggtcgcgctgcgcgcgctcgttgagttcgtcgcgcttgcgctcttcgcgcttcagctctagctctgactgtcgcgccgcgtttcgctcttcaagctccgccttgcgctcgttgttgcgctggtactcgttaagcagctgctttgcgaggattccgaagccgatagcgataaggaacgcgaagaaccattcggcaccgaacgccgctgcatggtctaaaacgctctccgccacgtcagccctccgtcacctctcgccagacggtttcggtgccgacagcccccggctcccatacgttgttggcaacgagggattcccagaccttgccgttgtgcttcacgcgggcaccgagcgggtagggattcgtagaatcgggctgcacccattcgggcacttcctctgtcggcgtgtcgggcgttccggcttcaagcaccttcgcccaaaggctcggcgctgccgtgggcgaccaatcgggctgcgaagtgtgagcctgaaggcacgtgtaaagcacgccctcgaagcgcacgcgctcgccctcggcgtaggcgtggccgtctccgtcccactctgcgaaaagcgcagggcacttcgccgccacgtcgctagagagcgacggcgcttgaccgtcgaaaatggcgatgatcgcgcgaagcttgccctcttcctcttcggtgaatgtcatgtgttcccctttctctcgcaacaaaaaagcccccgctaatgcgagggcttcgataccttgccatgtcggcttcctcagccgaaaagctccttgtatagcgcgtccatgcgctttaccgtctcgtgcgcgctaaggcgcttcatgctgccgcgccacgactggtaggattggttgacctgctcgacggtcataatccccttggcgaccagcgcggcttgcttcttcagcttgcgccgctgccgcgtcacggaggaacggcacgggcgaacgacaacctttccgccctcgccatatgaaaacctcttcttcaggaacacgaagccgcgcgtcagcttcacaacgcgcgtcttcttgcggttgatgatgattcccagatcgtcgcagagcgcttcgatgcgcgaaagagcgtcccaaagcgtctgcttgtcaagagctatgcaatagctatcgtccatgtatcgcccgctcgccaagatgcccggaagggacagcatcagatggtcaacgggcgaaggcagggcgacggctagaatctggttcggctcgctgccaagacccaagccgcgcgcgccgtgagcgtctatctggtcgctcatgacgcgcttaacgcgctcatcgtcaatggcgcggtcgataaggcgcttgcatgcgtcgtggtcgatgtttgcgaagtagtccgcgaaatcgacctgcaagatgtagccttccgttccgtgctttcggtggtgctcgacaagctggcgcttcatgcgccgaatcgcgtagtcggtgccgcgccccttgacgttcgcggtgcatccctcggcgagggtaggccagatcgcgggtgctagggcgtgacggctcaacgatttctgtatgacgcgctctgagaagtggacagagcagatgtgacgaagcttgccgcgctcgaacaagtcaaactctatgaagccgcgccggaagtctgcgcccatgagaaggtcgcgccgcgctctcatgatgttaggaatgacgcgcgccatgtagcgctgcacgctcgatttccagcgcacgccagcggcagcgccgttggcggcatcgtataggttatcgagatcggcgacggcttctagcgtgcatccctcgatgcgcttagccctgttttccgcgcgcttggcatcgcgccttgctcggcgcgcagccctgcgctcttcagagttcatgagggcaccccgcacggctcgcaatcggcatccagcagccgcttgacggttgaccatgaaacgcggtcgaacaccgagaaccgcgccatgcaagcagcgaacggcaaccgtcgcggggtgcatatttacgggcttgcgcccgatggtcgccccttccttcctcaaatgcacggcgcgcggcgcttccggccgcacggtctggcaatgcttgggaatcacggcagcgggcgcacccagtcgttcgtcggggcattgttgttggcattgccgttgctgttgacattgcacgcgctagacgaagacccgcccatgaccgaccgcagccaccaattgacgcgatgatttccaagggacaacgcgcgaacattctacccctttccaatgagcttcacgcccgcgcgagcgccctttatgagctttatatcgttctcgatgctctctgagatctcttcgaacttagccaccttgacgggtagcttcatcgccagaaggcattgcaggtcttggtaaagctggtttaggtctgccaaggcaagcgtcatgtaatgcttgcgttcctcgacgttccgctgtgtgttcgggtagaaggcatcagccttcacgaggttgaacaccacgcttcgcgccgtctccgccatggggacggcgaagatgaagcgataggatttgggcaccgcgcccgaagtgacaagccgcgtcacttcgtttcgaatcgaaaccgcagtgttgaaatactcgaacgtgcttaggttgcggttccgcacatatacgccgctcaatttgcaacatccccccctccgtgattttcaaaaaaatacttcgcccgcgcttcgcgcggggaagtataggcgcatgcgcaaggcatgcgccagacctgtactatgtacggctgattttatcagcctaggaggaagcacggcagcgggcgcacccagtcgtacgtcggggcatagccgtaggcatagccgtagccgccgacatagcacgcgccagacgaagacccgcccatgaccgaccgcagccaccaagtgacgcgaccgcccacgatgcggcttgcggtgtccgtgaagatggggaactgcgaatcgaagccgacagagtagcccttgctgccccataccgggcacccgtaaacctccatctctgagggcgaccaaatcttgcccaagtccgcccagctccaaccgctcgcttcagtgagcttgccggaagaagaatagcgctcttcgagaagcacgcgctgcgcgagaatggcgctctgaagcgtggacggcagagcgggcaagaaatcgttgatctcccaatcgtggagcttcgagcacaagtaagggtgcttctcttcggcggtgccgttgttgtcgttcgtctcgcgccactgaaggtagctcgtgttagaagccttgtcgcccgtcacggagactggcgctttcggcaccatgacgatatggtgccccttcgcggtgtcgtcgcactggtaatactggtcgatagcgccgatgcggtaacgcaccgtctgcgcgggcacgttagcgccctcggaaacgggaacgtcgatgtagtcgccgatacgaagaccggcgaagttggcgtttcgcgcgcggttgcgaagccacgtgtaaatgtcggtgtcgccgatctcgttagcgaagaccgaagcgagcgagcgccccgcgtaagcgttgatgttgtgctggcggtcgtattcctcggcggtcgtgacggcgtttgccgagttgcgcgccgaagtgtccttgatgttcttagccgagccgccgacgttgagaacggaaatgtcagccatgaaagaacctccttagttgagtgtcgcagtctctcccgaaacgctcgactgagaaagcgtgatgctctcgccagattgagccgtgaccctgcttgaaggcacgtagagcgtttcgccgaggtataggtaatcgtcctgaagctcagtaaccgcatgcgcaagcgtcgcattctcttcgcgcagctcttgcacctcgtcatctgacggcggttcgatagccgcgatagagtttgcgatgttaaacgcgttctgcgcggcggcggtggcatcctctgccgcgccgtttgcagtctcagcagcggcgttcgcgctcgcggcagcggtgttcgccgcgctcgcggcggcgttggcgcttgcggtcgcagcgtcggcgttctgcttcgccgtgttggcggcagacgcggcgttgttcgcagccgtggtcgcagcgtccgcgttctgcttcgccgtgtttgcggcagatgcggcggtgttggcggcatctgccgcgttgttcgcgttcgtcgcggcgctgttggctgtgctcgccgcagtgtttgccttgccagcggcggtattcgccgcgctcgccgcgctgtttgcgttctttaccgccgtctctccacggtcgatgaggtcttgcacggcatcatcccagttctgcgcgggctgctgcccgtcaagagcgctgcgcaggatttcaattgcgaagcgctccgtcgaataggtcttgccgctcttcgtgatcgtgaaataggcttcgtcggtgtagccggacacgctgcaaagcttcgattcgtcaaccgtgatcgtggcggagtttccgctcaccgagcactggccgcgatagtagttccgcttgttaggcagaagcacgacaagccatgccgtagcgccggaaagcgagaactcagcgccgttgtcgtagataagagccttgatggtggttccgccatcgtcgccctgaccaaccttgatgcaggttcccgcgccctccttcgagatatcgagttcaagcgtccgtgtgttgctcatcactcgccgccttcctcgccggttccgtaagcgagcgcgcggagggcttcgagcgcttcggcgaagctcatagcagatcgcgccttgctagacacgggctgcacgtccgcgctcgcggcgacggctggcacgctcgcagccaaagcgtcgaacacatcgacaaccgccctcattcggtcatcgacgtacaagggctgaacgagcgtgaagggctgatcgtcgttgattggctccttcacgtcttccggctgcacgacggttcggtttccgtcttcatcaactgcaatgaaaatcattccgttgctcgcggcgcggttgataagctcttcgtcgtattcggtcaccatcgcttcgcagttgcctatcgggtcgtgcagcatgtgataaagggtcttgctcatcgttcctcctagtcgaagttgcataccgtgcagaagccgtctacaaagtcgatgcttcgcgttgcgttccaccatgtaatcgtgccgtcgccgtcatcctgaatcttgctgatgtaatgcaacgtgcaatctttcgtaatcgcatgcgttgtcgtggtgctctcactgctagatgcagcggcggaaataagcggcgtggtgattcgtatatgctggtttcccgtcaactgaagaccggtcgttagctgtccggtgctaacgtttcgcatgtgcgctgagaagtcgatagtcccgatctgcgttccgtcttcgtagcctttaatctcgccactggcaagacgaatgaggtttgaagcagaaccgcattcgaacgtaccgttagcgtcgatattgtttgccgtcatgtagtttgtcgtaagcgaaccggtgttgaggttccacgtgctgcgaccgtatctgtcgctgatgatgcccgtttcaatgtagttggcattgatgtagagcagaccaccgctaaggtagattccctgtgtctgcccgttgttggtcagcttgttgaatatgtcgcgttgcgtctgagcatcgacggctgagcttgccgcatcgtcggcgattttctgaacggtcttgccgccaacctcggtgcttgcggaaagcgagaactcgccgcttgtcaaatcccagcggtttttgcccttctcgtcggtcagaagaccggcacgcacgcgctcggctctcatggttcccgtgttgatcgcgtcggcgctcaccatagcgcctgtcaggaaggttcgccagtcccattgaccgtcagaagtgaggttcgcggcaagtcgcatgcccataccgttaatgttgacagcccacatgcccgaagtcgctttgaccggcaaacctgtttcagcgtcgatgggtacattgctccacatcgtgccaagctcgaatgtctcgaccttataggttccaacggcgttgaactgagcgtttagcgcggcctgaagctgctgaagccacgaaaccgacgtgcccgccgcagcgtcatagattgcgttttgctggctgttgctctttaacgcgttgctcacgctctgccacatgtcggccatgttgtcagtaagagtgccgaacgtaacggtcgcgtctccggtgagcaagtcgcgctcaatctgagacacgcggccatgaaggcgcacgccctcggcagaaaagcccttgtcgatgatcgcaacgtcatcgccaacgcccacgccctcccacgagcgcccgaaggcgtataggtcgataaccgaagcggtgtaggttactttcggctccttcacttgctccaagtagtctttcgtttcctgcaagagctgcgccgcatcctcgcactgctcgttgacgtatgacgcgacggcgggaagaatgccgccctcgccgtcagggtgcccccagacggctgttgcttcggcatcctccacgtagtctttgccgccgttgatatcgccgaaggtgagacggcgaccgtagccaccgctctcagtctcaacgcccttgccgtagccgtagacgcgcgtcttcgggttgtcgctcgcaaccgagcgcttgacggaaacgaggtctttagtccacgtgaaccgctttgcactgctctggtttccgcgcttcgcgcgcacgcccacgcggcggctaactatgcccgcgccgtcgtggacgatgagcgtttcaagctcgccgccccacgtctcgatgattccggccaatccctcgcgcacgctctcatggtagaaggtgcgcgaagcgctgccgccctgatcgcacgtgccgacctcccagcgcgtgtctgcgataatggacgtgagggctaccgacacgctgccagaaggccgcttatcgtccagccagtcatcccacgtctcgttaaccgagttgatgcagacggcttgcgtctctggcgcgccgtcatcgtcgtgtacgcggtcgatggtgtcaacgatgtgctcgtggcacacgccctgaaggtcaatccagactacgcggtcgcccttcacgaggtcttcggcgcacgtgatgttcagttcgtcggttccgtccagcgcgtcggtgtgcgtcgcagcgctcaccgtgagccgccccagattgtcgccccagcggttgaagcgggtgaagccgatacgtcttattaaagccatcgttccacccactcaagaatcgcggtgccgttggtgatgttcaggtggcatcgtccgttgatctcgaagtaatccgaatcaatcgtcaccggcgctgtctggttgttgaccgtcgcgtgctcggtcgccatgtcaagccgtatggtgctcgaagacgtgagcgccgtattgatagccacgaactcgccggtatcgacgttcgtaatccgccacgtgctgccagcagatggcttcgccgtgaccttcaggtaagcgggtcggttgccgccagcgtttacgtagatgttgccagccgaaacctccatgcggcgcttctgtccgtaatagtccgggtcgccgatgtgaaaagtcacggttgttgtcgggcattcgtccgtgatctcgtctaagtcggtgctgccgctcacgattgcgagcaagtagcgcgtcgggtcatcgggtaggtagagcggcgcgggttcgtcagtccagagagccgccgcgagcttgtgccgcatctccgcgacctcgcggcggtcttcagtcctaagccaaatctcaacgggcaggtcgtagccgccacggtaggcgctcttgaagacctcgccatgccgccccggcacgctctcgaacgtcgcgttgacggtcgccatgatggggcggcgcaccttgcagtaaaccagcttcgataggtcggtgccgttgaagatgattcggtcgtgctggttcctagtccgtctaagttgcaactggcacccccctttgcttcagcttgcttgcgatgccagcgccgatctgctggcctgtctcgtatgcgtccacgccgtcagcgaccgtggcgtaaaccgtcacggcgacgttaacgggctggctcggcgcgtcggcgaaccgagagaacgcgcggtttaccgacgtttcgatgaagccttgcaactgcttctcaggcgcgatgaactcgccgccagcttcgccaacgccgacgattgacggctcatcgaagtagccgccgcgcgcataccaactaatgctcacgctcggtagcgaaatcgggccaaactcgttccaactgacgttgaagtgcggaagcttcggcttcggaatgctgatcttgattccgccaaaggcgttcatgatcttctgcggaatgctagaaatcgcgttccacgcgctttcaatcgggttctcgatgaagcccctgatgctgtcgaaaacgccccgcaccttcgagccaaggccggggaatcccagcttgtcgccgattcggtctgcgatgctaaccgccgtgctctcggcagcgtcaagcttcgagccgatgttgtctttaatcgcgttgaaggcgtttgccgcttggctcttcgccgtctcccagtcgccgttcatcgcggcttgcagagcgccagccgcagagctgccaaccgtcttcgcggtgttcatgtcgttctgcaccgtggaagcgatttgcccgaaggccgaatcggtgttgccggttaggttgttccaccagttagacacggtatcgaccgcgccttgtgcgaggttcccgacgttggttttaaggtcgttccaagcgttcgaagcgccggttttgatgttctcccaagtgtcggaagcgccttgcttcagctgctcccacttctcgccaacgccggtgcagaaatcagaaacgccggtgctgacctgctcccagattccgccccagaactcaggcacgccagcgaagaaatcctgcacggcttgccacttctccgaaatccagccggtgaagtcagaccacatctgcttacccgtctcggtctgcgtgaagaaccacgtaaggccagcgacggcggctgacacggcggctacgccaaggccgataggatgcgcggcgataagaccggtaaagcccgtccaaccgctagagagcgtgccggtgagcatggttcccagaccgcccgccttggtgacgatgttagagaagccggttcctatcttgctcagaaagcccgtgtcgcccatgagcttcttagcgccgccccaaagctcgccagcggtcttgaaggcgcttcccacgccctctgcggcttccatcgtcttaccaatggcggttgtcacgccgccgaaggcgaccgcgccgagcgcgaggttattaacaagcgtctgctgctctggcgttaggttcttgtaccagcccgttacggattcgagcgcgggcgcgagagtgttaagaaggctcgtcccgatctcggttacggcggtcttgactggcattgccgcttcgccgagttcctgcatgctctggttcatctcgttctgcgcgtcgcgcgaagcgagaaggtctttgttcgtctcttggtactgccgtcccgcgtccgcgtaaagcccggtaagcgtctcggtgatgagctgcgaccgctcctgctcgcttccgcacgcggcaagagcagcgttaaaagcgtcttcttttgtctgaccctcggcgaccgcctgattgaaagcggcctgagccgaagagtgaccggacagcgcggcgctccactgctcggctgatgccgtagaccagttgagagcgtcggcaagaccgccagtgacggtgcccgtgtgcgccgtctcctgcgctgcttccgccaagttctgaagcggcagagcgtcgccgaatgtcgcgtaagcgccagcggcaatgtccgtccactgctgcaattcctgctcgttggttgtcaggcgcgctaggttctggctcgcttccgtggcagatgaagaatcgccaaggatgcggtagaagctcgcataggtcgaagatgcttgctcggcggtgccgccagcgctcacccatgccgtttcgagctgcccgctctgctgtatcgcttcctcttggctcgatgcaaggccggtaagcgcgccagccgcaccgatgatgccgccagacaatgccgttcccgcgcttgaaatcttagacccggcgtttgaaagcttgtcggcgttgtcctcgatggtctgaccaaccttgtaaagcgccgtgcgcgatgcgtccgcttcgcgcgccgtgtccgcaagctcgctgccgtagctgtcaagctggcgctcgcactgcatgatcgcgcgcttcaggctgtcgtactgccgctcctcctgagccgtgagctgcgcgccgctctgcttcttgctctccaactgcgcgagcgcttgcttgtaagcatcaagcttctgcttcgtctcgccgtaggcagagttgagcgcctttaccttctgctctagcagctcggtgtttccggggtcgaacttcagcgccttgttgatatcgcgcaaatcgctttgggtgtcgcgcgatgcctgctgaaccttcttcagggcgctttgaagctcggtcgtgtcgccgccgaacttgataacaagccccttgtaagtgaccgccacgtaatcacccctcttcggttgtcaaagtcccatgagtgcttgaagcaacgcgccctcgcgggtgcgctgccgtcaagaactcacttcatgtcatgaccagaacgcggcttcggccttgcgcgccttctcgtcctcgtcgtagtgcgccgcagcgtctgcgtagaacgcgttgatttccaaaaggtcttgcacctgccggtagctcatcatctgaaggtctgagagcgtcaggccgcattgctggcagttgtagatgtatcgcgcgtcgcacgcgtcttgcaggttacttggaagcggcggcgctggccttttcggcttcctcggcttccactgcatcttgcgcggcgcttggaaaaaagttgtccatcacaatacgcatcacgtcggtagcccaaccgtccttgcgctccaagtcgtagccatcggcggggaaggacgaaacccactcatcgaacttctcatcgaactgagggtttgccgtcttgatgcacgcgtagaagatttcgagaagcggcacgagcggtgggaatccgaacttgtccaagttctccaagatcgcgccggtatcctcgttaatgtccttcggtctcatggtgccgttgggcttcacgacattgaagcagcgggaaaaggcaatcggagtgaatgcgttgaaggtcgcttcgaactccttttcgccaaccttgataagcattcgaaacctcctagaccgtcggttcggtcttgtgctcaagctcgatattgaccgcatcaaagaaggtgtcgtagtcggcaagcccggtgaagctgtcatagccgctcgtgcgaatgtcggtgctcgggatagtgaccggtcgccacgtgaacggataatcaagctgcgtgatctcgggcgtgtcctgaacggtgttaagctcctgtgtcggcttcgagagctggcacatgagaaggcagcggcggcgaccgagcacgtgccccggctgctcgcacataaaggcgaacttcttgggcgtgcggtcggcgctcaggatggttcgcccgtcctgcgcgatttcgtagcccacgaggtctgcgatgagctgccgcagctcggcggtgctctcggtgtcgtagaagctcatggttccagagccgccgttgtcctgctgcttgtcaagccacggctcgttgtcggcgtagctcgttgccgtctcaacggtcggctccatgctgatagctacggttcccgcgacatgcacggggtcttcgtaggtaagtgcgtcttcgtcggtgcagatcgcgaaatgcgagttcttcacgccgaagaatccgtttcgtgccatttggtctctcctaactctctgcgacgttcacggtgaacgccgcttcggtaagctcttctgaatcaatctctgtgatgccaagcgtgtaagggcactcggcggcttcgagtgcggcgcgtatgcgcttctcggtcgcgtagtcccggtgccgcgtgtagagcgcgatatcgtagggcatccacgaaagataggtgccgttgtccgcgtaggccgcttcgttgtagcccgcaacaaggcagatgaagggcggtgccggttcctcgccgtcagcgaagcgctggttagcccacgggatgccgagcgaatcgagaacgccgcagagcgcctttagctcaatcatcgtccgtcgccccccatctccgcgaactctcgcgccacttggtctgcaaccttcctgataacgccgtcgccgggaacggtgccgtaatcctcgccggtctggttcgtgatctggtggccgttctccaacaggtgcgttagctggtatcgccggttgtgcacggtgcattcggtgcccgtctcatcggtcttaacgtcggccttccagcccttcttgtaagcgccggtgcgcaccttgctttcttgcttcaacagcttcacggcgcgccttccggcttcgcccgcgttctcagcgagcgcggaaacgttatcgtccacgcactctttcatgcagcttcgtatgaaccgctcgatgctctgctcagccacggtcgcccaccacctcagcgagcgtcaggcgcacgaagtcggggcttgacctgtcaacgcgcgcgaccgtgagccgcgcgccgtcgaactcgactagccgctctccgttgtaggcgctctttcgaatctgcaacactgcttcggggtgaatgccagcggcagcggcggcgtagtaggcggcatcgcccatagagaagacgttgcagaacacctttcgctttgtttcctccgtctgctgcacgccgtattcgtccttcttgacggtcttagcgatgagctggcacgtgccagcccacatgctcatgacgcgcccccgaactccgagctgccgcgcatcatggttagcagatcgtcgaagctctgagtaaggcggtcggcatcggggttgtccatgccgaagttcgccttgcagtagaccttcaccgcgagccgaaccgtgctgttcgaatcgtcggcggctacggaatcggcaacgccgcccgcgcgcatcgcggcgcgggcggcttcgatgaggtcttcgatctcagcgtcaaagtcggtgcattcggcgggaatcctcagcgcttcgcggcacgcgtcaagcagcgtcggcttctctgccatgcggcacctcctaagccttaacggcggtgccgatggtgagctggccgaaagacttaggcacgacaagcccgccgtcgaagagcaggtatccgtcaaagcagcgcttctgcgtacccggctcgacgtagggcgtaatgtccacgccgtcgaagatgtttccacggaacaggtcgggatagcccgccttgatgataccgtccgccatcgaatcgtcgcgctttacgagcttgccgaagatatgcccctcaacggcggggtcttcggtcttctcgtccacgaagtaagagcgcccgttggcatcctcgaccatagcaatgtggttccaaatggtgttgccgttggcgtaaataatgcagcccttcggcgcagggttgccgtaggtgtagagcattcccagaagcttggtgatatcagccttcttcagggtgccagcggtggcgcagttaatcttgttgccggaatccatgccgagcgtgccgtcaaccgtcttggcgtggacacgcgcgttggcggcgacggcaaggcgcgcgccagtctcgttaacgatgtactgctcaaagccgctgatagactgaaccgccatcttgcggctcatcttgacggtcttcttgatctcctcgcccgtaagggtgatgatgtcgaactcgttctgctcctcatcggtgggcgctgcgccctcatcggtcttcgccgcgtcgccagccttgatgctcttatggcggataagctcgaactgatgcgggaagttgtccttgtggatgtcgccgtagagaacagccgtgttgtcaatcagcgtgaaaatctgcgtctgaagctcgacggggataaccgcatcggtgttgctggtcagatgcgtgaacgccgtgcgctgctcgataaggtggttgtacgcgtcgcgctcaacctgcgtaagctcggtgccaccgatgagctgcacgccggaacggctggcaatgtccttcacccacgcgcggcgggcggcggcgttgtagtcggtggtgtcgcgcacctgcggaagagcaccgcgagcgctcgcggaagtccccagcggcacggaatcgacacgtcgggcggtgccgttctcgatagcggcgcgcgcggctgcaacggtcgcggtgtggctgtcgcggcgctgagcggcggcggcgttgcgcttctcgatctcggcggtaagcgcgctcatgcgctctgcgtcctgctcggtcggctcggtgtcggtgccgtcatcggccttgtacttatcgacaagaccctgaagctcgttaagcaggtcatccatagtcatttcgtccattgttctaaacctttctgctcttggcgattgccagtgtcgccctcgcaacggcaagggcactcttacggcgcgcaagctccttgcgcgactgctcaatcgctccgttgagcaggtttcttgctgatatctcagtgttcgggtcagccggaagactgacggcggacacgtcgaaaacctttttgacgcgcgtaatggtcgtggtatgcgtctcgcggtcgtattcgtctgccgctaccgtgaaagcccatgacatgcgcgtgataagaccggcctttatctcttcgaagagatcgcgcgcgccctgagagcgcgacaggtcggcggcgatgaaaagcccgtgctcgtccggctccacaatgagcgtcccgttgctcatgcgggcgtacactctgcccgcatggtcgaactgaaggataacgtcgctcatgtccgcttcgcggaaggcatcggggctgataacctcgatgtattttgtgccgtcgaaatcctcgaacagaacgtatgggtcgttgaaagtagaagcgtagccctcaacgtagtattccgtgtcaaagcgcttcttggttgcgccgtcagccgcccgcacgttgagcggaacggcaagggaacggtattgccgctcactcggtttcgctggcatcgtctacctccttcttgtcgccgtagccgctgctcgcgtcgattgcggctatattcgcgttcgtctctgcggcttgcgccgcctgttccgccgtatgctcgctgataagttctaggtcgatgtactcgccgcgtatcacgtggcgctctccgccctcgtagtgcggggattggaaaacatcggctacctgattgccgttccagataccacggtcgaaaagcgcgacggaaacgttaagcttcgtcgtgttgctggcgaactctaggcggttcgcgctgaacatgattgagtttccgtgcgctatctcgttcgccgtgtacgtcatggaggtgataacgaagccgagctgaacagcgaacggctcgatgcgtccttcgtagtagctgttgaaggtgtcttcgtccgcgcagttcgtgacgatatcctcattggagccgaagaagcggtaagcgctcttctcgattcgctccatctgcgccgcatcgaccgtgtagcttgtcggcgtgatctgctcaacgtcagaaaacagcttgtcatagaccgcgattccgcccgcgttgtcagcggaaagctgagcgttgaacgcctttcgcgcccgctcttggtcgccttcgtttcggttctggctcagcttgccgatgaagcgaattgctgcgccctgattgatagccgactgctcggcttcgttctgagcgtgcataagctctagcgtcggctgaagaacgttcgtgccgtcgccgaacaaatcgctttggtactggtggcgcgtcatcacgccgacgcgcgaccactcgacaagcacgctgtcgcctgtcgggaacgtgagcttcagccaaagctcgccgtcaacgtcgtatgcttcgcactggctcggcagcacgggatagtacccggtgatcgtaataccgtcgccagcgtcgataggcacgataagcgccgtgtcgttgacctgaagaatcgtccaaatgcgcttgatgaactgcggcgtggtcatccacgggttaggctgctgcctgagagcacgcgcggcgacaggctgagcagagccggaaacctccggtttcagcttgcttgcgtggtctgcgccgctctcgatgatgcttcgcgtaagctctgcttcgtaaagcccgccctgccacgtcgtgaacgacggggcataggccgtgaacgtggagaaatagccgtttaccgcttgcatctgcggacggtggaacaccgcatcgaagagcgagcgcagaaacggttgtgatctgctcaactctaacctcctatcatcgcgcggtaatcgtccgcaatgttcttcatcgcaatgaacgcgtcgcactcagccgcccacgcgtctatgcggttgcgcgggtcttggttcttcttgtccggctgaatgtttccgttcacgtcggttcgaatggcgacgttcgagcggcaccattcggcaatcgggttggcgttgtccacgatgcgcccttccttatagagcgctcgaagctccttcatcggcattgacagcgtttgcgcgccctgaatgaccttttgcaggttgtcggcaccgaaatagtcttcgtatgcttccacggtcggcacgtcgcgcatgtgccacgggtcgtagccgcaagagacggcatagatgccgtacttgtcctgaacctcggccacccaatccagaacgtcgcgcttgtccatgatgggcgtttcgcacgtccgcataagcccgcgcgcaatccacgcgtcatagggcacgccgtcgcgccccccgcgccgcccctccttctccgcttgctccaacgcgcgaagcggaatccacgccatgtgcagcgcgtagaagttcggatcgttaggccgctgcatgagaaggcaagcggcggtaaggtcggtcgtatccgcagcgtcaacgccgagcacggcatacgtaaacgttccgtcgccggggtcgaaagtggcttcgttgtgaatctcagaccacgtaagccaagcctgagactggttttcaatgaggttgaagtccttaactagcagagtgggaaggtatgtcgcatcgtccttcgccttagaaacgttctggcgaagcgccgacagcgatttgatggtgccaaggccggggttagccttgacccaagcgccttcgtcctgccattcttcgcgctcgtcaagttcgaagatgaacgctatgaagcgctctgccttctcgcctgtcgccttgccgtcaagccatttggtcgcgtactcgtattgagcatcgaagatgccgtttcgcacgaaaccgttagtcgtgatctccaaaacgagcggttggcggcgggcggacgttccctgcatcgtaaggtcgtaaaggtcgcggttcttcatcgcggccagctcgtcaacgatagcgccggaaatgtccagaccgtcaaggtggttcgtgttggcgctcagcgccttgatggtgcccatgttcaggtcgcagtaaaggtctgacacgcgctttctgatgtgtttagcaagcgcagggcttgtgagcaccatacgccacgcgttgttgaagccctttgccgcctgatcgtgtgcggtggcgacgttgtagacctccggcgcgccctcatcgtcgttcacgagcaagtcaagctctatcgcagacgcaagcgcggtctttccgttcttgcgccccataatccagagcacttcgcggtattgccgcacgccctcggcatcaacaaagccgaagacaaccgacagaatggcgcgttggaaaagctctagcttgaaatcgtgccccaagcgcccggacggtaggcggcagaagctttcgatgaaccgaacgtgcttctgcgcgaactcttcgcggtagtggtacggatagagcgggtcggtgttgtccatgtcgcgcaggacatgagcggcaacctgcttcatcttctcgcacgctatgatctcgccgctcagtatgccgccgaagtattcgcgtatcgcgcgctcgcacgagccgcccttagacttcgccctagccgtaccgcgtttcattgatgaagtcaatgagcgcgtcggcagcggcggtgccgttcggcatcatgtcggttagctgcttcacgccgcgtgagaacgtggtgaacagcttgttgtaagcgctgaagccgggatgctcgcgcagcccggtttgccctccgccgttgtcgtactcggtgaaaatgtcttcgtagagcagatcggcgcgggcatcgtcaagcttgaccttcagaaaagcgaggttcgccagaagcggcatgacggtttttcgcttctcatcggggatagcgcccttggtgatctcgcgcagctttcgaagctcgctctctacgcgcttctccttggcaactcgccgcttcggcgggctattccccgcgactgcgggcgaaactttcgaagtattgcctacttttgccgtcatcgcaagaccaccccctttcgaaaatccgtcacgcgcaagaaattatctcccggcgttggtgccctaggcaccgcctgtgttttgcagaccggggggattgtctcgcgggtttacctgcggttttgcgtccgctttctcgcggtcgctctgtgttgtgttgcgtttttgaatcaatcgccaagcgatatcaaattgccgtcgctgtcgaaggccagcccttgtcgtgtcgaaccttgccttatccaaccatgcaccttcttatggcacctgtcgcaaaggctaacgaggttgcttgggtcagtcgcaatgcttgggtcgctgatgttcgctggcgttagctcgatgatgtgatgcaccatgacagcgggcgtgatctctccttgctgcaagcagtgctggcataggtgagcgtcgcgcgtcaatgccgcgtctctggcgtgttcccagtcagcggaagcgtagaaggcgcgcgagaagtccttagccatgcgcacccccaaacaaaaaggccacgagcgctgtcgcccgtggccttacctaatccaccgtaccgaactttagcagaaggcggaaagtgaacgcaagtgccaatcttaggcgttcttcaatttcgcccatcctacgcggtcgatgtaggcgaagccagccttgcagagttcgcggcaccattgctgcgagcattgcataatgtctgctatctccgcccattcctgcgcctgaagatagcccatgcagattgcgtcggcgtatctggtgcctttgagcttggcaagacctccgcgcccgtcttgcccgtaaagcagttcgcacgcttcgtcaatcatgccttgcgcgtcattgattcgctgctgcaacctgtcttcgaagtcgatacgctgcaatatcgagagcgacccatcggaaacctcaccgcccccgcgcccctccgtgtagctctgcgctttggcaccttctttggccttcatgcgttcgagcatatcccgcgccttatcggtcttcaccacctcggcgcggataccctcgaaatactcctttgctttcaagatcgcgtcacctactcaacgcccgtactgccgaagccgcccgcgccgcgctcggtgtcgctaagctcatcaaccggcacaagctcgcaaggaacatacggcataacgacaagctggcagacgcgcgttccagcttcgagcgtcaccgtctcatagctctggttgatgagagccgcgcagacctcgccgcgatagccgctgtcgataacgccaacgctattcgaaagcgtgatgccctgctttgccgcaaggccgctgcgcgggaacaccagccccacgcagccgctaggaatctcgacggcaagaccgcagccgacaacgcacttctgcatcggttcgagcgtgacagtctcggtgattcgaaggtcaagcccagcgtcgccatcatgggcatatgtcggcatgtcgataccctcggcgaccttcttagcccgcatcttgcgaccgatcatgttagttctccttccgcgcgtggcgcttaacgagcgtgcagttacaagcggcaacccagaaaccgccctttttctttccgggcgtgcgcaacacaactttctgcttgtggctcatcgccacgacctgaagcagcgtgccgcgataggaaacgaggtcatcgagagcgataagcgaacctgcggaatcgacgggctgagtgtcgaacagctccacccatagcggcttgctcttatcggtagccgccgcactcggcttcgccttcctcttcaagaaatcgaacatcggtaaacctcctaaaacggtatgtcatcgtcgtaaatgtcgggcgctgccggttgcgctggtgcaacgggcgacgggtcgccggtagccatcgcaagaccgggcgcggctgcgttcgctgatgccgtcgattgcgcatcgcgcttgtactgcatcagctccacatcatcaacgcgaacttcccaacgcttgatgctctggccgtccttctggtagcttcgcgtgtggatgcgtccgagaagcgaaatcttggtgcccttgcgaagccacggcgcgagcgcttcggcgcgcttgccgaacatgacgcaatcaggccagttggtgtattcgccccatgtgccatcgccgttcggcgtgcgctcgttgacagcaagcgagaacgaaacgacagggtttccgcttttcgtatagcgcagctcggcatctgcgccaagattgcccgaaagcgtgatcttgtttaggctcatacctcaacaccacccatcttgcgcatttgctgaacgatatgaaggctgagcgccataacgcccttgatgcagtcttctttgctgcgcatctgctcaccttgcagagtgtcgcaacagcagcaagagacatacgaaacgcggacgtaccagtattcgctaggctgatagccagcttcaggaatgacgtaaacaagcgtcccctgatagtctccatcgttgatttcgtggatgttctcgaagtccggcttagggtcgcaatagtcgcccgtcgcttcaagcgcaattgccttgacggtcgccttgacgatatcggagtaatcgcagccaaggcatatcggttcaagccagctttggatgagatcgcggttcttcatccacgcatcaacaaacttctgaatcatcgagaaccaccaccgaacagctcgacaagcgcggcgcgttggtttgcgccaagaccgcgaaggcggcgcgattcggaaatgtgcagcttgcgcatggtctgttgcgttcgggcgaagccgtagcccggtgcggccttgatgagcgtaaagaccttcattctcgccaccgtgtcatcgttgccagccatgttgagcacgtcgggcacgctgtaagagccatcggcaacgcccttcaagatcgcggcgcggcgctggcgtgcggccttcgccttttcgaggttttctcggcgctgctcagttgtcagattcggaatcatcttcgtaaccttccttctcgtatgtgatgtattcggtgccgtgcgtcagtttgacgggcggcgtgtagtccttcagggcatcgtcaacgctgccgttcatcagcttgcgtttgagccgcgcccagtcatcgtcgttaagctcaatggttttcatcgcacctcatttcttcgtgatgcggtaggtgccagtgagcttcaagcccttcaacgtccgcaagatgtgctctgcgtgctccttgccgaagatggttagcgtttgcgtcggaatcgtgatctcgtagaccgtttgcgcttcccgcttctcgcgttcccacatctgctttagggcggcttcggtcttcgccaacgtcgcttgcatttccttgctcagcttcggcgtgtcgggcttgaaatcgaacgtttgcggctccactggcaccctcctttctcacgattgcctgataattacttcttatctggcacgggcggttttaacccgtaccgaaagcggcggtttatctcgcgtttcgtcctcggtcgccgcgatgcccgaaaacggcgttttggttcacctttggcacacctcatgacgcttggatgcttcggttgcggcgcaaataagagttgaccaagggaagacaacaaagctgccatttggaagcccaacaatcggtgcgccagttgctgcgtgatgggaaacctcaaatcgaccttctacgccatccatagtcgcggtgccgcatgcttcacggaatacaagcgtttgagccgaagaatcaatgacattcgcattaaccgatacgtttacaacactttcagaagcgttcatgtgtaaccccttcctcttatccattcgaagctctgcgcttcgcttcgctgaagagctgagccgccgccgcgtcgcgtccgggcatcaggtggccgtagattcgaagcgtcgttgcttcgtccgcgtgccccatgcgctcagatagcgtcttcaggtcgcagccgttggcgatgagccacgaagcgtgcgtgtgacgcaagctgtgaaacgtgatctctcgcggcagtccgcatgcgtcgcgtatgcggctgaaagcccgtgaaatcgtcgttgggcgcatataagagccgtctagcgtaaccagtgggcaatctgcgcccaaacgccccagaacggcgctctgaagcttcgtgaaggcatcaataaccgcgatatcgtcttgtgtaagcgcgatgttgcggcacttgcggcctttggtgacgtttcgccgatagggcttcttgcccttgccctcaatgacgttgccgccgacgtggacgtaagacagggcgcgcttaacgtcgatgcgctgcaccgcgcagacctcgccaacgcgcataccggttacgagcgacagccacgaagcgaaggcgtagacggcggcgcggtaatcggccttcgtcttgatctccttgctaagagcgccctctagcttctcgttgaagccctcaaagtcccattcggtgagcgccgaagcttcgtgccgttccggcgatggtttggcgacgtacaccagcgggttagcgtcgcaaatgccagcgtctacgaagtggttataagcgccgcgcaagaagttgtggacgttgataacgctattgcggcaaagaccttgcccgccttcgtccttgaccatgagcaagcgttgctcaaagcggttgaagtccataacgccaagatcgcgtgcgtttgcggtcttcaggtaacgtgcgacgtagcggcagaacagccgatagctcttaatgctgttcgggcttgcgccgttgcgctcgcgcagttgcacgtagtcttcgagcaaatcggtcaagcgggcgcttctaaccgttccgtcagccgtcacgtaagcagcccacgtctcagcgagggcttgcgcttcctcttcggtagccgcgtttggaaaccgcttataggggcgaatcgccttgccgtcgatgctgcgcccaaggtacaaacgacactcgaaaacgccatctgcaccgcgcttgaccttaacgcccatcatgaccactcgcagtttccacgaatccgcgaagggcagtcatcgtcggggcaatccgcgcaatccaacggctctttcctgatgttgaactcaacgattcggtacttcagagaaaagcggatgagcagcagcagggcatgagcaagcgagttggtaaattgtccgcaccagaacgggcaaaacccgctcatcgcgccgcgaacctcgtacttgccgcccatgctacttgccaaccttcatgaacgcgcgcataacgcagataagcgaaaacacgacgaacaccgcaagggcgataagcccgaagccagcgccgaagaacacgccaaccgcgatgctcacaacgagcgccagaacggcaaaaaggacgattgcggcgcatccgtaagcgccctgctcgatctctctatcttctttcagcatgtgaaacctcctaaaacgtgagcgctataagcgcgagaaacactaggaacagcgcgattgccagaagcgcttgataagcccagtagcagacgcaccagaacgcggctacggtcgcggcggtggcaatggcgcaaagtacgatctggtagtgcttcacttcttgccttccgtctcggcaatcaggtagtcgatgcactgcttgcacttctgcaagtcctgaacgccgttcttgcgccgccagcgccaaaggtatttgaaagcacatccccaccagtaggcagattgggcgggcaaggcgtactggtcgccgctcatcatcgaacgcatagcgtccatgcactcaatctgtccgtcgcccgcgtagtggtcgggatgctccactgcatcaccgcgcgaaagctcgccaaggctcttcgcgtgcttcgtctcaatcatcggtaggtaactccaatcatccactcgcaaacccacttgtgaaacgctctgagaaatggctgaacgttcgtgtcatcagcccagcccgcaatgcctatgaatccgtcttcgttgaacgagatagcttcacggcctgagaagtagaagccgctaacgcgcagaaacgcgcttttgattcctctaccgccatcggcaaggttgatttgcggctggtacttcttgcgatagcacgggtgcatttccatgtgctcgccgttgcgctcgtgttgcgcgtactcgattgcaaggaaaccttcaagagctcgaatgtcgttcgctgtgatctgctcataggaaagcttgcttgcgaacagctcgcgtgctccgtcgcgtgtcgttggcgcaatcattccgcaacctccgcgccacaagaagggcaataggccgcgttgtccatgatgtagcacccacaacgcgagcattggaagtaaccgaagtcgtgttcataggtgccgttatccatgaccttatgcaccgtcacgtatgagcctgaatagtcgggaatccttttgcattcgttgcgcttgctgtaagagctgccgttgaaaataatgcggtcaggctcttcagttcccgattcggttttgatttcgacaacagacgcattgcgacgaagactatcaaatagctgttccaacttttccgggttgtcaggcgtaaaggagaagctataagtcttctcggtatccatagcaaatcaccccatttcgtgccattgttgaaaactctgttgaaaacctgtggaaagccgttttgctggcgctcgaatgagtcgcacaaaacaagaccgcaaagagaagaagcaagagaaagaaccttgcttgtaaggttgactaacaagcaagtacggtgggttttggttttggttcgaggaaccaaaacccacctcatcttgttttgttttgttttgttttgttttatggttaggcgaccatttgcgagtgggtttagcacacctaaaaccactggttttgccttgggtttggcaatcatgcttttacacctcctgacctgctgaattgttgttctgtgagttcttgcgcggtcttccgcccttgcgcccgttggcgcgttggcgaccgaaataaagcgcgtttttgagcatgcgaaagttcgtcaagaagccgtcttcgtcgcgttcgagaagccctatatccaacagctcttcgacaaaggatttgcaatcctcaatcgccatgtactcatcgaacgcgcctgactgtccgaagcccagaacgcccgcgagaataagcgcgtcttcctccgtctcgaacgctatacggtgccccttggtagccgccagatattcgcagagccgccaccagcgcccgtagccgtcatatccccgacgatgaatgagacgttggcacttcgcgtcttgcgaagcgttggaatcgtgcgagaagaaggccataggctcttgcgcagcggtcgtttcctcccttgtaggcatgtagtcacctcctaaccgtcttcctcgtcgcagatcacgtctggcgcgccctgctggtgccatccgtcccatacgcagtgcccgacttcgcggcagttcgtccaaacgtcgcgcccaacgaacgtgcagcacgtcttgccgcgatgccgcatgctttcgaactcgcatgattcggggtctggcatgggcggttcgccgaaatcgagcggcaaggtttcctgcgcgctattcctcttcatcgcttgaaatgtcgtaggcaatcgagctgccaacgtaggtgagcagcttttgcatgtgcttaacggtgctcggctcgggcttcgcgccatcttcaagcagagtgtcaacccatgcgagggtgccgcgaacgattgcgagcgtggcgctcatatcaacgtcgaagccctcgccggtcttgggattgatgagcgacatgctgccgttgagggcgaaggtgccagcgccgaccttggcgatagtctcggtgatctctttacgcttcatctttcttctccttgtcaaacatggatgttctaagctcgatgcgaagcttcgggttgcgttcgagcagccagcgagcgagcaaagagctatcgctgttgttgattccgtaggtgtgttcgttgccctgatcgtcaacgaagggcacgccaacgagcttcgtaatgccctcgtagcgctgcttctcgatgaggtacttagtggagacgcgaagcccgcgcgcgtcgattgcgagcgctgtaagctcgatttcgcgcagcgcctttgggttcttctcgcaccactccttgaacaggtaacgtctgtccgcgacctttagcggcatcgggtagacgcgctggcgctcttcgcgcatgacggcttcgagcggttgcgtgtagttatcggtgtccatgcgggcacctcgcttcacggctcatgacgcggcgcaaggccgcttctgcttccgccttgctcgccgatggtgcgacgggtagcatctggcggcggtagaccctgccgatgccccggttttccggcgtgctcgcgtcttcctctatgcgcgccatccagaagcccgcgttgtcgcggtagacttcggccttcatgaccaaatcacgcgccacaagacgcgaccaaccacgatgtaaagcggaatgagaagccaccagcccacaagatcgcacaaccacccaagcagggcggcagcagccatagggaggatgccggttagcgtcagagcggcgattgcatacaatccccagcgctggtagcgcggcatgcgcgctatactgtcttctgtcaattgcgccctgcaatttgacacgcccgttcgaagttgccgcttcgggcgggcatctttcttcgcagccattcgcgcgttttcgcaacggcgcatctgcaccactggcgctgcgcagcgcttaggccgcacggttcgggcattcgtaataccacctccaaaaccaacggttttcttatcggttttcacgtttcgaaacctccgctttagttgctcgaaagagcgacgatgcccaaaagctcatcggcggtacactcatagagcttgcaaagctctatgagcatgggcgctgtcggcgaagtcttgcccgtctcccaattgctaagcgtcgtgatggaaacgccaagaagggttgcggccttctgagccgtaagacctttccgctcgcgcgctgccttatagttctcgctcattgttcacctccaatcatccgaaagagagatgaaataaaccatacggcttatttcggggcaagcaaaagagtaagccgtttggtctagcgtgtcaacaataatttgtatacaattagccgagacggttacgtttgataggggttgctatggatagcaccgagacaaagaagctcattggcgctcgaattgccatcgcgcgcaaggctaatggcttcaaccaagatcaacttgcagaagcggtcggcgttcataagcagacgatttctaggtgggaaagcgggaagcgcgcgcccaacggcgaagaagtcaggctaattgttgagaccctaaattgctctgctgacttcatccttggcttgacggatacgctgaagattggtggcggaaatgactagaaaagagaagttacaagcgattgacccaaagaaggtaatcgtttttgataccgagacaaccggcttgaacatcggcggttctcgccgcgatgaaatactgtcgctcgctgtcatgaatcttgacggtgacgttctgttttgcgacctattgaagccatcggagcgcaaaaagtggcctaaagcggaaagcataaacggaatatctccgtctatggtgaaggacaagcagacgattgtagaaaggcgttcggaaattgaaccgattttcaagaacgctaagctatacgtcgcatacaatgccgatttcgacctaggatttcttcgagcttcaggcttggatataccagatcatcagacgtttgacgtgatgaaggagtttgcgaagatacacggcgcatgggacggcacgcatgctgaatggtcatggtgcaagttggaagattgcgcagcgttctacggatatcgtgactttggggcgcatgacgccttgaacgacgtaagagcaacagcgcattgcttcaattcgattctcgatgattttctttttggtgagccgcgccgccgcccgaagcgcgtaaaggatgagttcggcgattcgtatttcgagtatggcgacgaagagtttagaagcatcgtttgcagcggctatgctgccgcattggccgacactgaagaacatactaacaacgcgccatcggctaacgaggttcagcagcaagccaaggatgaaaaagacagcgtggataatcaaccggacagaaatcatgccgtgccagatcggcggaacacgaataaagcattggtgttaatcggttccgtttgcgtattgattgggcttgcaatcactgttttaggcgcagcaatcgttggtgtcccgattgctatattgggcgctttgcttgccataggttcaaagggaaggaaatagaaaaccctgcgcggcttcttggcggtcggcgcgcagggcaagtgcaaagaacgaagcgcaattgcgcgctcgctctaaggggtgattttagcatggtgaagaaccgagctgccatatacgcgcggttcagctcgcacaaccaacgctcagaaagcattgagatacaagttgagaactcacgcgaatactgcgagcgtgaaggcttgcatgtcgtgcgcgaatactgcgactatgcgcagacagggcgcaacgtagatcgagcagagttccaacggatgatgagcgatgcgaagcttggtctatttgattttgtggtgatttacaaggtaactcgcataatgcgcaaccgcgatgaaatggcattggcgcgaatcatgttgcgcaaggctggtgtagaaatactttatgcgggcgaagagatagcgagcggttcgagcggtgttcttcagcttggaatgctcgaagttctcgcagaatgggaaagcgcaatcgacagtgaacgcattagagacggaatccagaagaacgccgaacggtgcatggctaatggtcgcactctctatggatgggatatcgtagaaggacgctacgccatcaacgagcgagaagccgcagtgcttaggcgcatgaagaaccttttgtttagcggtaactcagtagcggagatcgtgcgcgccgttgacgctgagcgcagcaagcgcggcgcaaagttcaatcaggataccgtcaccaagcttctaaagcgagtgcagaacgcaggtgtctacaagtacgcaggacacgaggtagaaggcggtatgccagccctatggtcacaagcagaacaggatatgataaacagcatccttagcgaccgtcaccgcccacgaaggaaggttgacagcgcgctagagttcccgcttagcggaaagctctattgcgctcgatgcggaatgccaatggccggaacaagcggaacctctaagaatggttctgcctatcactattacaagtgccgaaaatgccgcaggacagttcgccgagacttgatagaagatgcagtggtcgatatgacctatgaagcagtaaagcaagctgatgtgagaaaacgcattgccaagacgcttgctggctacgaagctgagcgggcgaccgaagaaaagcccgaaagctacttcatcaagaaagagattcggcgtatcgacaccgcgtttgaacgcatctggcaagcgatagaagacggcatagcgccgcccggtggcagagagcgcacaaccgagctgaagcgacagagagcggagttagaagcccgcttgcgcgttgcagagcaagcggaatcgctcgaaccatcggttgacgatgtgcttttgtggctcgatgatctcgcgaacgacacaacgcctttggaaatcctcaacgagtttgtcagattcgttgagattgacggcaaagatgtaaccgtctacttcatgtttgacgaactgccggacgatttcacgccaaaacagaaaaaggccgaacaccattgctaccaaaggtgttcgaccaattctcttgtggtggaggcgcggagaatcgaactccggtccacgaaagccccctgattggcatctccaagctcagtcgctggttttgtctcggacgctttgcgcgcagcgacacgctcgcggcatcctaaccggttcggtcttagcctgcgccataccgattacgtgcgcaggagcattcccctaaaatgacgtcgcgccggtgtcggggaaatcaccgggttgacgcgccgctataaattaagcagcgagagccataggctcaaaagaagagttgttgtcaattcaatttgacggtacccctgtttaacgaggcgaggagacctcggcttgcttcctctctcagagctatcgtgtcgaaaccagtcgcccccgaatgtcgggaaagtctggatggcattgggcacgagcacccaacacccgtcgacttttcaaggaacacgcggggcgagccccgcttatggagtgttatcttaccacgttctgaaagcggacagctgttctatgcacgagctgtgaagaccccaatgtgcgctgcacttcgcacttttgctactggtcgcgtcacgtatattttcgccaagcaaaacagccagtcgaaaggaccgttatggataccaagcagcaactcgtcaatgccctcgcaggcctgggctcaaccatcaccgaagccatggatgtcatcgagggctttgtcccctgcggacatcccgccctcacggtgtcgaacgccctcgtctcactggataccgacgacgatgcagccctcgcccaacagcttgagaccgtcaagggcttcatcgaccacgtgagcgagaaccgcggcgtcaccgcacatcacgatgcctcggttgagctcacgggttccaaggccaatctgttcgcagcaatccgcgaggtaggaacccttatgcaaaccgcaggcgtcaagaacacccaggtcaacgagtgggtctaccgcagcctggccgcgctaaacgattccgacgaaaaggccgccgagaagctcgccgaagcccccgccatcaagactgcgcttttgtaatttaagaatgcgtgcccttcggagcgtcaacgttccgaagggcacgcaaacagccaggcactatcggaatacctgcccgccacgttcggccaaagccagaatcggcatcatttgacgtggcgtttttgctgcaatatcggcatgttcgagcagtttgcgatcgttggtcaccaagtaatcgacctgcgcgcgcttgcacgcggcgagcaccaagttgtcctcgtaatcgcgatggagcgccaagtatttgtcggccagccaaaggtccgacgcatctgcgcccacggccgtggcgttttcggtcatgttccgaacaaacgccaacgccgcatcgccaattgcacgggctgacgcctcgtcgagcgctcccccattggcaagaacactgcgctttaattcgtgctggacaacgtacagcacgtccttagcgatgtgcacggggaagaacagcgacgcgcctgcctccgcggcccgtccgataaaagcccgcgcggcaagcgactcggcatggtcagcgcaaaatgaatcgacccatacgttggcatccaccatgatcttaagaggggccccactcacaggatcatccccttttggcgataatgctcatccatggcctccgcatagaccgtatcccaatcgcggccctcggacccaggcgacgcaacgttacccaagtccgcatagagtcggtccgcggccgcccacgacgcggcaaacggggactcaggcgcgacggcctgctgccggtcgtcaacggccgcaagcacttcctcgcactggccgccgccctgcgcgaccttggccacaacctttttgatgagctcgggcagcgacccgcccgagagccgcaacgcctcctcggcacggtccttgacctggcgatccacgcgaacattcacctgtgccatgctgctaacagcacccacgtcgatcacgcccccttcacttgctagcattgctagcataactatatagagaagctagcaaacggtcaaacgcaaaaggcctgtacccggacggcaccgatgccatccgggtgcaggccagataacgtgggcgaacacgcctgctaacgcaggtaagccttcgcgttgttgagactgtacgcaatcgttgagccgttgtgcagcagcgacgacgtctgcggcgtaatcatgccggtaatgccgagcgccaaaagcgccgagttggtgagcatcaccttggaatacgagctcgtcagacggtcaatgagcccctggctcatgcggcgcaggcggacaatcgccgcgaggtccgtgtcggtcaggatgatgtcggcgacctccttggcgatgtcgcttccgccgcccatggccaggcccacgtcagccagacccagcgccggcgagtcgttgacgccgtcgcccaccatggcaacgcggcgtccctcgcgcttgatccgctccacataggcgtacttgtcctcgggcagcagctcggccttaaactcgtcgacgcccgcctcgcgcgcgatgcgctcggccgtgcgctcggagtctcccgtaagcatgacgacgtgtttgacgcccagcgcatgcaggtcggcgatggcctcgcgcacaccaggtttgagcgggtcctcgataccgagcacgcccacgaccgtaccgtcgaccgccaggtacaacggcgacaggccctgcatctgggactcgatgcgctccttgatgtcggactccagctgcgcgccctcatcctcaaatacaaagtgtgccgaaccgataattgcgcggcgcccctcgatggacgaggcaatgccgtgcgccacgatgtactcgacggcggcatggcgctcgcgatgctcgaacccgcgctcgcccgcggcgttgacgacggcgcgcgccaccggatgggggaaatgttcctccaagcaggcggaaaggcgcaggacctcgtcctcgctccagccatcggtcgtgagcacgcaagccaggcgcggctgggcctcggtcagcgtgccggtcttatcaaagacaatggtgtcggccttggcaaacgactcaaagtacttagcgcccttgaccatgacgcccatcttggcggcgtcgctcatggcggtcatgacggcgacggagcccgtgagcttgagtgcgcacgaatagtcgaccatcagcgccgcagaggtcttgatgaggcttcgcgtggtgagcgcgaccaggcccgcgagcaggaagttccacgggacgatcttgttggcgaggtcctccatgtgcgactggccctcggatttgagcgagtcggccgtctgcacgagcgagacgatcgagcgcagtttggtctgggccgtgttggcgcgcacgcgcaccaggatgctgccgtcctcgacgacggtaccggcaaacacgtcgtcgcccacgctgcgctcgacggccagcggctcgccggtcagggtcgcctggttgaccatggcgctcccctgctcgaccacgccgtcgatgcagatagacatgccggtgcgcacggcgaccaggtcgccgggctcaagctcggtggcggcgacgctaacctcggtgtcgccgaccaccttttgcgccttgtcgggcacgtcgagcagcgagttgatgagctcgttttcgctcatagcgcgcgtgtagtcctcgagcagctcgcccacgttgagtaaaaacatcgtctggcccgcggtgtcgacgtcgcgcttgacaaaggagataccaatggccgacgcatcgagcacgggaacggtcaggcgcggctgcgcgagctcgcggagggctgcacgcaaaaaggccatgtagccggcaacgacaaagacggcacgcaacggcgtaggcaaaaaccaacggcgcgcgtagtgggcgccgacaagcgtcgctaggtccataacgagcttgtgcttgcgcggctcgagctgcatcacgtagcccgacttggcgtcggcgatggcctgggcatcgagcgcgccgacggcggccaacacggcgtcacggcgcggcccgtcgaattcgagcgccatctggccgatgcggccgtagacgcgcaccttgcgcacgccgtcgatttcgccgctgagctttagaagcgcatcgagatcgctctctggcacaggacccgccaactggagacgggtcctgccggggatctcgctgataatcgagaatctcatagtttgtgcctgggagcgctactcgactgcgttgctcgcagcgtcagcctcgctctgggtgatgtaggcagcctcggcaaccatgtcgtcaacgttggcctttgcctgctcgaccatatcctggtagccgttcttgatgcgcatgccgcacgcgatgccctgcacgcaggcgttctttaccggagcgctggtgagcagcttgatgccggccgtaccaagcagaaaaccgccaccgacaagcagggtgttaaacgtcgacttcttcatgttgcttctcccttttgccgcacaagcgcggcatggtgccttagcacccgagttcattagtttgctcgagcacgcttttgaaaacagtttagtataacaatttggtcaacaatggctaactttttggaaactatggggatgaactcaatatggcaaagggacagtccctttgccacggtcctacagctgccaggcagccgcttccttttgcagcgcaaccatgcgggcgaattctccgcctgccgccttaagctgcgccggagtgccctgctcggcaaccacgccatccttgagcacgacgatcttgtcggcattttccaccgtacgcatacggtgggcaataacgataaccgtcttacctgcaagcagacgggagagtgcctgctgtaccacggtctcattctccacatccaagcttgccgtcgcctcgtccaacagcacgatgggcgcgtctttgagcagcgcacgggcgatagagatgcgctggcgctcgccaccagaaagcttggaaccattctcgccgatcatggtgtcgtaaccctgcggcatgcgattcacgaactcgtcgcagttggcggcacgcgcggccgcaagcacttcctcatcggtggcgtcacgacgcccgaggcggatgtttcccatcaccgtgtcgtcaaagagcagcacgtcctggaacacaatggcgtagtcgcgcagcagcacctcgggatccacgctcgcgacatccacgccacccacggtaaccgtgccttcggtggcatcccaaaagcgcgcggccaggcggctcaccgtagacttaccggagcccgaaggaccgaccagtgccgtgacctcgccttccttggcggtaaagctcacatcggtaagaactttctcgccagcgcggccgtcctcgcccgcaccatagccaaacgccacgtgatcgaacaccacatcgtggcccacgggctcaaatttctcgctgccccgcgccacaggctcttccatgatggaacgcatgcgcctggcagacgactcggcggcaaacagctcggacattaacattaacgcctggtcaaagggcgcatagatacggctcaccataagcaggaaggcaaacatcaccaaaaagtcgacctgcccggaggcgaccaccgcggcgcccgtgaccagcgtggtggcaatgcccagacgcaggatgacaaaggcggagttgaccaaaagcccgttagcgagctcgcccttggtggtctcgcgctcctcggcatcgatcacggcgttgagcccctcaagataatgggcctcctggttggtggcacggatctcgcgaacgcagtcgagcgtctcttgaatcgcctcggtaaccttgaccttctcggcacgcacgcgatcgaacactggagtcatggggccgcgtgttagatacagcacggcaaaggccacgggaacgctccaaaacgccgcaatcgccagctgccagcaaaagaacagcgacgccacgaacacaatggcgcttgcgatgatggcaccccaaagctctcccagcacgtggctgtaggcgtgctccatggcctggacgtcacccatgatggtctcggttaaatcggccagatcacgacgaccaaaaaacgacagcggcagtttgcgcaagcgctcggcgatctccatacgctgcttgccgcactcctcgtaaaagatgcagtaggtgtagtaatactgctgccagttagaggcaaagagcagcacgaaaaagaccaggaggccgcccacgatcggcagggcatccggcaggtcagccccgctggcgagatgctcgacaaagccggccataaccaggaataaaaagcccatgccggccatggtaatgagattggtgagcgtggtccagaagacgccgcgttttacgccggcgacgcctttatcggataggaaatacttcttttggaatgaggcgaacatttaggcctcgcctcccttcgtgacggcggcatccgcggtcgcagtagtaatcttccagctcgcggcctgttcgtattcggcccacatcttggcatatagacccttttgggacagcaactcggcatgggtacccgactcctgcacgctgccctggttgagcaccacgatttggtctgcgcccactacagtcgagagtcggtgcgcaatcataatgaccgtgcgacccgccgccagcttgctaaaggcacgttggatgagcgcctcgttctcgggatcggcaaacgccgtggcctcatcgagcaccacgataggcgcgtctttaaggatcgcgcgggcgagtgccacgcgctggacctcgccgcccgaaagatatgctccgccggcaccgagcatggtattgatgccctgtgggagcttggccacaatgtcgtcgcactgagctgcggagagggccgcacgcacttcgtcgccagtggccgtaggcttggaggcgcgcacgttatcggcaagtgtttgccggaacagctggttggtctggaacacgaaggcgacctggtccataagctcgtgcggatccatatcgcgaacgtccacaccgcctacgagcactcgacccgaggagacgtcccaaaaacgcgggatcaggcttgcgcaggttgacttaccgccacccgagggacccaccagggcgagggtgctaccggcgggaacgctaaagctcacatggctaacggcaggtgctttggcaccctcgtacgtaaagctcacatcctcaaatcgcacgtcgccgccggcagggtgcttgggttgggcgggcacggagagctgcttggaatccatgacgcttcggatgcgagccagcgaatcggcactcatctgagaggcctcgcccacaaacatgagcttggtcatggccgtcggtaccacggccgaaaatatcgcgtaaaacgtgaagttggccataaaatgcgcgaagtccgtctcgcccggcgccaacagcaacgccacgggcaacaggaatgccacaagaccattgagcgcggtaaggttgagtacctgcggacctcgacagaacgtgcccgcatagttttgtgccatgtcggcgtattcggcgatcgcatcgtggaaggccttaaaggagtagaccgtctgctgaaacaccttgaccacggggatgccgcgtacgtattcggtgccggtcttgttcatcttgaccagcgctcccatgtaggccttcataaactcgccacccttgccgcccatcatggcggccatggcgccaaacgaaacgacaaccgagataaggcatgccgcgcccaagcgccaatcgagggcgaaaagcaacacgagcagacctgcgaccatggcggcggcgccggcgatgtcgggcagcatgtgtgcgagcaaagtctcggtggaggcggcgcatccgtctacaacacgacgcagctcaccggtggcgtgcatgtcaaagtagccaagcggcagcttaagcaggtgctcgctcgtagtcttgcggatattggacgcgcagcgaaacgcagacaggtgcgtgcacatgagccccacgaaataagctacgatgcttgccagggcaaaacccacggcccaccagccatacatcgcgatatcggtggcttcgctccagttaggcgccacggcgatcaaatcgcgtgcgacaagccaaatgcacacgtacgggccaaagctcagcaactgcgagagcgccgagagcgccatgcccaaatacgttaggaatttgcggtcaccggcatacgcgagcagctcgccgataccgccaccttccttttttgatccctttgccatgagattcctttctaacggcttgagagttaaccgcaatcaacttatcattgatgtgttagccatggctcacaatcaagccaggcgtggacgtttctgcaaaggaaagggacgcttttgcaaatacggcgggcagcgaccgacataaccgagctctacgcaccacagtttgagcagtttggcttggagctttccggcaaaggcgccgtctttaccggcgaggtggcaaacgaccgggcgcatggacgcgcatggatcatgcccctctcccctgtctgcatcgtcatggagcatttcattaccccgacgcacgatatgtacctggccgaatacacacccgagccatacgcctgcgtgagcgaggtcagcgcgcccacacttgcatgcatgcccgaggctggcataacgcctgtgaaccttaaacccttgcatggaccgtggccaaacagtgccgtttgcagctttatccaagatagctgtggcgaggaattaagcccgctgtttgcggggcggctctatcactcgcgctcggtgctctttttgcctggatattttgacgaactggagcaccgctatcccaccgagttcacgggaatctttgaggcgtttgccgagccatggcacgaagaggcgacatctgccatctgccacacgctgcgccggattaacgaagaccgcgtccgcaccgtaggcggacacgtctatacgcaaggcatcgtggagaccatggtcgcggagctcgcctgttcgcgcgcggcccacaagcaggcgcggcaggcggcaggcacacgcgtcagcataaccattgccgaagaagcaacggcaatgattgagcgcgcgctcgacaaaggtagacgtgtgagtatcaacgaggtggccgaggggctctacacaagccgctccaaactatgcgctacctttaaggcccaaaccggcgaggccctgggcgcttacattcgcagacgccgcatggagcgagcacaggaccttttggccgatagcgcgctcacgatagcgcaggtggcagagcgtctaggctaccctcagcaggccgccttcgcccaagccttcaagcaacacaccggcatgacacccacggcttggcgaagcaagcatcgctaaggcccaagctccctggccgtaacggagcgattaatttgccgccgcccgtcagctcacccaggatctaaacgtcaagatgcgcacaatcaagcgcctttttgataagagggacagatcgatcagccaaatacaacggaatgttgagcaccccgtcgtcgagcttcaggttcttaagtgagtagcggaccctcaatggagtcgtctccgcatgcttgtcggcatagtacttaaggctcttggaatgaacgacctctcccgatttgacctcgacgggaacgatttcgtttccgacttgaatcaaaaaatcgacttcgtgcttcggcttctcgtttgtccaataacgcggagcagcatctaactgtgaaagtaatgcctgaagcacatagttctcggcgaacgaacctttgaactccgaaaatagcgcatccgagatggcaaaagcggacgcatccagccttgccatgcggcgcagcaagccgacatcaagacagtagactttaaatgccttgaggtcatcgtacgcagcgagcggcacaccaccggcagcattaaggcgaaccgccgtgatgagcccagcatcggcaagccattccagagcatcctcgtattctcgagcacgagccccctcgcgcaccgcaccccaaacgaactttttgttctcgcgcgccaactgagctggaatcgagttccatatttgcgaaagcttggcgaactgcgcacggccaccatgcttggcaaaatcgcgctcgtaggaatccaagagatcagacaacaccttatcgacctgaacgatatcgcccgtctccgcccaccggccaagagcctctggcatgccgccgcatgcaaaataacgacgaagatgctcgacgagacggacatggaagaaatcgggcactgtctcgatctgatccaggccgccaaggtattcgtcgtagtttgcagcgccctcggctttcagaaactcggaaaagctcatagggtgcatctccatgaactcgacctttcccaccggaaaagcgctggtctcacgggacaagcgaacgcccaacaaagaccctgcgcatgcgacgtgatactcgggggcctcgtcacagaagtatttaagggcgccgactgcagaaggacaatcctggatctcatcaataataagcagcgtctcgccgggatcgataggttgtccaagtgccagggaaaggtttgagatgatccgccgaggatcgcgcgtaccttcgaaaaactgagcgtactcgctctgtaccccaggtgacggttcctcgagcgtcagatacacaaaattgcggtacgaggttcgaccgaactccttaagcgcccacgtctttccaacctggcgcgcccccttaaggataagcggcttacgatattccgacgctttccaagcgttaagcttggcaatgatatctcgctgcatgaccgaacctcccgcaaagaaacttccgaaaacgtgatatttcccacattttaccctaggtaaaacgtgacatttatcacatttacggaagttttaagctcatttcgccacactttcatcacattgaaaaggcggaggcgcattttgcgcctccgccaccatctttcctatcagcccgcctgacccgaacggccgagtcgtctggccggggaagccccgagtcgccggggtgtttgctccaaatgagttccgcatgcaaagaaggccactaaatgtggccttcgtcttgcataggactgtttgaaatttggaggaaataccccggcgactcggggcttccccggcctcgcagctacgagagcgacgttctcagcaactcgttgaagagcttcgggttgcccttgccgcggctcgccttcatgcactggcccaccaaaaagccgatgaccttctggttaccgtcacgatgctgctgcgcctgatcggcacagtttgccagcacctcgtccacgatcggctgcagcgcgccggcatcgctcacctgacgcataccacgctcgtcgacgatcttgttggggtcgtcgccggtctgggccatggcctcaaagacctcgtgcgcctggttggagctgatggcatcggtcgccagcagcttagccagcgctgccacctgagccggcgcgatgccggactcggccagcgacacgcctgcgcccttaaggtaggcgatcatctcgttcaccagcaggtttgcgaccgtctgggcctccttgccagccataccggcagcggcggcctcaaaaaactcggcgaactcgggatcgccggcgatctgctcggcatcggcggccttaatgccaaagtccgcctcaaagcgagcgcgcttggcatcgggcagctcggggatctcgccgcggcagcggtcgatgaactcgtcgtccaggtcgaacggcgccaggtcgggatcggggaacagacgatagtcgtcagccgtctccttcacacgcatgaccacggtgcgcttgcggctgggctcccagtggcgggtctcctgatagatgatgccgccctcctcgagcacctcggcctggcggcagatctcgtaggcgaggccatcgtgcaggctcttgaacgagttaaggttcttgagctcggtcttggtgcccagcttggtctcgccgcggcgacgcagcgacacattgccgtcgcagcgcatggaacccttctccatggagcagtcggaaatgcccagcgtcacaaagatgcggcggagcttctccataaacaggcgggcctcctcgggcgtgcgcagatcgggctcggtgacgagctcgatgagcggcgtgccgcagcggttgtagtcgacgagcgactcggccgcggcagtaatgcggccctcggcaccgcccacgtgcaccatcttggcagcgtcctcctccatatggatgcgcaggatgcggatgggcaccgtgtaggaaccgtcctcgcggcgctcgggcatctgcaggttggacgcgtcgtagctggccaggtgaccggcgcgctggttaccctcgcgcatggtcgacgtcatggacgtggacaggccctcggcgttggccgaagcgctcgccaggctctgggcctcggcctcgccaaacgcgcagtcggggcgctcggcggcaccgcgaccggtcacgtccaggtccagatggccgtacatggcaaaggcgaccggaccttgcgtggtctggaagttcttggccatatcgggatagaagtagtgcttgcggtagaacatcgagtggcgctggatctcacagttggtggcgagaccggccttgacgatgctctcgattgccttcttgttgggcaccggcagggcgccgggcaggcccaggcacaccgggcacacgttggcgttgggctcgtcatcgtggctgagtttgcagttgcagaacatcttggtgtcgagtgcggtgagctcggtgtggatctccaggccgatcacggcctcccaatcctgcaggacctcggaaagctccttcattacagctcgcctcccttcccggcaaaatcgggcgcgacggaaagcgcgggcgcacccgtggcggcatcggcaaagccgcgctccagggcgcgggcaaacgtgagcagctgacggtccttaaaggcaggccccaccagctgggcagaaacgggcagcttgctgtcctcgcccaggcccagcggcaccgagatgccgccgttgccgcagatgttaagcgaaatggtgtacaagtcggacaggtacatctgcgtggggtcgctgatctcgccaaacttaaaggccgtgcgcggcgaggcgggcatcaggatcgtgtccaccttggcatacgcggcgtcgtagtcctgcgtgatgagcgtgcgggccttctgcgcggcgtagtagtatttgtcgtacacgcccgagctcagcaggtaggcgccgagcatctgacggcgcttggcctcggcgccaaagccgtgggcgcgcgaaagcgagctctggtcggacaggttggcgcagccctcctcctggtagccgtagcggatgccgtcgaagcgggccaggttggagaacgcctcggccgggccgatgacgtagtaggcggcgatggcggcgtccaggtgcggcaggtcgacctcgaccagctcggcaccctgattctgcagctcctgggcggcgcgctgaacagcggccttgacctcgggcgtcaggccctcggcctccataaacgcggggataatgcccacgcgcttgccctcgatgctgtcgttgaggtgctcggtaaagtcgacggcgcaatcctggctggtgcagtcatacggatcgtggcccgcgccggtaagcgcgttcatggccagcgcgacatcctcgaccgtgcggccaaagggacccacctggtcgagcgacgagccaaaggcaaccacgccgtaacggctcacggcgccatacgtgggcttaaagcccaccacgccgcacagcgacgccggctggcgaatggagccgccggtgtccgagcccagcgagagcgcgacctcgcccgcggcgacagcggcagcggagccgcccgaggagccgccgggcacgcgctcggtatcccaagggttgttggtgcgatggaacgccgagctctcggtagagctaccaaaggcgaactcgtccatgttggccttgcccatgggcaggcagccggcgtcgagcatgcgctggacgcaagtggcggtgtagacgctctggtaatccccgagcatgtgggaggcgcaggtggtgcgcgtacccacgaggttcatgttgtccttgatggccagcggcacgcccgcgagcgggggtagcggctttccggcggcacggtcggcatccacatgcgcggcggcctcgagcgcgagctcgggcgacacctgcaggaatgcctggaccccaccctcgcgcgcctcgatggcggcaagagaggcatgggccacctcggtagcggtaaagtcgccggcggcaacgcccgcggcgatctgggcggcggtaagggaatcgaagctctgagccattactcgctctccccctctcccaaaatggacggcacgcggaagtaacggtcgcgcgcgctgccggcgttctcgagcgcaacgtcgagcggcaaatcgcgctcgggctcgcgcaggtcgtcacccatcacgttggacaggcttccgatgggatggaacgtgggctccacgtcgggcaagtcatattgcaagacgggctcgagcatctggacggcgtcgttcatgtaggacgtcatctgggtgagctcgtcatcggtcagtgcgatctttgcgtactcggcgatgccgcgcacgtctttctcgctgagtgccataggcgctcccttccgcataacagttaaaccgctctagtatacagggcaacgccgacttggagcaggcgctttacccaaatgcagcgaaaacgtaacgaggacggcgggttggcagggcacgatctggcggacctgcagcgaaaaccgccccgcccacaacaaaaaccgtcccgcccgcaacgaaaaccatcacaacattcgacgcttttcgtcaaaatcgcgattttcatcgaatgttgtgatggtttggaagccccgaccaccacaaaggtggctgtccccattgtggtggttctgaagaatgtcttatgccgaggccttggccttgcggcgcttgcggaccgtgtggatcacgatgtccagcagcaacagcacaatggccacgaccacgatgagcacggcaaactcacgcttgccccagtggcgaccggccagcgacttttgcttgtcgacgtccttcttgctgtacttggtgcgcacgcaatgcaccagcaggcgatggtcgttcacgccgtagggcgtgcaggtgacgagcgtcaccttgtcggcgccgggctcgatagtcagcgactccatctcctcgggcagcaccacctcggagtccaccatcttgtaggcgagcgtcttgttcatggtgtgcagcagcaccaggtcgccgggttccagcgaatggatgtcatcgaacatgctcaggttgcgcatgcccgagtgcgcggtgagcacgcaatgcgtcgaggtgccgcccaccggcaagctcgtgccctccaggtggccgacgcccgccatgaggacttcttcgctcgtgccgtggtagatgggcatgctcacgtcgatggaggggatctcgacccagctcatcatggggtcgcggtcaaagatgagctgctgggcgtagggctcgatctggtcggcgggaagctcggtggcctcgcccgccagctgctcgttaaaggagcgcgcctggagcaggatgcgctcgcgctcctcggcagacagcgcgtccacggtgctggacacggtgctgatctggttgaacacgcccgaggcctcgagccggtccaaaatccacggccaggtcataaggcccacgccaataaggataatgacgatggtgatgagccggtcggcccagcgcggcagtcgcttgcgacggcgcttgggttttggttgagatttgggctgagggcttgagccgccgttgtccgcggcgttattgctcttcatatgtttggcgccctgcaccatcgccggtcactcctctacaactcaagttgtctaaacaaataatagccgattcgcgaacttccgcgccggacaacgcagccaggaccgaagcaccgcctacggtcggaattcttagagaccttctacagcgcttcctgccatggatattcctttccaaacatgcgatcgacttcgagctgaattcgttcatcgtcgattgccgccaaagatagcgcaagtgaaatgtcgtcgatacgggaggagtcggcaaacacgggcgcatagcgccacacttggatcatcgccgtttcgttatccgacaattccccatctgcgacttcaaggccacgcagttcacgccatacgcttcttaagaccgccttttgatccatgcccggagccgcgagcatcgaacgcgcagcgagcgctgtctccccagcgtcagcgagacagtcgatctgtggtgccctccttgcaaaaaagaccttcgagacaggcgagaagagctctgccatgtgctcactgagcagaagatccacggccacgggaaacacaatgacacgtcgttcgcgccgttcgcgctttgcgagccccctgtctacaagctcggttatggcctcactcgcgcggcttgccgaaatcccaagcgcacgacaaaggtcatcggaatgatatgactcctgccctgccccccagattgcggcagcctgcgcgttgggtgacatcttggtcgcgcgattatgaaatctagtgccgcccctctccgtgcaggccgcgcccataaatggaagaaaggcctgtctaccagagcaaacaaaggggattccttgtgcgaccaatgccttgcgttggcgcgcatcggcatcaggaaacgaaacgacgacaggagcctccgcacgcaaggctaactggctatagactctcttagcctcgggaagtcctacgccagcaggcaaacttgcaagcaaaaaagaaaaaccatttgcgtcaacggcgcggacctcaatcgaccgtagatgcagtggcaagtgtgcggatccaggccaagttttagccttggcggagaggcccagtgcttcttgtaagtaggcaagcgcttcgttcatttccatctttttcgcttgattccagtatttattggaattatacataatttttggaaatgacaagatttctttcgggcataggcccgggttaggccgtatttgagttttcaaaatatctcgaatcaactgagcgattcgggatacaatgtttatagaaaacgacgcatcccgcgtaagtgttaaggagcgcgggcagcctagttttctaacgtgttaaacggccgggctgcaaccccggccgtttttatttgcgcttgcggcgcaaacgccgagaaccgtccgcaccgcgcgtgcgcctacggaccttaaaccgaacctcatacgagtcaacgagccggagagcacttaatgtgctctccgtgcgagcaggactgtccgagcagggagtaaagtcctccggctgcctccggacaggtcagtctgctagcaagtcgggtactcgccctcccagacgatgcgacggtactgatccggatcggtgtcgccctcggtggagaagcagagcacggagctcgtcttgtccaggccgatgagctccttgagctcggcgtactcgggatcgagcatgagggtctcgaccaggccggtggtcaccgcgccggactcgccggagatgacgcgcgggtcgcccttctcgggagcgcccagggtgcgcatgccgcgagcggtgacccagtcggggcaggacacgaaggcggtggtgtggttgcgcaggatatcccaacccaggatgttgggctcgccgcagcacaggccggccatgatggagggcatgtcgccgtccacgatgcgcggatcgccgtcgccggcggcagcgcccttgtacaggcaggcggcaggcgcgcactcgaccacgacgaaggtgggcgggttatcgggatacaggttggtgaagtagcccaccacggcgccggcgagcgagcccacgccagcctggacaaagacgtgcgtcgggcggttgatggccatctcgcgcagctgctcggcagcctcggaagccatggtgccgtagccctccatgatccaggacgggatcttctcgtagccctcccaggcggtatcctgaacgatgacgccgcgctcgcaggcgtcggcctcggcggcggccatgcgcacgcactcgtcgtagttgacctcttcgatggtcaccgtggcgccctcggcggcgatgttatcaaagcggggcttggtggaacccttgggcatgtgcacgacggccttctggcccagcttgttggcagcccatgccacgccgcggccatggttgccgtcggtggcagtaaagaaggtggcctggccaaagtccttggcaagctgatcggaggtcaggtaatcgaaggtgcactcggcaacgtccttgccggtctcgtcggcaatgtagttggccatggcaaacgaaccgcccaggaccttaaaggcgttgaggccaaagcgatagctctcgtccttaacgcacaggttggaaaggcccaggcgcgcagcctgaccatccaggcgggcaagcggagtgacggtgtactgggggaacgactggtggaaggcgcgggccttcttcacgtggtcgaggctcatgattcccaagtgcttgtcatcgctcttgggcatcgtgttgcccgcccactggatcttatcggccatacggtgaactccttaagttctctcttgccggcccccgcatacgcgtttcagcccgatcccattcacacggctgaacttttatgtggaggccaaacaaaaagtttgttagtactgttctatcacactttttgattggtatacctaacaaattgtttgttgccgtaatcggtaccttttcgccgccgaacggtcacataacgcagcaacgctttcgttatttgcgaacaagtgtggtttatggcaaagtgtgcccaaactaatttttaggaaggcacccatgacccccgcacagattgagttttacaagcgccttgcacacggcctggcgctccaatttggccccaactgcgaagtcgtcgtccacgacctggagaccgaggacgtggaccactccatcgtagtgatcgaaaacggccacgtcagcgggcgcaaactgggtgacggccccagccatattgtgtttgagtccatgcacgagggcaccaccgacgtgcacgaccgcgagccatacctcaccaagaccaccgacggcaagctgctcaagtcctcgaccatctttatccgcaacgacgagggcaagcccgtcggcattttgggcatcaactttgacattacgcttatgaaggcttttgagcgttcgctcgacgcctttaccggcaccggcggcacgggctacaccgagcccgagcccattaccaaaaacatcggcgacctgctcgaggacctgctgcacgagtgcgaacagtttgtgggcaagcccgcggcactcatgaccaaagacgagcgcattcgtgccattggctacctcgaccgtcgcggcgccttcctcatttccaagtcgagcgagcgcgcctgcgagttctttggcatctccaagtacagcttctatagctacctcaatgaggccaaggcggcgacaggcgacaagtaggcactcgcctggattgcccctccccttttgggcgcgagttctggaaagcacgaatccaagaccgagccgcttgggaagttccatataatcgatgtcattagtatttcgaaagggtggaacagaatggcgttgagcaaggcatcatgcaccggtcgcggattgattccggcaattggtggacatgtgcaccgcatgttcgatgagggtgaagacgacctgttttcgctgagccttgacgacgtgatggatgatcgcccgtggaccgccgacgaactcatgggcggtggggctcgcccgtcaagccccaatcccgcacttgcgcctaagcccgcatctgcgccgactcctgcgcagccgcctgtttcgacgcccgcgtctgcgcccacacccactccccgccccgcaagcgacccgtccgagacggcggcatttctcgctgcagcgacgcagggcaaatcggccgacagcaccgttatgtacagcgcccagcagttgcctgttcctgcggcacgcaagcctccggtcacaaggctcgatgagcccgttgcccatcaggttgcctacgattcctgggctgcagccgatctggatgagacctctaccggcatgccggcgctcgacgttccagttaacccgctttttgccgccaacacgagcgccgcgggctatgagggcggtgcggcatattccgattattccgatggctatgctgacgccggtcgcatcgagaccgaggattatggcaccacatcgagcgattatctcaacgatccgtacgccgccacgcctgcaccggaatatgacccggaggccgcgtccgcaccggcgtataccaaaagcacgggcgaagagcgcttcgccgattattacgccgaggaaaaggcgctgcgtttctcggaatttccgcaggcagtcaaggttgcctttatcgccattgtcattgccctgctcggcgtcattgcgtttgagggattccggctgttctccggccccacccaagcggagtcggagacccagcaaaaagaggacgatgacgagtatctggacatcaacaccctcaagggcgaccccaacgacggagacgatgagtagcgagagctgaaggcggccgcaggatcccgcatccagcaccggcttctaagtgctgttttgtcatccagctacacttttccgaagttttaaggtgcctatttcgacacttttccgtacttttacacggctgatttcgacacttttccggatgaaagccgaataatcacttgggaaaccaacgccgttcacgcgtcatttcgcaggcggcgcttgatttctgtccgtacacgttgatagacttcctcttgcccgcaaggagcgggcgcattttatccagagtcggggtagagagttggctccacgatcccgacgccaaccggccaagaggcacggtggccctgccaacatcgatgaaaggagtccgtatggacaatttctccgtgcgcagcgagcgtaacttccacaacctgatcgtcaaaccgaatcacatgcatcttctggataagccaaatggctacgcctcggccatgatcaagagcagcctctcccaccagatgcgctttacggtgcaggtgctcgaggaagaactctgcgccgccggcagcccgcacgtgctgcagatcaagctgcttggagacgactctcgcgagccgtctagctggaagctctttgctgacggcgtatgcgttgcggacggatccggcgcctttgcccgagagtgcttctgcgagggagccgaggcattcctggacctgtgccgcgacgccgtacgcacggccgagctgtactagtggagccagagggagtatgagctgttgagtgcggcccgcgggattgcgggggcgtaggcagacagaccagacagctcgtcatactggttgacgcttcgattcaaacagcagggcgggctcgcgcttacagccccgccatgccaaaccgaatggcgttctcaaaaggcctaccccctccgccttcagctttagcagcaggtcgcccagctcggagcacttgctggaaaagcgcgtctgagctcgctcgcccatcccccaccgttgacggacctcctgggcgcgcgggctcacgcggtagtccccgtccaccatctgcttgagcagcttggcggtcacgcgcgcatcggctagggcgctgtgggcgtgacccgtcgactcgtcgaactcgatgccaaaccacgtcgctgcgtcactcaaagagacgcacccgtggctgctcatgtccatgatcgaggtgtaaaacgcctgcaggtcggcccagtccgtaggaaatgcggaaagatcgatgtgctttgcttggcactcgatcaaaagctgtcgacgatccgccccgctccaacagaccacccgggcggagtagcgcccgatccaatcgctgagccttttgatcaccatgtagagcggatcggccatcgcggtgcccacggccgatatccctgtgagctcgcggacggggaacgcaacgccttcggtaaattccgtctgtacaaactgcgagaactcgcccataacgttgccgtggtaatcgagcttgacggcgccggcctcgataatctcattgcacagtccacggcgctgacgctgctttggcaccggcgcaaactcaaagtccagcacaatctggcgcgcaaagttcgtcgtatcgatagccgagatacacggcgtcttttcagctgacacggttgggcctttctccgtcaactgccgctcgttacataggcggctacattgccgtaaggataggcgcccgtgcggacacaaaagcgggacgcaatgccacgcgcgccaggcatacgccatgcagacggccccaagagaatcgcccgctctattcaaatgcctgaaaaagatttaggcccggtgacttgaatcagaggtcatcccgggcccatcagagctcgtagagctcttggttgctttggtctcgctcttcacggcgcttatcgaactttccgaggcactcaagcagcattcgaagcataaaaagaggggtcgacgccgttaaggcattgaccccttaaactgagtaacggcgctgcccagctcttcactacttgggctgccgtcgactttattctacccacgggtgccaggtttaacaaatggattttcggtaacgaggcctcggcaaccgccgccttgattggcgacccatgctctgccacaggccgagggttgtcgaaaagtcgaacattatagctacccataatatagccagctataacgtcattcgacgaccggcgcaaacgcccacgcggacacgaaatgcgctgcggtgccattggggattatgggatgcgctttccgctcgaggcctcaaccggaaacggcatcccgatctgaaggtcaaatccggggcgtagtttccgcttgaagaccgattcggaaaggttgtcccgttctggagccaaatactgggtcgtagtttccgccaagcatgccatccggaaagcgtgtcccgttctgagcctgaattctgggatgaactttccactgaagcatctactggaaaatgcatcccgttccgaggcttaattctgggatgcactttccgcggagagactaccgtttttcgaaaaagtacacgtccctaaacttaccaggtcttcataacttgttgccgttcacgggagccgatcaccgcccaccgattcgaatgtaaaaatgtcgccgaaaacaggccatctacctgcatggttagattttggtcagcttttggtcagttgggcggcaagttgcggctgatacgttttttgctacccaaaaggaggcggtagctcatgacccattgcaatgaccaactcatcgaccaactgctcactcaagccgaacaagaggggcgctgtctgattcccccgagcacggcaatccgaaaagcgctccttcggcgcatcggcagcgcggtcgtctcgcccatgccgggactgttcgcgcgcaaaatgcgctgggatgaactcaaccgggcacagcgtcattgcgagattattcgcgcccttgcgatcatccaccccgattggacgttctgctcgttttcggccgcctgcctgctggggctcgaggtctcgtggcgacatctgaacgttgtgcatgtctgtagctcgacaaagccgtcggctcgcccgggcgcgcatattcagcggcatcagatcgagccggccggagcaatccgtctatccggcacatcagtaacgccgcccatccaaacggccacagattgcctgctgcaaactggttttgccgacggcatgcccattgccgattcggcgatctcaaagctcggccttgcgccggaacagctgatggaggccgttgagcaacgagcgactgcccgcaatggtcgcgcgattcgcaccgccctcacaacgcttcgatatgccgacgcccgcgccgagagcggcggggaatcggtcgcccgagccgtcatgatcgagacgggctttgcgcccgactggcttcaatacgagctgacggaccccttcgattcggccaagcccatacgaacggactttgcctgggagcgccaggcgcgggaactcacgctgggcgagctcgacgggctcatcaaatataccgaccagaccatgctggccggacgcaccaccgccgaggcgctcgttgccgaacgacagcgcgaggcgcacctatcgctctacggtcaccctctgctgcgctttaccatgagcgaagtccgctcggcaggactgctcgcgaaaaagctgcagacggcaggcatccggcagaccgcgctgccgacatggctcaacgaggtggagttgtaggagctgttgagcttatgcccgtctgcctgccaaaccgggacacactttccggttgaagctccaaccggaaagtgtgtcccactctggagccgaattccgggatgcgctttccgccagaggctctaccggaaagcgcatcccattctgagcatcgattctgggatgtaatttccgccgagggctccaaggggaaactgcatcccattctgagcgctcatttcgggacacgctttccgctccaagcaaaaggccccggctcgcgatggagctggggccaaaggtgcagcatatacagttggtgttgtgcgcgaacagcccatcagcaatgccgtctgcgccctaccctactcgcggtgacgggcgcggctgtacggcgtatccaccatgggcagatctggacgcagcttgccgtcaaatgcgcggtaggcattctgcacggcaggcgccgtgggaatcgttgcaatctcgccgatgcccttgccgccgtatgccacgggcagcagctcgtccttctccacgtagatggcgtggatatccggaatctcgggcgcacggaacagtccgagcgtgccgtaccttgcctgggggacgcagtccttgagcggccaatcctcggtaagcgcatagcccatacccatgagcacgccgccttcgatctgaccctggatggagatgggattgaccaccttgccggaatcgtgcgcggcatagacctcgctcacgcggccgtcatcatccagaatgaccacatgcgtggcaaaaccgtagcagatgtggctcttggggttgggaacgtcggcgcccagtttgtcggtcggctccaggtacacgtagccaaactcgcagccctcgagcgccttgatggcggcagcgggatcttgaggatgcataccctggccggcaacgagttcctgcgtgcgcaactggtaggcgcgaccgtcgtcgtactcgatcttgacgccattaccatgggcgctcacaggagcatcgggtgcatgcttgccggcctcgatgtcaagcatggcatcgcgcagcaggaaggcggcaccgcgcacggcctcgccggtcacgaccgtctgacgcgagccagacgtggtgccggagtcgggagcgttctcggtagagcactcgccattggcgatgcagcgaagcggcaggccgcatgcctcggcaacgtcctgcaaaaagacggtgttgcagccctggccgatgtcggacgtggcggcatagaccacggccacgccgtcctcgatgcgaatcttgcagcggccggcatcgggcaggcccacgcccacgccggcgttcttcatggcgcaggcgataccggcgtgtccgggatgtgcgtagtaggcatccttgacctcgagcagcgtctccttaagcgccgtggagcagtcggcaatctggccgttgggcaaaacctcacccggctcgatagcgtttctgtaacgaatctcccacggatccaggccgaccttctcggccagcaagtcgatcaggctctcgagcgcaaactcggactggcaaacgccaaagcctcggtacgcaccggcgggcgggttgttggtgtagtagccaaaaccgcggatgtcggtgttctggtacttgtaggggccgacggcgtgcgtacaggcgcgctcgagcaccgggccgcacagcgacgcgtaggcgccggtatcaaagttgatctcgcagtccaggccggtaaagttgccctcggcgtcgcagcccagcgtaaaggtaccgtccatggcatggcgcttgggatggaacgcaagcgactcggcgcgcgtgagcttgcacttcacaggacgctggaacttatatgcggcgagcgcggccaggtgctggatggacacatcctccttgccgccaaagccgccacccacgagcatggtctcgacgaccacgcgctcgggctcgttatcccagccaaacatgtgggcgcactctttgcgcgtatcgtaggcgccctggtcggtcgactgcaccttgacgccgttcttgtacgggaaggccacggcgcactcgggctccaagaaggcatgctcggtaaagggcgtggtaaagcgctgtgtcacggtaaacgcgctctccgccagcgccttggcggcgtcaccgcgcgtcacgtgacggctctggcacacgttgtccttgagctccaccgtgttgccaaaagcaaagaagctgtcgtgcaggcgcggggcgtcggcagacctggcctcggcgatgttgcgcacgggctccagcggctcgtaatcaatctttacgagcttcttggccttctcgagcgtcgcctcgtcctcggcaaccaccagcacgatggcatcgcccacgcagcgggtgatatcgccctgggcaatcatgacgtcccagtcctggataaggtggccgacctggttgaccggcacgtcctcggcgcgcaggatgcccaccacaccgggtagggcctcggccttggaggtatcgatggagagcacgcgggcacgcggatacttggagcgcacggcgctggcgtaggtcaggcccggctggtcgatctcgtcgatgtcgtcggggtacttgccctcgccgagcaccttcttgcgcacgtcaatacggaaggcgcgcttgcctacgccgtagttgtcgccgcgctccaagtcctcgtcgatctgcttttcgccgcggagcaccgcagcggcgagtgcgatgccctcgatgatcttcttgtagccggtgcaacggcaaacattgccgcggatggcgtacttgatctgctcctcggtaggctcgggatcctcggcgatgagcgctgcacccgccatgaccataccggggatacaaaagccgcactgcacggcgcccacggcgccaaaggcgtacacaaacgcctcgcgcacgttctcgggcaggccctcgacggtcacgatgttgcggccggcggcaagcgcggtggtcagcacgcacgccttgacggccgcaccgtccacatggatggtgcaggtaccgcatgcgccctcggagcagccgtccttggcggaatggatatgcaggtcgtcgcgcaggtagcgcagcagcggtttgttttgggtcgtcgtgcgctcgacgccgttaacggtaaaagtgaattcctgtgccatggtgattcccttctacacgccggcggcgatgccggtgcggtcgtggatggcgccatgcgggcagacgacggcgcacatgccgcacgacaggcagtccacgccgtcgatatgggcgcagttgtcctcgatgcggatagcgccggcagggcactttttggcgcacatgccgcaaccgatgcagctcgtgtcgcagatcttgcgcgcaatggcgcccttatcggtgttgttgcagcgcaccaggatgttctggtagccggggacgaaggcaatcacgcgctgcgggcacgccatgccgcacaggccacagcccgtgcacttggagcgatccacgcgggcgatgccatcgaccagcgcaatagcgccgtgggggcaggccgtgacacaggcgccacagccaatgcagccttcgctgcagcgggcgtcgccgcctgcggaggcgcaaccgcttccgcaggcaacgtaggccacgttatgttgaatggatttggccataagagactcgcctatttcttaagaaggtacgaatagttgtcgcgcacggccctgatggtcaggcggacggcctcgggaagaccggtgttgacggcatcgaccgagacggtgcggaccgtgccggcgacgcggaccttaaagtggccctcgtccacggccaggaagccctcgttctcggagttctccatgtcctgctcgctccagaacagggtgagcttgtccttgtagggacgaccctcctggtaggggcagaacacagcgcagttgccgcactcgttgcacatgccgtcgacgtgaacgacctgatgcttggcgagacccggcaccttaattgccacgttggcgcggttggggcacacgtcgcagcagacctcgcacaccgagccgcagcccaggcagcgggtcttggtgcagttgcgcttgtcgcggcacagcgaccccttgcgctcgtagcaggtgtcctcgcggccggcctgctcgttgcagtcggcgtacttgttaaagtccacgccgacaatggcacgggcaacctcggcggcatcggcgatggcctcgaccacggtggcaggaccgcgacggcagtcgcccgcagcccagacgccctcgacgccggtggaggtggcggcaaggcggccgcgacggtcgtgttcgacgcccgcggcatcgtacaggctggcatcgatgccctcgcccacggcacagatcaccgtggtggcggcaagctcgacggtctcgcccgtggcgacagggctacgacggccgcttgcatccggctcgccaagttccatgacgtcgcaggtcagcacggcgccgttgagcgccttgggcgccagcagctcgcagaactcaacgccgtcggcaagagcaagatcgagctcttcctcgtcggcgggcatctgcttcttggtgcggcgatacaccaggcgcacgttcttcacgccagtcaggcgcttggccacgcgggccgcgtccatagcggtattgccggcgccgatgaccacgacgtcctcgcccagctcgagcttctcgcccttcttggcggcctcgaggaactccagcacgtcgagctcggcaccctcgcccaagcctgcagagccgggcatccaggcaccggtggccacgaccacgtcggtaaagccctgagccttgagctcgtcaatggactccacgcgggcgttgagctgcaccttggcgccaaaggccagacagagctcggcatcgtgggagatatcgtcgctcgcgatacggaactcggggatcacgtgacggaccacgccgccgagcgagtcgcgggcctcgaagatagtgacgggcacgccggcgcgcgtcaggaagaacgccgtcgccaggccggccgggccgccgccgataacggcaacgttgcgctcggcgtcgttggcaatggcctgggcgcgcagcttgggcagcacggcggtcatggcctcgcgggcggccttgagcttgctggcgcgaatctgggcgccctcgggctcgtagaatgcacgctcgcaggcacggccgcagggatgcgggcagatggtaccggtaatgaacggcagggcgttgcgctcgatgatgatgttgagcgcgtcctcgtagcggccctcgtcaacagccgccaggtaggcgggaatatcctgctggatggggcagctcgtgcggcacggcgtggtaaagcagtcggaaagcgggctcttgccggcgaccttgcggtcgggtagcggacgcagcggcttcttgtagagcgggttggtaagcgagtcggtctggatcgcggtcacggcctcgagcgagacgcccgcgaacggcttgccgtccagatcggtaaactcgccggccatctggctaaagcgctcgtagccaccgggcttgagcacgtcggtcgccagggtaacgggccaaataccggcatcatacagggcgcggatgttgtagaccgtggcaccaccggagtagctgatgcgcagcttgccgtcaaactgctcggtaatgcggcgggcggcctcgatggtcagtgagaacagcgaacggccggacatgtacatctcggtggaaggcagctcgttcctcgtcacgtcgacggggaacgtgttggtcagcttgacgccaaactccaggccgcgctcggcgcacagggcaatcaggcgctcgaacatgggcacggcgtcggcccactgcaggtcctcgcgaaagtgcgtatcatcaaagacgatgtagtcaaagcccagctcgttcagacgctggcgggcaaactcatagcccagcagcgtggggttgcacttgatgtaggtgttgaggcccttctcggtgatgaggtaggtcgcgatgcgctcgatctcggcgggcgggcagccatgcagcgtggactcggtgatggagttggagacgcgtgccgggatggactcgacaaacgcggcgtcgacatgctcaaacttgtccaggttggcgagtgcccaggcacggcactcgttccagacgtcggagccgctggcatccttcatgccctcgatgtaggcgtcgaccttggggctcttaatgccctccaggtcatagcccaccgacatgttgaagacaaagccgtccgggctgcccagaccgtactcgcgagcgatcaggtggcaggcaaaccatgccttcacgtactcggcaaaggcctgcggaacctcgagctcggtcgaccattcgcagttgtagcactcgtcctgagccacgatgcagggcttgttgacgcacttggagagctcctcgccgtccataacctggacggtcttgagctcaaagaagcgagaaccggccacataagaggccacgatgttctgggccagctgcgtattgggaccggcagccgggccaaacggagtctcgatgcgctcgtcaaaaatgggaagcgcaccctcctggttggtcgtgaccatcttacgcacgccaaagatggcgtcctgggtcttgtgctcctcgatgatccagttcatcagctgcgaaaacgggatcggcctcatgatgtcgctcatagtgagctcctctctgtaacgcccggcgagaccgcgcggcgggcgcaaatacggtgtagcgctagcacagcgccggcgaccccgcggaggccgcctatgcgcgcgtcggatgcggcgaaacatccgacgcgcgcgaatctccaattggaattagtacacgcgatcgttgagcgtgctccaaagcttcttggactcggccatggtccacgcgttgatcttgtcctcatcaatcccaacgaactcacgatccttgtacaggacgcggccgttgatgatggtggtgcggcagtttttgcccatcatgccaaagagcatgtggccgtcgatattctcctcgctcagcggcgtaaagggcttgtagtccatgacgatgacatcggcggcagcgccggcctcgagcacgccgagcttgcgatcgaagtacttgctcgccatcttggcgttgttctcgaacagcatggtcatggcctcgcaccagcccacgttgggcatggcggcgttgtggcgctgaatgatcaggaagaccttaaggctctcgagcatatcgtgggtgtaggcgtcggtgcccatgcacacggggataccgcggcggaagaactcgagcacgggggcgcagcccacggcgttgcccatattggattcggggttgttgaccagccaggtgccggactccttgacgatatccatctcggcaggcgtcacgtggatgcagtggccgagcatggtgtcgggacccagcagattgtgctgcagcaggcgctcgacggggctgatgccaccgcggttgaggcgggagtcccacacgtcattcatgccctcgcacacatggatgtggaagccggtcaggccgttgttggcctcggccatcttatccatggtctcgtccgacagcgtaaaggtggcgtgaccgccaaacatggcggcaatcatgtggttgtcgttatcgcgacgctccttggcggcccactgggcaaactcggcgttctcggcaatggcctggtcgcatttttcctgaccgcggcggtcggagacctcgtagcacaggcacgaacgcatgcccagctcctgagctgcatccttaatggtaaagaggctgcctgggatctcgcagaagctcgcgtggtgatcgaagatcgtggtgacgccatcgcggatggagtccaagatcgtggcataggcgctggccttggtgccgtcgagcgtcaggttgtcgtcgatcttccaccactgctgctcaagattctccaggaagttggtggggttgcagcccttaatggcaaggccgcgggccagacccgagtagatgtgggtgtggcagttgatgagtccgggcatgatgaggttgccccgggcgtcgacgtactcggcatccgggtacttggctttgagctcgcactcggggcccacttcgacgatcgtatctccgtcaatggcgaccgcaccgttggggatgaacggggcctgagcgttgcgggtaaagacggaaccgttagcgaccagaagcatggatgctcccttcgacatcagaggcggggtttgacacctctgacatggcggagtgcgaagcgccggcctacaccggaaacgggccctctcccgtcaacgcttcaccaaagggacaaaccctttgaagtgcggcttggcgccgcatgacgtcggcggacgaggcgatgcgcccgccgacgaatagcaccgatattggttacttcttgctctcgggcaagaccagatccacggcagcgtccttggcggcatcgatgtgctgagccacgactggcgtctgcggaaggatcaggttaaggacaatggccatgatggcggtgggggttacggcattggagccgatgacggtggacacccaggcgggcatgccctcgccggcaaggcaaccgctggccatccaaatacccaggccaaagacaacggaggtaccgacgatggtggtagtgcgctgcgtgaggccctcgcgggtgaacatgcgcacgccgttcatagtgatggtgccaaagacgccgacggtcgcgccgccgatgacgggctgcgggatagcggaaaggacagcagagagctgcgggaacagaccggcgatggcaaagacggccgcgatgatcacaaagacccacttgttgacgaccttgttggagcagatgatgcccacgttctggccaagggcgctggtgggaagaccgcccagcaggccgccgaccatagaggtgagaccctgggacacgatagcgccggagagctcgcgctcggtgggcatacggtcgatggagcccaggcaggcggcggagacgtcaccgataacctggatggcaaccatggggaacacgacggcgagggtaatgcagacctcgggatcaaactcgagcgcatagggcatgagcttgggaagggcgaagacctgagcggtggcaacgctggagaagtcgatcatgccaaagggaatcgaaacgatcatgccaacgatcatgccaaagaacacggatcccagcttgagcgtgcccttgccaaagttggcgagcgcaaagaccacggcgaaggtgataagagcgacgcaccaggcctgcggagtgccccacagcggcgtgcccatgccaccggccatgtacttgacggccgtgggatagagagagacgccaatggagaagatgaccgtaccggtcacgacaggcgggaacagccacttaatcttgctgtaggccagaccaaagaggaccgcgacggcgccgccgacgatctctccgcccagcagagcgccaaagctaaagcccgaggcacccatggcctggagggccgggaggaacgcgaacgaaacgcccatgacgatgggcaggccgccgccgatgcgacggaagggagcgaaggcctgaagggccgtgtcgattgccgaaagaatgagcgcgacctggatgatgtcggtgctctgctggctattaaatccgtagacgccggccatgatgaccgccggggtaatgatgccggcaaacgatgccagcacgtgctgaagggcacacgggatcatttccttaacgggaggcatgccttcacgagtgaacagggcttcagtgccgttcgtaaccgtctcctgggtcatttgaccaccaatcctcgaaatagttgttttcgcatctaacgctctattgtgacgcagtgcggggttgaggttgtgccttcgttggatatcgtattaaagatgattctcattctcaataataattttttgttatcagactattcttgagctgagacaatgcatttccgcaggtcaggaaattgtctggtcaaaataacatctaacttttcttttggtcgaccgtttaccgccgaattcctaccgctcgtctgtattacgcaatgtacctgcgaatatacgagatgacgaacagcgtgttaccatgagaaaaaattgttatgaacattttcgatttcaccccaaggagttgcccgtgaacgagaccgtacgtcgctttttgccgatggtcgatttcctggagcagatactcggtaagaacagcgaaatcgtgctgcacgatttctcggatcccgaccacgccatcgtcgatattcgcaacggcatcgtgagcggtcgcaaggtcggcggtcccgccaccgatctggcactcaagatcatgcacgacgccaagtatcgcgacctgccgtttattacgggctatgaggggcgcggtgccagcggcaagacgttggagtcggcgacgtactttatccgcgagaatgacgagatcgtcggtatgctctgcgtcaacaccgacctctcgactgtgcgctccatcaacgccatggcgcagcagctcatgtcgtgcttcgacgctgtgccaaggcaggcggagcctgcgtctatcgaagtcgaaagtctttcggagtctacacaggagctcatcgaccgcagcattgccgagttgctgagcgcgcgcgggctggatgtagcgtcacttggtcagagcgaccgcgtggacgtcattcgccacctcaacggcaacggggtgttcatgctcaagggtgccgtggcctgcgccgcaaccgcgctgggcatctcggagcccagcgtctaccgctacctgcaaaaagttcgcaaggaaggctaacaagcaaaatggagcgcgggcagtctttttgggacggggctattttagctaccccctctctgcccgtgatttcgatgagccgcaagtaaaaacaatcctgcatgtaggggtagctaaaatagccccgtcccaaaaagactgcccctggtggattcacaagtgatccgtcgctcgacaaaaagaaccctgcagctcgcacgcgctgcagggttcttttttgcatgtcatgtcttgcttcgcctacatcttagagggcggcggcgacctcgatctcgaccagaccgccggccggaagggcggcaacctggaaagcgctgcgcgcggggaacggagcctcgaacttggaagcgtagatctcgttcacggcagcgaagtcggcgatgtcggccaggtagaccgtggtcttgacgacatcggcaaaggtggcgccggcagcggtcagcagcgcctcgacgttagcaagggactgcttagcctgggcctcgacgccctcgggcatcttgccggttgcggggtcgatgcccagctggccggacaggaacaccatgttgccggtctggatgccgggggaatacgggccgatggctgcgggtgcgttatcggaagacacgacggtcttgctcatgtttttctccttacgatcagatagagagcgtgagcgcggcgttcgcaccgggaggcacaattcggtctgaacaccgcgcttgatttgggatagtactcaaggttcccgcgcgatgcaagattattatcacgttacgagaataatttatcgcccaacggcgcctgtcggccgctgaacggcacgaccgaacggtgaagctcaaaatgatccgttcccctccgtcccctatggatcacctgatccgatggggacggaggggaacggatcatttttgctggaagggctgctgaagactttatcctgcttgggccacaggactcgtccgccgcaacagcaccactatacttttgtttatctgagcattttgaaaggcaggatatgaccgcaaccgccagccgaaccaccaaccgcagacccgagcttttagcgcccgccggagggccagagccctttgccgccgcactcgccgccggggcagacgccatctactgcggcatgggcagcttcaacgcccgtcgcaaggccaccaactttaccgacgaggcctttgagcaagcctgccgagccgcacatctagccgggtcgcgcgtctacgtcacggtcaacatcgtcatcaagcagtccgagatgggcgatgcgctgcaactcatccatcgctgctccatgctgggcgccgacgccttcatcatccaggactggggcctgttctttgaggtcaagcgcaccatgcccggcatcgagacgcatatctcgacccaggcgaacatccatgacgaccgcggaaccctttggtgccgcgagcagggcgccgaccgcgttaccttgtcgcgcgagctctccatcgacgagattgccgccattcacggtgccgcacccgatgtcgacctcgaggtctttagccatggtgccatctgcttttgctactcgggcctatgcctgctttcgagctttgccatggcgggacgatcggccaaccgtggcatgtgcgcccagccctgccgcctgccctacgagctgatcgacgagaacggtcgcgcgctctcccccgccggccgcgagcgtgcgctatgcccgcgtgacaccaacacctcacagcttgttcgtcgtctgtatgatgccggcgccgcgtcgctcaagctcgagggccgcatgaaggcgcccgattacgtgtactccatcgtcgatgtgtatcgtcacgaaattgacgacatgctatccggagccaccgttgccaaggacgaggaagccgcccgccagcgccagctcaagcgctgcttcaaccgcgactttacgcacgcctatcaggacggcacctcgggcgacgagatgatgagctatgagcgttccaacaaccgcggccagatcgtgggcacagtgctaggcagccgcccggccaaccgcgatgtgcgcggcctcaagcccgacgaccgccgtcgccgcgccgccatcgcccgcattgagctgtttgagcccgtgggcaagggcgacctgctggagcttcgccacgacgacgaattcgaccagttcctgaccaccattgccgccgatgatgccgccgccggtgacatcatcgaatgtcgcgtgccccgcagcatgcccgagggctgccgcgtccgcgtgattcgcagtcagcgtgccaccgacgccgccggcgccgcgctcaagcgcgacgtgctgcgacgccgagctgttgatgtgtctgtcgtggcgcgcctgggcgagccgtttaccgtcacactcacctgctgtgacaaccccgcgctcaccgccaccgccacaggcttcaccgtcgaggccgccaagacccgcgccgtcgaggcggcagacctggttgagcatgtaggccgcatgggttcctcgccctttgaggcagcgagctttgacgtttcgctcgacgccggctgcggtatgggcttctccgccgtgcacaaggtgcgcgccgctgcctgtaaagcattggaggaggccattctgtcgccgtacgaggaacgcgcgaaaacgttcgagctgccggtgctcgacaaatgtacgcgcgccatgcccgagcattaccgtgacgagccgcaaatctgcgccgccgtcaccacgctcgaagccgccgaggcagctcgtgccgagggggccgcgcgcatctacatgaccaccgacgcgctcgaggccgccgggctctcccctgccgatgcatttgggcagggtatcgtgcccatactcgacgaggtctgccgcgccgttgaccacgagcgcgtcgatccctggatcaatgccggagccaccgtcgccgtcggcaatatctccgagctcgccgtagccgcgcaggccggcgccacggtcgagattcgctcttgcttgccggtgcacaacacgccctgcatggaggcgcttgccgagcgcggagccggtgcgttttggctctcgcccgagatcacgctcgacgagattatctcgctcggcgccgccgcgcccgcggctctgggcatcaccgtctttggccgcccgcgcgttatgacaagcgagcattgcattctgcaggttgccaacggctgcatccacgattgtgtcaactgccgtctgcgtgcccgcaagctctcgctcaagaatatcgacggaaaggtcatgcccgtccgcaccgacatccacggccgctctcgcctgtacgatgcctaccccatcgacctcacgccgcaggttcctcagctgctcgatgccggcgtgcgtcgtctcatggtggacggaacgctgctcgaggcggatgaggtgggtcgtgccgtcgcccgcgtccgtcgcgccgtcgaggcggctcaagccggccgaaagcccgccgcccgcctgcgcggcgccacctcgggctgcatgtttgtgggaatcagctaaccgaaaggcttacacgtgaacgaagaacctcaagtcctctactgcgacgcctggctcatggccatcgacaagcccgccggcatgatcgtccacggcgacggcaccggcgagcgcacgctcaccgactacgccagcgacctgctgctggcgatgggcgacggctttgccgcgaccgacatgcagccgctcaaccgcctggaccgcgacaccaccggcgtagtgctgttttcgctcgacaagcagacgcagcccgcctttgaccagatggtcatcgaccacgctttcgaaaagcactacctggcgctcgccgagggcaagatcgactggaacgaaaagctcatcgacaagcccatcgcccgcgaccgtcacgacagccgaaagatgcgcgtcggcgccagcggcaagccgtctctaacgcgcgtgaaggtgctcaagcgccttaagagccgtcgtggcctgcccacgcgctcgtatatcgatgtcgagctgctcaccggccgcaagcaccaaatccgtgtgcacctggcaagcgagcgtcatcccctggttggcgacgacctgtacggaacgccgcgcccctgcggcctgatgctccatgcccacagcgtgtccttcacgcatcccgtaaccgatgagcacatccacatcgaagccccctgcccctgggagccctaaaacctgccaaaaaagggacagtcacctttgtggcgggtttgccgcaatggctcagccgcggtcccaaaacgtctcgatctgtaacagttagaacccattttccggtctatctgttacagatcgagatattcgaatcccccttaagggaaaatctcaatgtgtaacaataactcggcaaaatcggtcccagatgttaccgattgagacaaagggaccgcgcggttcggaagtatctcaatctgtaacatctaacccacttttaacggtccagttgttacagatttagacaaaacggcagacaacaaaagcggcatcgcccatcgagggtgttgccgcttttctattgaggaacctaaatggttttgaccttgccctgtcgctagaccgtgatgacgttatccattgtctggtacttggcgggcacctcacctgcggtaataatcgttgcgtcgcggaagtccgcgtacttaacgggcgccaccatgccaaatttactggcgtccgagattacgaagcgtttggcggtatggcgcatcgagatacgcttgacctgcgcttcctcgatatccggtgtggtgagaccttgctcggcggcgatgccattggaaccccaaaagccgcagttgaagttatagcggtccagagttgccaaggcatcgggaccgacgagtgcctcggtctcgggcttgagctcgccgcctagcaccacggtgcgcataccacgcagggcgagatgctgagcatggagcacggaatcggtcacataggtgacaccctcaaggcgcggaagatgctcgatgagcttgagggtcgtggagcccgaatcgatatacacaaagctatcgggctccaccagagccgcggcacgggcgcagatgcgctccttgtcatcgttatggagatcactgcgctcgctgatcgtcaggtcgcgcgtcacgtgcgcacgctccagactcgtcgcgcctccgtgcaccttggcgatacggtgtgcacggtcgagcgcctgcaggtcgcgccgaatggtagacgccgtcacgcccagggcttcagcaagctccggcacggtaaccgagccggcctgctgcaccatcgtcacgatcgcgttgagcctatcttccgcaagcatcgcttactcctcctcggggtacacgactccccagtcggcgcggagcttggtcatcagctccataacatcagaagcatagcccagaagctcgcgcttcgaatcatcgccggcaacggccttctccaggtcggccatctcgtagcacagagcgtatgcctcggtgccagcgtggacctcctcacggtgaccgtccgcagtccacacgatggtcgcatgatcggcacgcggatactcgttgacctcgatatagcacttatcgaagctgatgaccgagcgcttgggctgcttggagtggagcgtaaggctcacaacgcccagctgctgctcagcattacggcagacaatgccacccgcgacgtcaacgccagtctcgcaggtattgcccagagacacgacctcggctggctggctggccataaacaggcgcatgacggacagggcatacacgccaatgtcgagcatggcgccgccggcaaggctgcggttgtagaagcggttggtcaggtcgccgtactccttatagctgccaaagttgagctgggcgaggttcatgcggccaaagtcgcccgcatccatgcgacggcgcagctcctgatacagcggcatgtggagcaccgtggtagcatccataaggaccacgttatgctcgtcggcgatggtacgggcctcgtcgagctcggcagagttgagggtaatggccttctcgcagagcacgtgcttgccggcggccagcgcggcacgcagataggtgatatgcgtgttgtgcggcgtggtgatatagacggcgtcgatatccggatcggcatagagatcctcgaccgtgtcgtacaccttctcgacgccatactgctcggcaaaagcctgcgccttggaaagcgtgcggtttgcaacgccagcgagcttgcggccggcaagtgcgagggactgagccatctggttggcgataacgccgcagccgatcacggcccaacggagctcgggagccgtaaagaggtcatcggggaacggcttgtcttggaccgatgcgaacgctgccttagcggctgccgcagcatcgagcggagcctgtttggaatctgccatcatgtgcctcctgtgtcatagaacgtcttgcatttctgacagctctatattcgcataattacgcgcgtatgtgcgtactttagcgcgtattaccgcgaaacggtcattattcgaccgtaaacggtgcatttctgcgcacgttcacgtaattctacgcagactaatgcgcagaaacgcgcgccatcagatggacagaaagacggaagaatcggatcatctgactccaaatgactgtcccaaactgccgacacgaagggaacgtccccggttgccggcacataggaacgttcctttcctgccacatcgatccatgcgccataccgccacagacccgacgtaagttgcggtgaaatagggactgtttagccccctagagcccccaatcagtccctatttcaccgcaacttagttgaagaccgtccccatcaactagccggttaagaacgtcctcaacggccactcatttaagtctgtccccaatgagtagggatagaaaaaggcccgggtgccgtggcatccgggcctttgctagcaacttgatgttgcgggcagcttagaacttgtggccgcacttcttgcagacgcgcagcttgttcttgccgtccttctcgtgaccgacgcgggtaaccttaccgcactcggggcaaacgagattgacgttggaggcgtcgatgggagcctcctgcgaaacgatgccgccctgctggttggcagcgttgggcttgacggccttcttgacgaccgaaacgccctcgacaacgaccttgttctcggcggggagagcacgcaggataacgccttgcttgccacgatccttaccagagagaacctggaccttatcgcccttcttgatatacatatatctcccctaactacagggtctcgggagcgagcgagacgatcttcatgtacttcttgtcacgaagctcgcgagcgacaggcccgaagatacgggtgccgacgggcgaaccatcgttgttgatgacaacgcaagcgttctcatcaaagcgaatgtaggagccatccttgcggcggatctccttaacggtgcgaacgacgacgcaacggacaacgtccttcttcttgacgttggcgccaggggtagcctcctggacagcaccgatgaacacatcgccgatgcctgcataacgacgcttggaaccgccaagcaccttgatgcagcgaatcttgcgagcgccggagttgtcggcgacgttcagcatggtttgcatctgaatcatggtagatgttcctccgaactaagaaccgaagagaggtgcgcagcctttaggcggcctgtggtatgcaaaccaggcatacgcacatcttcggaaacgtacaagtcgtaagagcgactgcttatttagcgcgctcgacgacctcgatgaggcgccaacgcttcatcttggacataggacgggtctccataacgcggacggtatcgcccacgccagccgtgcactcctcgtcgtgagcgtgcagcttcttggagctggtcatcatcttgccgtacttggggtgacgcttgcgctcggtgatggtgacgacaatggtcttggcaccggagacggaggtaacgacacccgtacggaccttacgcgagttacgcgaatcagtcatgttctctccttaggtcctactcggcgacagcggacttctccgctgcgatctcgcgggcgcgctgctccgtgaggacgcgagcgatgtccttcttcacggtgttgacgcgagcggtgttgtccagctggctggtggccatctggaaacgaaggttaaagagctcggcgcgcatttccttcagcttctcaacgagctgagcgtccgagagctcacgaatctctgcgggcttcattagttctcctccttggcggcggcggcgtcctcagcagcccacttggcctcgagagcggcctcctcagccatctccttctcgatgcgctgctcagcgttcttagcagcaacaatcttggtcttgatgggaagcttgtgctgtgcaagacgcagagcctcgcgagcgacctcctcgggcacgcccttgacctcgaacatgatgcggccgggcttgacgacggccacccactcctcggggttacccttaccagaacccatgcgagtctcagcaggcttcttggtgatgggcttatcggggaagatcgtgatgtacacacgaccgccacgcttcatgtagcgggtcatggcaatacgagcggcctcgatctgacggttggtgatccaatgggcctcgagagcctggataccaaactcgccgaaatgcagctcggtattacccttggcctggcccttcatggagccacgctgcaccttgcggtgaagaatacgcttaggggcaagcactactgacccctcctctcggagttacgacgacgaggacgggaagagccctcgagtgcagggttgggaacaggctggcccgggagcttctcgcccaggtagatccagaccttcacgccgcaagcgcccatggtggtgctggcgacagccgtgccgtagtcgatcttggcacggagggtgtgcagaggcacgcgaccctcgcggtaccactcacgacggcccatctcggcaccgccgagacgaccggagcactggatacggatgcccttagcgccggccttgcgggcggactggacagccttgcgcatagcgcgacggaaggcaacgcggccctcgagctgctcagcaatggactgagcaacgaggttggcgtcgagctcggggcgcttgatctcgacaacgtcgacggagagctggcccttggagacgccagcgaccttctcgagctcggtgcggagggtatcgatctcggcacccttcttaccgatgacaacgccggggcgagcggtgaggatgatgaccttcaccttgtcgccagcgcgctcgatctcgacgcgggagacagctgcgcgggaaagacgcttctcgaggtacttgcggatctcgagatcgttaccgagggtcttagcgtaatccttctctgcgaaccagcgggagcgccagttctcggtaatgccaagacggaagccggtggggtagactttctgacccatacagctttacgcctcctttcgaggagcaacgacgacggtgatgtgggaagtacgcttcagaatgcgagaagcggaacccttggcgcggggacggatgcgcttaagcgtcggaccctcgtcaacataggcagcggcgacaaccaggttgtcggcacgcagaccgttgttgttctcggcgttcgcaacggcggaacggagaaccttctcgacatccacggcgacggcgcggtcgcagaagtggaggatgtcgaaggcctgagcgacaggcttgcggcggatcagatcgaccaccaggcgggccttgctgggggaaacacgcacgtacttagcgacggcgcgaacctcggtggcctcagtttcaatagacttagttgccatttacggttaaccccctatttggccttgtggccacggaacgtacgagtcggcgcgaactcgccgagcttgtgaccaaccatggactcggtaacatacacgggcacatgcttgcggccgtcgtggacggcgatggtgtgaccaaccatctcggggaagatggtggacgcgcgggaccaggtcttcacgacgtccttcttgccagcctcgttcatcgcggtgatacgcgagagaaggcgagtctccacgaacgggccctttttgagacttctgctcataagtgctttctcctaaaactcggtatccgaaattacttcttacggcgacgaatgatgtgctggttcgagaccttcttcttcttgcgcgtacgaaggcccttcgtcggcttaccccagggggtaacggagggacgaccagaggtgtggttcttgccctcgccaccgccgtgcgggtggtcgacagggttcatgacggtaccgcggacggtcgggcgcacgttcatgtgacgcttacggccggccttgccgatgacgatgttggcgtgatcggcgttgccgacctcaccgacggtggcgcggcaggtaacgaggatgcggcgcatctcggaggaaggcatacggacgatagcgtacttgccctccttacccatcagctggcaggagttaccggcggaacgggcgatagcagcgcccttgcccggctggaactcgacagcgtggatgagcgtaccgacggggatgtcggcgaggggcagagcgttgcccggcttgatgtcggcgtcagaaccagacatgatggtctgaccgacctcgaggcccttgggggccaggatgtaacgcttctcaccgtcagcatagtgcagcagagcgatgcgagcggaacggttcggatcgtactcgatcgtggcaaccttggcgggcacgccgtccttgttgcgcttgaagtcgattacgcggtaacgacgcttcacgccgccgccctggtggcgggtggtgatgcggccgttgttgttacgaccggccttcttgggcaggggctcgagaagagacttctcgggcttggtgcaggtgatctcggagaagtcggagatcgtctgccaacgcctaccagcggaggtcggcttaaggtgctttacagccattacaatccctttcaataggaatccgttagccatcgcagacagggattcgaggttctgcctcgggtgcgatgacaccggacgtatacacggttccgggcgtgtccattttatacgcccaaaaccttgagctctcgcctcccctatttgggaggcatgagctcactcaacagcagcgagtcttaggcctggttgccaaagacctcgatggtgtcgccctcggccagcgtgacgatggccttcttccaagtacgggtcttgccggcgacatagcgcacgcgcttggtcttgggcttgaccgtcagggtgttcacgcgaacgaccttgacgccgaagatctcctcgacagcgtccttgatctgatacttgttagcatccttggcgacctcgaacgtgtacttgttcagctccatgccggagaaggaacgctcggacacgatcggacggatgatgatctcgtgggcggtcatttatgcaagcacctccccgaagtgagcggcgatgtcggcgggcatcagcacggcgttgttgttgacgagatcgtaggtgttggcctcgtcggcagtgatgatgaacgtcttgggaatgttgcggaacgacaggtaggcgttgacgtcctcatcgcgaacgatgatggtcagacgcttgccctcaaggccgagagccttgagcatggcgacggcagccttggtggaaggcttctcgaagccgtagtcgtcgacgagcacgagctcgccatcggccagcttggcggacagcgcggagcgcatagccagcttgacctccttgttgttcatacgcttagcgtaggaacggggcttgggggcgaagacgacgccaccgtgacgccactgggcagcacggatggaaccctggcgggcacggccggtgcccttctgacgccaaggcttcttgccgccaccggaaacctcagagcggcccttagcggactgggtgccctgacgccaagaggccatctggcacttgacgatgtggtgcataacgtggatgttcggctcgatgccgtacacctcagcggcgagctcggcctcggcgaccttcttgccctcgctgttctttacttcaaactttgccatttaagtgttctccttggtatgacgctgggctaaatgggctgggcccttaggccatacggatggcgacgagaccattcttggcacccgggacagcgcccttgaccaagatgaggttctgctcggcatcgatgcggacaacggaaaggttcttgacggtaacgcgctcgttacccatgtgaccggccatcttgacgcccttgaggacgcgcgcaggataggcgcactgaccgatagaaccggggtgacgctggaagtgagagccatgcgtcataggaccgcggcgctgaccccagcgcttgatgcgaccctggaagcccttacccttggaggtaccgatgacgtcgaccttctcgacatcagcgaaatcagcgacggtgacgacctcgccgaccttgtgctcctcgccgttctcgacgcggacctcacgaaggaagcggacaggctcgacgccagccttggcgaagtgaccagccatgggcttgttcacgttcttggccttgatgtcgccgaaaccgatctggacggcgtcatagccgtcggttgcctgagttttaacctgcgagacagcgcaggggccagcctggatgaccgtgacgggaacgacgttgtcgtcctcgtcccaaacctgggtcatgccaatcttgcggccgagaatcatgctgatcaagatatgatcccaactctcgcgtggtcttgggacaatgcgtacaccaccgagcgtacgcccctagaggaccactacttacacgacgtgctccccagtcttgtattacgcccggactacctgacaaccctattaagcaggcattttgtccagccagaatactcccctggtttcacacagctgtttagtatacacggctgcgggcgtatccatcgagattcatatttcactcacattgtttacgcaggtaaagtgcgtggatggctcccgagcacggcggagggccggagaaatatattaaggtccctgctctacagtcctgcgcaagacggagagcacattaagtgctctcctttgcgtgcggaactcgcgatgaccttaatatatttctccggccctccgccgtgctcgggagacgacacgttgatgtctgcttaactctgctcgctcaggctaatgactttgttgggggtccactatttgctggagggtgaacttgcattgcattggctcgccctctacttgtggctccgcctcatcaaaatcgaagatcatgatggcgcagttggggagttttgttgggagctcgaagccctctggggctgcagccttgatgaattggcggctggcactgccgtggcttactgctaggagggtttcggtgtccttagcgcccatgagattggtgagggtgcccaccatgcgctcctgcagggcatggcttccttctccgctaaatgggataaggtcctcgccggggtcccagacgtcggtgggaagggcatcgtgggggccttcttcgaaggtgccgtagctgcgctcgatgatgccttcgcagggctcgactgcggcgtccggaccgaggagttcgcatgcgacgagactcgccgtgtccatggctcggcctaagggtgatgagaccactttgtcggggacgacgccgtgggtcttgagccatgcggctgccattcccgcttgtttgcggcccaggtcggtcaacggagaatcgcagtggccctggaccagctttttaacgttgaattccgtctgaccgtggcggagtagatatagacgcttcatgttctccccttctgtataccttgctttgccggcacagccctgctcgtgggcatggccgacatagtcctcgtcgatcgtaatcttggcgaccgacttgggatattccgattcgacccgttgtgccagcgcgtgccttacgtcttcggcgctcatgtgcagatccgagggacgcacgcagtcaaaaatcacattggtgtgcgtagggcccggcacgcaacgcaaatcgtgaatcgaaaggcggctatcgatctcttgagccatagcgttgatgcataaacgcatgctcgccagcttggggtcatcggtcacgatgggatcgtagtgaagcgtgacgatcatgccgtcttcgttcctaaacgcctgctcgatgttatcgagcgtgtcgtgactttccatcgggctggcctcggctgccatctcggcgtgagcgcttgcgaacttcctgcccgggccgtagtcgtgaaccatcagatcgtgaacgcccaaaacgccggggtagctcatgatcttgctgcggatatgctcgacgagcttaggatcgggcgtctggcccaaaagcgggctcaccgtatcttggataagctcaaagccgctccagccaatataggcgccaacggcaaggccgacccacgcgtcaagattgatgtgcgtcacctgcgaaacaattgcgcacgccagcacggcgcccgtggcaaggacatcgttcttggaatcttgcgcggtcgcatgcagcgtctcggactcaatgcgatcgccgagcttttggttgagggccgccatccagagctttacgaccatcgaaagcactagaactgccaccagggcaagcgagaactcgacgggttcggggtggatgacgcgctcgaccgaggacttcaccagctcaacgccaatcagcagcacgagcgccgccacgaccaatcccgagagatactcatagcgaccgtggccgtaaggatgctcggggtcggccggcttgctcgccagcttaaagcccagcacgctcacgatattcgagctggcatcggacaggttgttcatggcatccgccacaatcgaaaccgatcccgaaaccacaccaattgcgcccttcgcagcacaaagcgcaacattggcgacaatacacaccatgcccgctaacgtgcccacacgcgcacgatcgccctgcgcgcgcctaacaatccactcgaccatctacatccgcccccacggtactacttatatatctattgctcaaacggattgtagtgtagccactttgtcctccagatacaaaaaggccgcagcccacacgagccacggccttggaacacgacaaagggatcgtccttttgtcgcacaggtttatgcgcttacttcagcagcgctcgccactgtttcgggcgaatcggctccgtcccccgtcgcctgccccttcgccggcaccacgccaaagcagtagctcagcgccgcagacaccacaaaagccgtgccgccggcaacgcagcaccacagcaggttcgaaaaaccacctgtggcaaaaccaatgaccatgaggacattcgtcatgccgatggtataggccgtaacgtggcccacggccgcaacaaggcctccgacggcgccgccaatggccatgcacgtcaggcacctgccatatttaaaaccgcatccgtacagcgccggctcgcttacgccgccaagaacacccgagattgaatggcccagcatgagcgtcttctcgtccttatccgcaacgcggagcgacgcgccaaagggcatgccccaaacggcgaacgttgccatcgtcgcagcgatcaggatgcacgaatccgttcccacactcataaactgcgcataggcgagcgataggacgacgttgctgacgcccgcgatcttaaggaactcccagcccgcggcaagccccatgagcgtgagcagcgatacgatgccaccggaattgccaagcataaacataagctggcccaacagcatgcccaaatagctaccagccggcgccgtaatacacagcgaaaccggaaccataacaagcatggtcgcaaacggaacaaacgaaaacgccacggccttagggataatgcgccgaaagaaacactccactcgccatagcacgggcaccgagatgagaaccggaataacagtcgtcgtgtaatcgttgaccggcgcgggaagcaggccatacacggaagtcatcgatgcccccgtcgtcgatgcggtatcgacgagcttaagcagatcgggcgcaatcaatacgccgcccagcatcatgcccagctgctccgagcaaccgagctggcgggcggccgcccaaccaagataaacgggcaaaaagtagtagccggcgttatagagccaactgtagaacaggcgatagatttcggaatcggcagaccacaggcccagtatgccttcgcccataatgacggcgacggtgcggaacaacgccgcgcagacaataaacggcagcgccgacatcatgcttttggacagatagtccaccacggccatggcgtttgatgagaccgtcgttgtaaacgaggtgttagaaacttgtgacacaggaaccctttcccaatgtgacatgcggactgtccctttgtcacatcgtgcggtactgaccgattgcgcggtactttcggtagcggaggtttgtgagggtcgcgtcgtcgagccgcccaagcgtatcgaaggcggcaaatgccgaggacatgacggcaccggcgatctcctcatgagacaggcccctatcgtcaacgatgccgtcgatgatgccgagcgccaacagatcgggggccgtgagtttcagcgcctcggcggcctcattcgcgcgctcggtatccttccacaggatcgacgcgcaggcctcggggctcacgaccgaataggccgagctcgagagcatcaggatgcggtcggccacggacagcgccagcgcgccaccagagccgccctcgcctgtcaccaccgagacaatcggcgtcttaaggccgctcatctccataaggttctgggcaatcgcctcgccctggccgcgctcctcggcaccgatgccacagaacgcgcccgaagtatcgaccaggcacagaaccggtcgaccaaacttttcggcttggcgcataaggcgacgcgccttacggtagccctcgggatgtgccatgccaaagttgcggcgcatacgctctttggtcgtggtgccgcgctcgatggcgatgaccgttacggggcgtccgtctttccagccaatgccagccaccacagcggcgtcgtcgccaaagtaacggtcgccgtgcagctccacaaatccatccaggcccagcgagatcatctcacccgccgtggcgcgatctgccgagcgggtctgcttgacaatctcgagcgcggtttttggtgccggcgagcgcttaaacaagtgtcccagctttttgccgcggcgacccgcatgcacaatctcatgcggtgcccccaggccgggcgcatgcccttcgtgcagcgccaacagctcgcctaccgtgagcgcaatctcgccacgcggaacaacggcatcgcaaaagccgtgctccagcaaaaactcggagcgctggaatcccttgggcagacgcttgtgcatgttctgctcgatcacgcgcgggccggcaaatgccgtcagggcatcgggctcggccaggataatgtcaccctccatggcaaagctcgcggttacacctccggtcgtggggtcggtgagcaccgtgatatacaggccgcccgcctcgctgtggcacctaaccgccgcagaaatcttggccatctgcataagcgaggtcacgccctcttgcatgcgcgcaccgcccgaaacggtaaagccgacaactggcaatcccagctcggtcgcacgctcaaatgcgcgacagatcttctcgcccactacggaacccatcgagcccatcataaagttggcgtccataaagaagagcgccgtatcgcaaccgcagattttgcccctgccgcacacaacggcatcgcgctcgcccgaacgctcgcttacgctcttgagcttgtcggcatagccgggaaacgagaggaagtcctccgacgccagattggcatcccattcctcaaacgtgccctcgtcgaccgtcatgcgcatgcgcgcgcgaccgctcacacgaaagtgtttgccgcaacgagggcagacctccaggttatcgtgcaggcgtgcctcatcgatcacgcgacggcactccgggcacttgataaacacgtggcgcgcgggaaactcggcgcacgactcggttatcggcccctcaaggacattgaccgtcttcgcttttctattcatcagcatagagatgccccatcagatcggtgtgatacatgcccgacaagaactcgtcgtttgccagcacgtcgagctgaagctcgctgttttcgctcacgccctcaatcacgagctcgcccagggccgagcgcatcttgcgaatggcgccgtcacgcgtgggcgcacacacgatgagcttgccgagcatggagtcgtagtacggcggaactgtcgcaccggtgaacatggccgaatcccagcgcacgcgcggaccacccggtacgcgcaacgcggtgaccgttccgcatgacggcagaaagtccggcgtttcggcattgatgcggcactccatggcatggttgcggaccggcatgtcctcctgctcaaagggcagaggctggccggccgccacgcgcagctgccacttgaccaagtcggtatcggtcacaaactccgtaactggatgctccacctgcaagcgcgtgttcatttccataaagtagaaattgccgtcgtccgaatacaggaactcgatggtaccggccccttcgtagccgacggcacgggccaggtcgcgcgcggccttgtgcatgtgcgcgcgaatatcgtcgtgtccgtcgaggcacggtgcggggctctcctcgatcagcttttggttgcggcgctgcaccgagcactcgcgctcgccgagcgaaaacacatggccctgcttatcggccataatctgcacttcgacgtggtgcgccggcgcgacgaacttctccatgtagcactcgccgtcgccaaaaacggcctcgccctcggcacgtgcttcaataaaggcctttgccgcatcttccacgcgctcgaccttgcgaataccgcggccgccaccgcccgcgcgcgccttaataagcacggggcagccaatgcgctcggcctcggccgttgcctcctcggggcttttgagcaaatcgcagcccggcacgatgggcacgcccgccgcggcagccgttcgacgtgcggcatccttgtcgcccatgctgtcgatcacctcggccgaaggaccgacaaacgccagaccgtacttgtcgcagtcgcgcacgaagctcgccttctcggaaaagaaaccgtagccaggatggatcgccttagcccccgactttacggcacaggtgagcacggcatcgtcgttgaggtagctctcggcaagacgcggaccgccgatgcaatacgcctcgtcggcaagctgcacgtgcagcgcgtccgcatcggccgtggagtagacggcgacggtcttgatgcccatatcgcggcacgcgcggataacacggaccgcgacctcgccgcggttggcgatgagcactttgtcgaacatgaagccttccttaactttcgtgcatgagtgcaaaggacatatcggcgcggcaacacacctcgccgttgacgctcgcggtgcccgtcgcaaaccggaacggcccgcgcgcacgcgtgatggagcacaccagatcaaccgtgtcgcccgggcgcaccggacgcttaaagcgcactttgtccagactggtgtagaacggcgtcgcgccgcgcgcctcctcatcgcccatcagcagcacgcagcagttctgggcgagcatctcgcactgaatcacgccggggacgaccgggtttcccggaaaatgcccctgcaaaaagtactcgtcgcccgtaatcgtgatcttgccgtgggcctcgtcgcccactagctcggcttcgtcgagcaaaagcatcggctcacgatgcggcaacagcttcttgagctcttctttgttcatggatatcacctatccgatcctcatgaggcagctgccaaactccacgaggtcgccgtcggccacgcagatctcgagcacctcgccatccgcctctgccgtcacctcgttgagaaccttcatggcctcgataatgcagagggtctcgccggctttgaccttggagcccacgtgcacaaacggctcgtcgcccggtgccggggcagcatagaaaacgccgaccatgggagcggtcacctcggtgcccttaggctccggcgcggcggcaggcgcctgcgcagcgggctccggtgcgccaggcacgactgcgggagccgcaaccggagcagccatggcactcggcataggcatgggcacggcaaccggctgtgcggcgctcgcgcgctcgagttcaaccgcggtgccatcgggctcctcaacgcgtacacgcgtgaggccgcggtcctccataacatcggctatctcggcaagtcttttggaatccatgctctagctcctcgtatatctacgcagcgcgatggcagcgttgtgtccgccaaagcccagattggtcgaaagcgcccaggtaaggtcggcgcgaaccgctcgattgggcgtgtaatcaagatcgcaggcgggatcgggcgtgtggtagttaatggtcgggggcaccacgccctgctcgagcgccatggcgcaggccatgacctcgatggcgcccgtggcgccgatcatgtggccggtcatcgacttggtcgacgagacgtgcgcggcgcgtgccgcgtcctcgccgagcgcacgctttatgcccgccgtctcggacgaatcgttgagcttggtcgaggtgccgtgagcgttgatgtagaggccctcggaaggcttaacgtcgccctcagccaccgccagcgatatcgcacgggcaatgccggcagcctcgggatcggggctcgtgatgtgataggcatcatcggtgttgccgtagcccacgacctcggcataaatgtgcgcaccgcgcgcctgcgcatgctccatgctctcgagaaccagcacgcaggcgccctcgcccatcacaaagccgtcgcggtctgcatcgaacggacggcaagccgtcgacgggtcaggattagtggtgagagcacggcaggatgtaaagcccgcaacggcatcggggatgattgcggcctcggcgccgccggcgagaatcgcatcggcatagccatgcttgatggcgcggaacgcctcgcccacggcatgggccgaggtcgcgcaggcggtcaccacgggcagggtcgggccctttgccttgtggcggattgcgatattgcccgaagccatattggggatcatcatcgcgatcatatagggcgatgcgcggcggggcccacggtcggcaatcgtgtggacgttgtcgacgagtgtctgcatgccgcccacgcccgaacccacgtagacgcccaggcgctcgcgatcgatggcgccctcgacatcaaagcccgcatcgtgcatggcctcgtccgacgctgccagggcaaactgaacgcaggggtccaggtgcttggcgtcacgcttgccaaagtactcgttgccgtcaaaacccttgacctcggccgccaccttaacggcaaacgcatcggtatcgaagtgcgtgatcgggccgatgccgcacgtgccggcgcacatggccgcccaggtagcaagcgccgtgttaccgagcggcgatacggcaccgataccggtgattgcaactctctgttccatcatggtctcctcattcaagccgttgttcggccctggtttctacatcgccattccgccgtcgacgcgcacgacctcgcccgtaatgtaggcagccgcatcactcgccaaaaagcgcaccacgccggccacttcctcggggtgcgccatgcgctttaggggaatctgctcctcggttgccgcgcgaaccttctccgaaagctttgccgtcatatcggtctcgacaaacccgggggcgaccgcgttcactcgtacgccgcgggacgcaagctcgcgcgctaccgccttggtcaaaccgatgacgcccgccttggaggctgcatagttggcctgcccggcattgcccatcaggcccacgaccgagctcatgttgatgacgcaaccgccgcgctggcgcataaaggtcttggtgagcgcgcgcgtcgtattgaacgtgcccttgagattgacatcgagcacgcggtcgaaggcatcgtcgcccatacgcatgagcaggccgtctcgcgtgatgccggcgttgttgacgagcgcccaaatggagccaaagtcgttgaggaccgtctccacgcaagtgttgacggcggcggggtcggccacgtcacattgatatgcgcgcgccgtggcgccagccgcctcacaggcttcgcacgtctcgcgcgccgcatctgcgctaccggcatagacgacggcgatatcaaagccgtcctccgccaggcccacggcacaagcgcgaccgatgccgcgcgagccgcccgtgaccagcgccacgcggcgcgattcgtcgcgctcgagcgcgccgttgttcaaattgcccatgtcgttcctttcgggttacagccctgtgggctatgcgagctcgtcggcaatagctgcgacctgctcggccgtttcgcacgaatacacgcgaacatcgctcagcgtacgcttaaccaggccggacagcgttttgccggggccgacctcaataaacgtgtcgatgccttgatcctgcagagcatgcagcgtgtcgacccagcgcacggcatgactcacctggttggccagcacctccgatgccgcctgcgggtcggccggatagggcgccgccgtcatatttgccataacgggaatgagcaacggggacggcgcgtgaccggcatcgatatatgcagcaaggccacaggtcgcctcggccatataggggctatggaatgcacccgacaccgcgactttcatagcgcggccaccagcctcttttaccaggacgtcgagggtctgcaacgcatcgggcgctccggccacaaccgtctgctgggggctgttgtagttgaccggccagcagtcctcgccggcctgttttgccaagccctcgacctgcgccgcatcgagtttgatgacggcgcgcatgccgccggggtgacgctcagccgccgtggccataagcgccgcgcgctcgcacacaagctcaaagcccgctcgcgtatcgaacgcccccgcaaaggtgagtgcagcaacctcgcccagcgagaatcccgcacaagcggcaggcaccacgccgcgctcgcgcagggcgacggcgacagccaagtcgtgcacgaatacgcaaggctgcgtgttctcggtctgcgagagctcctccttggaggcgctccggcactgctcgctggtccccgggcgtacctcatcggcaatggcgaacacctcggcggccgccggtgatgcctcgatgagatcgacgcccatcgcggggtgctgggcgccctggccggcaaacagaaacgctacgctacccatgcgcacgcacccttcaggacgcgctcggcaccctcgaccagatcgtcgacgatttcgcgtgcgctctggcgttcgttgaccatgccagcaatctgtccgcacaaaaacgaaccctcttcgtaattaccgtccttggcggccttgcgaagcgcgcccgtgcccatggccccgagctcctcgggacttgcgcccgccgcctcgttcttggcatacgcgttggtgaaggggctcttgagggcgcgaaccggatgtcccgtcgagcgaccggtcgcacgcgtcgacgtgtcgcctgccttgagcaccagctctttgtactgttcggatacggtgcactcgtttgcgaccaggaagcgtgttcccacctggacgccggcagcgccgagcataaaggcagccgccacaccgcggccatcggcgatgccgccagccgcaaccacgggaatatcgaccgcatcgacaacctgcggcaccagtgccatcgtcgaggtctcgccaatatggccgcctgattcggtaccctcggcaaccacggcagtggctccgcgacgcgccacgagacgcgccagcgccaccgaagccacgacgggaataaccttgatgcctgcatcgctccaggccttcatgtacttggtgggattgccggcgccggtcaccacaacgggcacccgctcatcaatcaccacttgtgcgacctcgtcgacaaacgggctcatgagcataacgttgacgccaaagggcttatccgtcttggcgcgcagctcgtggatctgatcgcgcagccagtttgcgtcggcattcatggccgcgataatgcctaagccgcccgcctcggacacggcagatgccagcgaggcatcggcaatccaggccatgccaccctggaacacgggtttttcgatgccgagcagatcgcagagaggagacttgagcatcactacttctccaatgccgcctcgaccgtatcgacgaactcgccgaccgtcttggggttctcctcggtatcgagctcaatgccaaactcgtcctcgacggcaacgaggatctcgacggtacccaggctgtcgaggccaatctcctcgagcgtggactcgggcttcatctcgacatcgtcaaggccggccgtctcgcggataacgtcacaaacgcgctcgaaggtcttctgatctgccatggtatttctcctttgtttgtgccctaggggcgttttcatttcctatgtgcaactacttccagcgaagtagatagccacctacatccaagccggcgccaaatccgaccagggcgatggtgtcgcccgcgtgcagcgcgccggtatttgccagtcgatcgagagcaagcggaatgcaggcgctcgagatgttgccggtttcacgcaacgttcggaccacacggtcgtccggcacacccaggcgcttgactgcctggctcaagattcgttcgttagcctgatggaatacaaagtggtcgatgtcctcgaccgcgatgctcgcgtcgcaggcaagcttgtttaccgtgtcgcagatggcattgacgccaaacttgaagacgcgacggccgttcatggaaagcacgctttcgcagtcctgcgccgccttatacggcgaggagcccgccaatccggggacgcgcagtgtttcgacgtcaggcgacgtcgaaagctcaacagcaaggggattctctcccccagcctctatgaccgcagcagccgcgccatcgccaaagagcacgcacgtggcacggtcggtccagtcgagcacgcgcgtcatctgctcggcggcaacgaccagcacgtgcctggcgcgaccgcgggcgatataaccctcggcgacatcgagcgcaaatacgaagccggcacaagccgccgagacgtcgaaggcaggacatgtggcacccaggcgctcggcaacggcgcacgcttcggcaggaacgagatgatcgcccgtcgtcgtcgaacagacgataagatccaactggctcgcatcgattccggacgtctggagcgcttgctcgctcgctgccacggcaaggtcgtcgagtgactcggtggtgcacacatggcggctcttgatccccgtgcgggtaaaaatccactcatccgaggtgtcaaggaactcggacagctcgtcgttagaaacgctgcgctcgggaagtgccgagcccgttcccagtatcgtgaaacccatcactaacctcctttgagttgttgacgtgtttacatcgaccaagagaggatagcgcatttcagttattgttgacgtgttaacattaaattgtccaaatgcgacaaaggcttcacattgtgtctgtctctcgacaccattgcgttattcacttattcattaaggaggtagcagccgctatggatgcccaattaaagatagtcgacgtaaccggatcgaccaacgatgacctgctcgaagcaggaaaacaaggagcgccgcacggcacaggacttgccgcccgggctcagacagcaggacgcggccggcgcggccacaagtgggattcaaccgccggcaacctattgctttcgattgtcctgcgtccatgcgttaatcctgcaaagtactctggtcttgccgccgtcagcggcctagcggtgctcgaggcgctcgaaaagcagggtcttgcaaacgagattgacctcaaatggcccaacgacctcgtcgcgcgagggcgcaaactcggcggtatcttggtcgaggcggctcgtgacaacgagggcaagccctttgctgtctgcggcattggcgtcaatgtaaactacacgccccaagaggtgcccgatggcggcctggcggcaattggcctctcagacctcaacgaaactgttcccgccgtcgatgtgctactcaaagaggtctatcacgcagttatagaagctgtagatgcgtgagcagagcgtctcaacgccatggaaggagacgccggaccgctcgcgcccgtccacggcgaatatatcggtcatctcaattggattggggagcacgttatcgcccgttcccctgccggtgacgagctggcgcgtggcatctttcaaacggtcgataactttggtcgcgcgtgcatcgagacggaagacggcttgcgatccttccattttgaggaggcatcgctgcgccccttgagcgaatagggcgccgcagccacctgctcggcagtattacccggcagtccaaaccatcattcaaacaaaagagccccgctaccataatggcagcggggctctttaagctatgagcaatatcgcttagagcttgatgtcgatgtcgacgccagcggggaggtcgagacgcatgagcgaatcaacggtgcccgaggtggggtcgaggatgtcgatgaggcgcttgtgggtgcgcatctcgaactgctcacgggagtccttgttcacgtgcggcgagcggataaccgtgtacaggttgcgctcggtgggcagggggacaggaccggaaacgcgagcgccggtcttctgagcggtctcgacgatgagcttcgcggactgatcgacgacctcgtgatcatagcccttgaggcgaatgcggatcttctgggtagccaacttaaacctccaaagagtgcgagagatgttctcgcagattacgtaacagggagctcgaacttaggcgttcttgctcatgacctcgtccacgatggacttgggcgcgggctcataagagtcgaactgcatcgtgtaggatgcacggccctgggtctgggagcgaaggtcggtagcgtaaccgaacatctcgcccagcggcaccttggcacggatgagcttgctgttcttgcgatcctccatgccctcgatcttgccgcggcgaccggagaggttgcccataacgtcgcccatgtactgctcgggggtctcgacctcgacagccataatcggctcgagcagctgcgggtcggacttcttgagagcgtccttgatagccatggaaccggcgatcttgaaggcggcctcggaggagtcgacctcgtggtaagaaccgtcgaacagggtgaccttaacgtcgaggaccgggaagccggcgataacaccggtgttcagggcctcctggatgcccttgtcgatggacgggatgtactccttgggcacgacgccgccgacgatagcgttgacgaactcgtagccgaagccctcctccatcttctcgagcttgatgacggcgtggccgtactgaccgcgaccaccggactgacggacgaacttgccctcagccttctcgacgtcgtgaccagcggtctcgcggtaggcaacctggggcttaccaacgttagcgtcaaccttgaactcacggagcagacggtcgacgatgatctcgaggtgcagctcgcccatgccggcgatgatggtctggccggtctcgtggttggtggacacctggaaggtcgggtcctcctcggcgagcttggtcagagccagggacatcttgtcctgctcggccttggtcttgggctcgatggcaacgtcgataacgggcttagcgaactcgatcttctcgaggacgatctccttgccctcggcgcacagagtgtcaccggtggtggagttcttgaagccgacgcaagcgacgatgtcgccggcagcggcgtcgtcacggtcgatacgctcggcggcgttcatctcgaggatgcggccgaggcgctcgcgctgaccgttggaagcgttgacaacgtaggagccggactcggcgcggccggagtaaacgcggacgtaggtgagcttaccgacgaacgggtcggtcatgatcttgaagaccaggccggagaagggctcgtcgaaggaaggatgacgctcgatctcctcgccggtgtccggatcggtaccggtgacggcctcgacgtcgagcgggctgggcaggtagtcgacgacagcgtcgagcagctcctggacgcccttgttcttgtaggcggagcccacgaagacgaggttgagctcgttggccagaacgcccttgcgcagagcagccttgagctcctcgacggtgaagtcctcctccatgagaatcttctccatgagctcgtcgtcaaagctggcagcagcgtcgaggagctcctcgcgcttggtggcagcgatgtcggcgaactcagccgggatctcgtccatcggctcggggtaggtcatgcccttgtcgtcggccttgaagtcccatgcagtcatggtgacgaggtcgatgacgccccagaagttgtcctcggcgcccatcgggacctgagcggccacagcgttggcgtcgagacgatccttcatggtctcgatagcgttgaagaagtcagcgcccacgcggtcatacttgttgatgaaggcgatgcgggggacgttgaaggtagaagcctgacgccaaacggtctcagactggggctgaacgccggcaacggcgtcgaagacggcgacagcgccatcgaggacgcgcaggcagcgctcgacctcggcggtaaagtcaacgtggcccggggtgtcgatgatctggatgcggtagtccttaccgtccttgttccagaagcacgtggtagcagcggaggtaatggttacgccgcgctcctgctcctgaaccatccagtccatggtggcagcgccctcatgaacctcaccgatcttgtgggtcttaccggtgtagtaaagaatacgctcggtcgtggtggtcttaccggcatcgatgtgggccatgatgccgatgttacgggtatcggaaagcttgtacttaggcttagccatgttagttccttaccttaacttaccaacgatagtgagagaacgcgcggttggcctcggccatcttgaagacgtcctcacgcttcttgacggaagcgcccaggccgttggaagcgtcgaggatctcgttggcgagacgctcggccatggtcttctccttgcgagcgcgggagaagttgacaatccagcggatgcccagagcggtggaacgacgggagttgacctccatcgggacctgataggtagcgccaccgacacgcttgggcttaacctcgagcgtgggcttgacgttgtccatagccttcttgaaggtagcgagagcgtcgccaccctcggacttctcggcaacgatctcaaaagcggtgtaaacgatgcgctcagcggtggccttcttgccgtcaagaaggaccttgttgatgagctgagtcaccaggcggttgttgtaaacggcgtcaggctgaacctcacgacgattagctgctgcacgacgcggcatgtgaaatctccttaagtgtctaccgtgcggcgcttaggcggcacacggcgaaagtatcaaaacgttatctggcttatttggccttggggcgcttagcaccgtacttggaacgggcctgcatacggttctggaccggagcagcgtcgtaagcgccacggatgacgtgataacggacaccagggaggtcacggacacgaccgccgcggacgagcacgatggagtgctcctgcaggttgtggccctcacccgggatgtaagcagtaacttcgatgccgttgacaaggcgaacacgggcaaccttacgaagagccgagttcggcttcttggggctcgtggtgaagacgcgggtgcacacgccgcgcttctgggagttgtgctgcagagcagcgttcttggacttcttgggcacggaacgacggccctggcgaaccagctggttaatagtaggcaaagcgtactccttctcgaatgattccagctttctgtaaagtgcaacggcttgaatcgaggggtcagcatccccctacgaaacacgcagttcgataggatacgtgccgttagctgtgtcgtcaacagaccacgccgccgggcgtatcctaagatgagcatatttccgcaaagcctacacaaaaggaatccccttctgtgcgcggggggccgcggcggcccgcgctgcatgagcatgcccttctggcgcgaggacctctaagtctttccgtttccggtgcggtcccactacaaccgcaccggtttcgcccgtcaaacgggcaccactactactttaagtaattcacttcttcgaaaggaaacgaaccatgggtgttaacctctccggccgtagcttcctcaagctcctcgacctcaccaccgaggagatcgagtacctgctcaagctctccaagaacttcaaggacatgaagcgcgctggcgttccgcaccgctatctcgagggcaagaacatcgtcctgctcttccagaagacctccactcgtacccgctgcgccttcgaggtcggcggcatggatctgggcatgggcgttacctacctcgatccgggttcgtcgcagatgggcaagaaggagtccatcgaggacaccgcccgcgttctcggccgcatgtatgacggcatcgagttccgcggctttgcccaggacgacgtcgaggagctcgctgccaagtccggcgtgcccgtctggaacggcctgaccaccgagtggcaccccacccagatgctcgccgacatcctgaccgtccaggagaacttcaactacgacatcaagggcaagaccctcgtcttcatgggcgactgcaagaacaacgtcgctcgctccctcatggtcgtttgctccaagctcggcatgaacttcgtggcctgcggccccgaggagtgcatgcccgctgacgacgtcatcgaggcctgcaagcccatcgccgaggccaacggctgcaccatcaagctgaccaccgacgtcaaggacggcgtcaccggcgctgacgttctctacaccgacgtgtgggtctctatgggcgagcccgacgaggtctgggccgagcgcatcgctcagctcaccccgtatcgtgtcacctccgaggtcatggctatggccaacccgggtgccatcttcctgcactgcctgcccagcttccacgacaccaacaccaccattggcgccgagaagtgcgagcagttcggcatcagcgagcaggaggtcaccgacgaggtcttcgagagccccgcttccaaggtcttcgacgaggccgagaaccgcatgcacaccatcaaggctgtcatgtacgccacgctcaagtaagagcatctagcatctcgctcggggtgtattgctgcacgccccgagcggttttatctggtaaatatctcgcaccaagcggtatgcacggcacggaagagtcgctttgcgcgagatcagttaaatgatttatgaaggggggatgagaaccatgactgagaccgctaagaaaaagcgcggtatgccttcatcgttcaccattcttcttgctctgctggctattgtcgcagtgattaccgttatcgtctccggcacgtccggcggcgaggttactgcagcccgtctgaactgtacgtcgcggctggtcatccaagaggcgccgtcggaggaaaagagcggttcggccttggcgtaaatctgaatccagagctctgacaagttatttcgaagcgccatctcgttctgcggccgttgaaggtcgtggctaaaggagctcttcagcaaatcgataaagggcatatcgtcggggttggtgggcgaccatttgagcacatcgacgcctcgacattgaagtaatggattgatgtagcgcttttggagacgtcccgcgggatcgccgagcatcgacggctgaaagatatgcagcatttgaatggctggcgccgaattgggcgattgcagcgtgctgtgcaaaacgccgccgttgataaagccggcggacccttcctcaaagcgtacgtgctcatgagccgcgcgcgttcgatagtcaatcgctccctgctccatgtagaaaagctcaacttcggaatgccagtgccaggggacggaattgcccggatagcgagcgaattctgcgcgttcggcaatatagggccagtcttcggcggtctcgggaaacgcttcctcgcgtcctccgcggtgcaattctatgtgatccatgtttcgcatggcatcagtataaagcgcgatgggcttagattgctcttgcctgttcggggaacgccttgtctagggatgcttggagcttttcgaaggatgctcgtaagttgaggctctgatcggctgagcgcttggtttttgtggtgggggagtcgaggaggccgtttctctgtgtcggggggaaggagaaaaggtttgcatgttttagggatggctgctgtgctgcgtcattggaagaatgcatgcttatgcggcctcctcgatgtccaccaaaaggttgcgcacggggtatgctgctaggtcccgtgcgttggcagtattatgccgcggctgttgcaaagaagcgctaaagaaagacttaatgaggtttgacgttgcgatgaaaccgcaggtaaaagctattgagtaacactcttgaaaggttttgagcttaagggctttctaaggtttgtggcgcggatgtggcttgcctgtgtggggcgtgtggacggctcgttcctagcgctgcggctctgcggcgcgcacctgctcgatgaccttatccatcgtggcgtcgatgcggtcttttttgagctcgcattcccagatggttatgggtgtccagcccatttgagtgagtgctgccacggcagcgcggtcacgctcgacgttgcggcgaaactttgcctcccaaaactcaacgttgcgcttgggctggctagggttgcacttggggcagcggtgccaaaagcagccattgacgaagatggcgatcttgcgcccgggaaaggcgatgtcgggtttgccgggaaccttccattccaagcgatagcccgtaaggcccgcggcgcgcaggcgctggcgtacgagcagctcgggcttggtgttcgcacgcttgttgcccttcatggactttttgatggcggcgcgacggcgcacgagctcgcgctcgtcagcggagaggtccgaggtatcgatgccgtcgagcagacctggtttggggcgttttttgctgcggcgcttaggtgcacgcttgggtttggcggcaggcttgtcggccgcgctggccttggcgtcatcggcggcgcttgcctcgagccggtcttccttcagctcaatcagggcatcaatgagccccttgtcggcgggcatccattccaccgtggcaagcgaggtgcgcggaatccagcggatatcaagctgacggtcatgcttctggggttcatcggattcatcggcgagcgagcagtagtagcactccatggagagatggaaatcggggtagtcatactcaacggtatagaaatcgcgcaggttggtgacttttacctgcagctcttccataagctcgcggcgtacggcgtcctcgggtgtctcgccgcgcatgagcttgccgccgggaaactcccaaagtccctgcatgtcgccatagccgcgctgcacggcaagcagctcgtcggatccttccttgcgaatgatcccagcggcaacatgaacagtcttcaacaggagtcctctctcaacatcaacacgtgacagggtagctacccctaccttacacaacggtaaggcaagcgtaagccatatcgatggtagccgactcgtcttcttgcgactatagatgccgtagactaatcgcaagaaaggactcggtatgcaaaccacgcacatggcgaccccggtactggaggtcgcgcatctcgaaaaggtatatggagcgctgggcaacgtgacccgcgcgctcaacgacgtcagctttaccgtcaaccgcggcgaattcgtcggcatcatgggcgcctcgggctcgggcaagtcgacgttgctcaactgcgtgtcgaccatcgatagcgccacgagcggcacgatccgcatcaacgggcaggacgttacgcgcatgaagcaggccaagctctcgcagttccgccgcgaggagctcggctttatcttccaggactccaacctgctcgatacgctcacggcacgcgagaacatcgccctgccgctcaccattgcccgcacaaactcggcagagatctcgacccgcgtgcaggatgtggccgcgcgcctgtctattagccaggtgctcgacaagtacccctaccagatgtccggcggtcagcagcagcgcgttgccgcggctcgcgcgctcgtcaccgaccccaccatgatcatggccgacgagcccaccggcgccctcgattctaaaagcgctcgtctgctgctcgagagcctggaggccctcaatcgccgcctgcgcgccaccgtgctcatggtcacgcatgacagctttgccgccagctacacgagccgcgtgttgtttatccgcgacggcaagatcttcaccgagctccgccgcggcgacaccgaccgccgagagttcttcgaccgcattatggaggtcgttgccatgatgggcggtgagggctccgatgctctgtaaactcgcttggggcaacgtccgccgtgccggccgcgactacctcgtctaccttttgacgctcaccctgggcgtcacggtcttctatgcctttaacaccatctcgatgcaggtcgacatcgccggaattgatgaagagggcttggcgcaggttatgggcagcatgctcggcgacctgacgtactttttggccggtgtcatggcctttttgatggtgtacgccaataacttcatcatgaaacgccgcaaaaaggagtttggcctgtaccaggtgctcggcatggggcgcgggcgcgtcgccacgatcatggcgctcgagacggtgattgtctcggtggtggcctttgtcgccggcattgtgctgggtgtgggactttcccagctcatgacgttctttacggcctcgctctttaagacacagatcgccaatttccacttctttttctcgatgcatgcgttctatctgacccttgcctgcatgctcgtaatgtttgtgctcacgctactgctgaacctccgcgccgtgcgtcgtaccaaactcatcgagcttatgggtgccgagcgtcgcaacgagagcatcaagacacgcaacccctggatcgcgattgccatctttgccgtgggtgcggtgcttgtgggcgtggcctattaccgtctgctacgtgatgggttcccgctaaccgcgacggacagcaagctgcaagaggccatgaaccagtttggtattacgaccgctatggttgccgtgggcacctttgccctgttctggggactctcgggcatgctcatcaagctgctgcagagcctgcgcggcgtgtattggcgcggcctcaacatgtttaccgtgcgccagcttgcggccaaggtcaacacggtgtgcttttcgatgggcgtcatcgcgatgctcctgtttttggccattacctcggtgacctgcggtatgtcgattgccaatgtgatgaacgagaatctggagcgctataaccctgttgacgtgtctcagacgtatgtctattacacgcccgatacgctcgactactacaaagggtatgccaatccgtctgaggccgatcgcatggtgctggccgatacaacggtcgatttgtaccctgcatggcacggcaagggcaagtcggcggacaacaacgacgagaccggcaagaaggtcgatatcgccgatgttgccggtgagcatgtgcagatcgattcgtatctgagttacccatttggcggctcgaatccttcggtgaccccaagtgagatgtgcaagatcatgggcgaaaagcttcccaaggcgttcgggggtagcaatgccgatacgatggggctgtttgtgacgccggcaagccagtacaacaaactgcgtcagatgatgggcgaggagccggtgcacattggccgcgaccagtacttgctcacgtgtgatatgggcggcgagctggtcgacctgtacaccaaatacatggccggcggccataccctcaccttgggtgggcatacgctcaagcccgcaaccgataagtcggacgaagatacggcggccatcgccaactcggcgatgggcagtaattcgggtaccgtcgtcgttgccgacgagctgttgtcccaacttaatctgcagccgtattccagtagcctgctcgttaactacaaacaggggatggatacgactgaggcagacgagagcattaaatacactgtgctcgacaatctgctcgttgacggcaaggagccggggtcgtggggaatctttatcacacgctccgagatgtacacgcaagcagcgcaaatgaacggtcttattagctacctagccatctacatcggctttgtattggtcgttgcatgcgcggcgattctgtcgatccagcaactctccaacgtggccgacggcagccgcagctatcgtgtgctggcacagatcggctgtgaggaccgccagattcgccattcggtgatggcgcagcaagcggtattcttcctgttcccgctggcagtgggcctggcgcactcctttgtggcacttaaagtgatcatcgagctggtgagcatattcggaaatatgagcatcggcggcaccgtgggcctcacctgtgcaatcttcctggcggcctacggtggctacttcctggtgacctacctcatgagcgccggcatggtacaagctgctatcgccacccgctacagcgaataacaagcgggcaaaacggtcgcaaaaccagagacgtgtgaccgccgcgaaggggctggggacctcttgcggcggttatttttgcctatctggtgcgtttcggatgcaagtgagtagacttttttgaacttgccgagcacatcgcgacaaatgctcaataaaaccgcaggtcagggctgtggcgttttgaggtgtgctcggcatcccgccaaaagcctactcacttggttttactgctagaaaaccgccgcgagggaaagtaactccctcgcggcggtttttggcgtttgcccagataaaacctgccaaaataaacctgtccctttttggcaggttatcgcttccaaaagtggaggatgagcgtcgtgcggttttgctgttcggttttgaccaggatgttgtggatgtgggtcttgacggtgcccacggcaaggaatagctcgtcagcgatctcttggttcgatttgcccagtacgaccagacgcataacttcggtctcacggttggagagcttgtaggcgttgcgatagaagggcatctgctcttcgatgtgtcgatcaagatcgctgacgttcttttcctcgggcgcctcctgcatgcggattgaaagcacgtggtaggagtagatgatcagcagaatcgcaaagtagcaggcaaagacgttttcgctaaagttgcgctcggacagatatagttgcagccaagagggcgccagactcatggggacaatcagaatgttgtagaaatcctcggcaacgatgcaaccgaccagaatagcgccgataatcaggtgctttcgttggttgttaacgcgtgccttcagctcgacttgtgtgctcttgcgtgccgtccaaaagatatatagccccacgaaaacaaggaatacctgacgcatcgtgtagtagagccattgatgaatggggccgtaggggacagcgacgataatcagcagctcgctcagcaagaacgttgcgacgggaatgacaaactgcttttttgaatgcttgtcgagcaaatccatggcaatgagccaaataaaagcctgcgaagcggtcgccacaaaggtccgcaacacaggcatggtaattgagtaatagtcgctggctggaaaactctggttttgcagcgtgtattcaaaaaagaaaatctcggtcatctcgatggcatagcagataaatacgccgctgccatagataaagaagcgtcgacgagatgaggcataggcggcaagcgagagcaccgccgtcacaatacagatcacgagtatcgctagggtatagaagaacatcagggtgttcatctgtcaccgtcccatctcatttattctatggccgagctctgtataccttgtgggatatagacgtctcaacccttcgtttcattgcggattagacgccgagatacagcatagccgtataccgttcgcggttccagacggtaaaccccctgtaaactcttgacctgcgggtttatattggtttagagggggtgtaactccgtgaacggtctttaatcccgaataaactaggtaaaaattgcatacgggtgaatgatggtcttgtcaacacgaggcgtgatgttcgagcgcctcatagtaatagtcggcaagaccggcggaaaggaaatcgacatggcactgcctaaggatttcatcgacaccaacgacttcaccaaagagcagatcctggctatcgaggatcttggcctggcaatgaagaaggccatcaaggttgacggttattatccgcacctgctccgcaacaagagccttggcatgatcttccagcaggtctccacccgcactcgtctttccttcgagaccgctatgaccgacctcggcggccatgctcagttctatggccctggcaccatccagctcggcggtcacgagtccctgggcgacaccgctcgcgttatgggctcgctgctcgacatcatgatggctcgcgttgaccgtcacaaggacgtcgtcggcctcgccgagggctccgctgtgcccgtcatcaacggcatgtccgagttcaaccatcccacgcaggagatgggcgacctcatgaccatgctcgagaacctccccgagggcaagaagatcgaggactgcaccctggccttcatcggcgacgccacccaggtctgcgtctccctcatgttcatcgcctccaaggtcggcatgaagtttgtccagtttggacctaagggccaccagatccccgacggcggcctgcacgttggcaccgtcgaggagcgcgccgagttcggcaagcagatgatggccatcgccgaggagaactgcaaggtctccggcggctcggttgtcatctccgacgacatcgagtgcatcaagggcgccgacttcatctacaccgacgtgtggtatggcctgtacgacgaggaggtctcgggcgagaactacatggacgtgttctatcccaagtatcaggtcaccatggacatgatgaactttgccggccccaactccaagttcatgcactgcctgccggccacccgcaacgaggaggtcgtcgacgaagtcatggacgatcccgagcgctccctgtgctgggtcgaggccgagaaccgcaagcactccatccgtgctctccttgccgccctgggcaagcgcaccccgctcaacgacgagggtgtcgagtactccgccaaggctgagctccacgccgctctcgaggctctcgagcagctctaagcctcaaggcttttaaaagcacgtttgcgggcggcggatgctcgtctcctgtcgcccgctcaccgaggcccaagcaattgccttaataccttagggcctcggatctgtccaagactgagcgaaggagctcatcatgagcgacggaaagaaaaagctttccttcttgacggtcatttcgaccatcatctgcgtcgtcttcgtttgcgaggccgccgctcctgctgctgctattggcaaccagcagttcttctggtggatcttcctgatcctgaccttcctgcttccctacggcatggttgtcgccgagctcggtaccacctatgacggcgagggcggcatttacgactgggtgcgcgatggtctgggcgacaaatggggcgcccgcatctcgtactactactgggtcaactacccgctgtggatcgcctcgctggccaccatgttccccgatattctgggcatggtctttggcgtcgagttcaacctgattgccaagatgggtatcgaacttgcctttgtgtggatcgtctaccttatgggccgctccaaggctgccgactccgagtgggtcctcaacggtggcgccattatcaaggtcgccgttgccgttatcgtcggcgccctgggcatctggtatgccatggagaacggttttgcgaacgacatgtccgctgccaccttcctgcccgagctcaccaacaccaacgctcttggctacctgtccatcatcatctttaacttcatgggcttcgaggtcatctgcaccatgaccgacgacatggccgatcccgctcgcgatattcccaaggctatcatcgtcggtggcctgtccatcgccgtgatctacctgttcgccggcttcggcatcggcgccgccgtgccggccgactccatcgaccccgactacggcatgatcgtcgcagtccagaccatggtgggcgactccatgatcttcaaggtcatctgcatcgccttcctgatcaccctgttcgccaacatggccgcctggtccttcggcgtcaactccgtcgcccgctacgctgccgagcacggcaacatgcccaaggtcttcgcctcgatgatctcggatgacgacatgcccaacggcgccaacctggtcaacgccgtcgttgcctccctggttctctgcctgcagctggtgcccatcgacgccatctccaacggtgtcttctggatgctcttcggcacctccgtcgtcttcctgctgctgacctacatcccgatgttcccggcgttcctcaaccttcgcaagaacgaccccgaccgcgagcgcatcttcacgttcccgttcaagggcgccatgatgaaggtcatgctggccatcccctgcatcgagctggtcctggccatcgtcgcaactctggttccgttctccgccgctgaaattggcgacaagctcccgatgatcgtcatcttcatcgtgctcgtgctcatcggcgaggtcgtccgcgtcgtcagcgccaagggccgcaaggaagagtacaagggtctgacccctgagctcgcagcccagcgtctcgctgaggaggccgccgaggccgaggagaactagagcacccggattcggggctccaaccctcatcatcttctaaccattccctggggtgggtgtgagcgatagctccggtaaccaccgcccaccccaatctctcttccgtatccttcgtgcgttttgtctccacgcacttggttacgtcgtcgcttgccggtgcgactccgtgaaaaccggcgccaggcgccccgacctttgctggggaacgggcgcctaccatctcttggttttaggctgcaggtaacccgcccgcagcaaacgatcgttcgatttggaggaaatcttatgcgtacgatcaccgagtccgagtccacccccagggccgacggcttcttcatgcccgccgagttcgccccgcaggatcgcgtgtggatgggctggccccaccgcaccgacacctgggcccacggcgccaagccggcccagaagcagtatgccgccatcgcccgcgccatcgccgagttcaccccggtctatatgtgtgccaaccaggtcgactatgccaactgcaaggccgtcttcgagaacgacgagaacgtcaccgtcatcgagatgaccaccgacgacgcgtggttccgcgacaccgccgccacctacgtcatcaacggcaagggcgagaagcgcgccaaccactggcacttcaacgcctacggcggcctcgtcgacggcctctatttcccgtgggacaaggacgagcagatcgcccttaagatggctgagctctccggctgccgtcgctatcgtcccgatgacatgatcctcgagggcggctccatcaccgtcgacggcgagggcacccttgtcgtgaccgaccagtgcctgctttccccgggccgcacctgctctgcggttctggaggaggaagaggatcccgagtccatctggcccaagtaccacaagaagtttgagccctggagcgaggagcttcgcgcctatatggacgagcacctcaaggattacctgggtgtcgagaaggtcatctgggtcaaggagggcatcgaccccgaggagaccaacggccacatcgatgacgtcgctacgttcatcgccccgggcgtcatggcctgcatctggaccgacgatcccgagtacccgttctatgatcagtgccacgctgcttacgagaccctctccaacgcggttgacgctaagggccgcaagatgaaggtctacaagctctgcatgcccgtgaacccgctgttcatggaccaggcctcctgcgacaccatcgacgccgacgagaacgccgagccgcgcgtccccgacgagccgctgatcgcctcttacatgaactacctggtcaccaaccacggcgttatcgtcccgcagtacggcgacgagaacgaccagctggccgttgacacgctccagaagatctacgacgaggtctggggcgagggcgtctacaagtgcgtcggcgttcagtccgagcaggtcgtcttcggcggcggcaacatccactgcatcacgcagcaggagccgtccgcttaatcgtctgtcttcccgaggcacggcaccttgcccttcaatcgtcgggcatgacccttaaggtctatgccctcctctttcagggcaatctgccgcagctcggaaacccagccaatcacgcagacgcttaatcgtcgggctttccgaggtgccccatctcgtcgctcaaaccgtcgctcgcgtaccaaagtacgcttcgctcctctttcgcggcgacctggggcacctcgaaaacccagccggtcaagcggacaggtggcgtgtcgtcccatctcggggcattgatgggctgctacttgatgtcttggtcggctgggtttttctttgggcactccgttgcctccacttcggagtgcccgcctctttgattgagtacgcgtctgatctgggatttattgcgggttaggccaattgttcgcttgaatatcccaggtcagacgcgtcttcaattgccgaaagtttccggttgcgagcgcgaccgttttgatcggagtatctatgtaccagcgtatcgttatctacacgcgcctgttccgcgagcgttggtccaacaattgcatcctctcttctctttgggatggcacctgcaccggtgacgcggcctgcaaccctaccttgggctgcgccttcggtacagatgccatcctttttgctgtagggggagcgcgtcgtggcaggtaaaatgttctccctgttcgaggtcatcctctcggttatctgcgttgtctttaccatcgaggcggccgctccggcatctgccatgggtaacgtgcagttcttctggtggatcttcctcatcattacgtttttgcttccctatggcctggtggtggccgagctcggtacggcgttcgattccgagggcggcctgtacgattgggttcgcctgggcttgggcgaccgttggggcgcccgctgctcctggtgctattgggtcaactttccactgtgggtggcaagtatcgcctgcatgttccccagtgtcatcaatgcggtatggggcatcgaattttcgcttggggtccgaattgccatcgagcttgcctttgtgtggggcgtcacggtcatggcaatgcagccggtggccgaggccgattgggtcatggatggcggcgccgtcatcaaggtgctcattaccgccgtggtgggaatcgtcggcatctggtttgcctgcaacaacggctttgccaacgatatgtcgtttaagacctttgtccccgatcttggagacactaactcactgacgtatctttcgatcatcctattcaactttatgggcttcgaagtggtcgcgacctttgctagtacgatgaaaaacccgtcgcgcgatatccccaaggcggttatcgccggtggcgttgccattgcggcaatctacatcatttgcggcatcggcattggggctgcggttcccaccgagcagctttcgctcgattcgggcattgtggatgcggtcgccgccatggtggggcgcgctcacccgctgacgatggtcgtgggcgtggcctttttggtgacgctgttcgccaacatgatctgctggagctttggcgtcaacaacgtggcgagctatgccgcgcgccatggcaacatgccgcgtccctttgcgttggtgtccaagaggaccggcatgccagacggctcggcactcattaacggttgtttcgccagcttggtgctgctacttcagattccgctgggcgagggttccgacgtcttttgggtcttcttttcgatgaacgtcgtctttctgctcatgagctatatcccgatgttcccggcgttttggcgcctgcgcaaatacgacgaccgcccgcgtgtgttccgcgcgcccttcgagggcaaggtgcttgcggtagcgcttgcggtgccggtggtagagctcgtgctttccattgttgcgacaatcgtgccgcttaacagctcgcccgccgagatgtcaaagttgccgatcctcatgggagtggtgatcggcgtgttgctgggcgaggtttcgcgcctcatatcgcgccgcggccgcagtgtcgataatcccggcgttggcgcaagggggaccggtcgcttcgcaccaaaacagtagcgccgcgagttgtgcggcgctggctgcatcttggattactgttcgcggtgctcgggatcagaagcgagcttaggcgcaaagtaggggacgtggcccaggtaagggcaactgtccgtacgctcgtcgacaacgcagggaatatcttcgtaggtgagtgagtcgctcaggcgggcgatggtcttggcggcaggagcgacgagcatcttgagcggtgcgataggcgccatggcgtctcctttcttgcatgcgacccgtgttttggcgcgaatgtatacgccgccagtctagcattccgccgaggagagctccaaaccaccacaaaggggatgggcagatgcaagtgagtagacttatttggatatgccgagcacaccgcgacaaatactcaataaaaccgcaggtcagagctgtggcgttttggggcgtgcttggtctcctacaaaaagcctgctcacttggtttttctgctagaagaccgccgcgatggaaggcagctccctcgtggcggcagacatttgcccagataaaacctgccaaaataaacctgtctactctttgagccagagccgacaataattcaaatggcgaaatcaaagggcgttctccacatggagggcgcccttttttatcgcgggatgttttgcgtggcagtcatgaggcccaggcggttgctgacgccgagcttgcgatagatggcgttgacatgcttcttgacggttgactcgcttatgaatagctcgtttgccatctgtttgttcgttttgccgtcgagcatgagccgcatgacttcggcttcgcgcggttggatattgtgttctgtaatgaaagcattcagctggtttgtgtcttctgtctgggtgagtttaatgccccgaggatagaggttggcgagcgcgaggctcgcgtgccgagcgatttcgagcaggattgcgagctcggtgtcggtgaagtctccggctgtgcgttcgcgaaacagggtgatgcttcctagcggcctgtcgttgtgcgcgagcgtggccgtacagccaaagtagacgccctgcggttccatccatttgcgatagatgggcgtggcatcgcgtcgctcgacgtcgacgaggtcgaggtcgcggtagacgccgaccttatgtaagtcaaagctccatgttgtatagtccatcgcggcgtagcggttgtagtagtcgctcagtgcgcggtcgtccattccgctgcttgcggggtggacgtaacgtggggcatcactgcccgccgcctcgatcaggtcgaacatggcgatccgatggggcacgagccctgtcgttccctcgagggtctccttttgcagcttatcgacaccgtgtgatgcgtggattgcaagcgcaagctcgttgagagcagtccaggtcgtactgtccaactcaatagtctgctgtttattgcatgggggcatagggcgtcctttccattgtggaacccagtatgtcatgttctcggtctgaatagaactttaggtcagcgaatggtataccgtcggtcgttgaaaggggctcgagggaccattgaggacatctggctacggctgcatcatggtctcgtcaagcaaaagcaccgagatttaggagcttgaaatgaagaccatctatgagagtgaatccacgcctaagaaggacgggttctatatgcccggcgagtatgaggaacaggagcgcacctggattctgtggccgcaccgctccgacgtgtggcactgcggcgccaagccggcgcagaaggtcttcaccgagatcatcatgaccattgcacgttttcagcccatcactgtgggcgtcaacaccgaagacttccccgcggtgtgtgagatcttcgacggcgttgaaaacgtgcgcgttatccacatggagtacaacgacagctggattcgcgaccccggcccggcgttcctcgttaatgacaatggtgaggttgctctttcgcacttccactttaatgcttacggcggtttcattgacggcctgtatttcccgtgggacaaggacgcttccattggcctgcaggtggcacagctcgagcaggttaaccgctatcgtcccgaggattatatcctcgagggcggctcgttcaactgtgatggtcaaggcaccgtcgtgaccaccgagatgtgtctgctcaacgaggaccgcaacccgcagtacaccaaggagcagattgaggagaagctctctgagtatctcggtatcgagaaggttatctggatcaaggacggtatcgatccgtacgaaacgaacggtcatgtggacgacgtcgcatgctttagtgcgcccggcgaggtctgctgcatgtggaccgatgatcccaaccataagttctacaaggagtgccaagaggcgtataagacgctttccgagacgacggatgcccgtggccgcaagcttaagatccacaaggtgattatgcctgcgacctcggtatatatgaccgaggaggaggcatcgaccatcgatccggtcgagggtgtgctgccgcgtactcccgaggacgctttcgagccgagctacctcaacttcctgcccatcaacggcgcagtgcttgtaccgcagttcggcgatcccaatgacgcccaggcgctcaaggatatccaggctgcttatccggaccgtgaagtcatcggtatcatgactcgcgaggtaatttacggcggcggcaacattcactgcatcacccagcagcagcccaaggcgcgctgcaagtagatgcggttgcaggcacacggggtagtgtcgatatgacctggggcccgctggcgcacacgctggcgggcccttttgcgtgcggcgggcagcgttgcacacgggcactcgggtctaagcgagggtaccaggggccttgcttatcgtcgatagttggtctagaatcgtcgatagtcgatgatagggggtagcatgcagcttgttgaaagtgagaccgtggagttcaagcgcacatttacccctaagctgctcaaagctgtggtggcgtttgccaattcgaatggcggtaccttgtatatcggaatcgacgattttggcagcatcgtcggcgtggacgatatcgatgccaccatgcttcaatgctctaatgcaataaccgatggcgtgtatcccgacgtttctgaaatcacgacggtctccgcattggacatcgatggcgcagcgttggtgaaaatcgaggtggaagcgggtcctcacaagccgtactgcctgtgctcgaagggatttgttcccgccggggtatatcggcgcctaggtcctgccaacgtgcccatcgagatggcccagatccgctcgatgatcaagcgcaccgacggcgattattttgagaccgcgcgctctcatgaacagagcttgacgttttttgaagccgagcgggtctttaggcgcgcggagattacgtttgaccaaacctctcaaaagaatctcggccttatcgatgagctgggcttttacaccaatttggcactgctggtctctgaccaaaacccctttgcagtccgcgctggcctcttcaacgacgatgcgtataccgagtttatcgaccgtcaggatggcgagggctcgatcttcaggcagatagaggatatcgaacggttcctcaatatatcgaacgcaacgcgtatgtactttgtgccgggaaggctcgatcgcatagataaggacgactatccccgcgaggctgttcgagagggaattctgaacctgtttatccatcgcgactacgaatcttcggtggcgtctcttatcaagatgagccgtacggcgcttgaatttaccaatgcgggagggccgcagcacatcagcgtcgaggaggcgcttgcgggcggctcggacgctcggaatccaaagctgcaactgctctttttgcgtctggggatggttgaggcgtttggaacgggcctcaaggggatccgtgcgctctatgaggcggaagggttggaacccgaagtctgcgcctaccctgcaatgtttaggttgtcgctgcccaacgtcaacgccgtgcgcaattcctatctgacgcctcgtggcaatagcggtcccaacttgcgtggggattacagcgattatgagcagctcgagcgggaaggggcgctgccgcccgatgtttcgcaggcgtttgcatccgtgcgagcgcagcgagaggggcacgtgtcgatgaatggcgactgcggccacgaggtgcgtgccaagctcgtggaggagcttggctttgatgttgcgtgcaaggcgtccgcgatgctacaggatgtctcggacgagcgacgtggtggatacgctcgcgccttgattcgctttgcccttgagcggccccgcggttttacgcgccaggatgcttcggacgctctgggaactgggcgcgacgtgacgctgcgggttatcaacggtttgcttgaggaaggcgcactcgttaaagaggggcgcgctcgggcgacgagatatcgcgctgtcgggcaggtttagggacgggcggtccggccccctgggttaatcctgggcagaggccaagggccgggttcccggctcgccttgattgaaggggtacttagagcgtgcttccgtacatgtagacgataaagccgtcgccggtgtcttggctgtggtcctccaggatgcgcttcatgttgaggtgttcgtaaaactgccagtcggagttgcagtcgctcatcaggaagaacttggtgcagcctgccttggcgagctcggtgcgcgcaaggtcgatgagcttgcggccgagtcccttgccctgccattcaggcataatgataatcaagttgagttgaccctgggcatattcgttgcctgtggcggcaaagcgatccgctgtggccttttcgcggctgtctccaaagagcgagccctcgagcttggcatcggcggtctttgccatctcggttgcctgggcaaacatctcgttatagcagggctcccacgtgggattggtgcgcggcttgccgtcctcgaagatgccgatgcagcaggcggcgataatgcggccctcggtctcggcgacgagtgcgatgggggagcgctgcagctgcatggcgatgttaaagcgcgcgcagaaatcggcagcttcgacgtcgccgcggttgcgcagcgtgttgcaccacagctggttgtagatggcagcgatgccggtcaggtcgtcgagcgtggcggcgcgcagggttacgttgtcaaggctcatgaaggctccttccaagttgggtcaggccacctctgagtgtgacatggccgcagagccgccgcatcaaccattcggtagacgacccccgatcccacgggggcggagggctccaagagggaatgagagtggattatcggacgcccgttcgacgagagtggataatctcccactttcgcccgaaaagcaggccaaaaacgggagattatccactctcattctgggtagtcgttggggatgttcttaaacgaccagtcattaaagaacgtccccaatgactgccccaaggaatatcccagactgccggcagagacgatatgagcaggacataaaaacattgagagcccctgctgcgaaccgctcttttcctccgacggcgcctcttggatgaccagccgcgacgtacagttcaaggcaatcctggactttatccgcgcaaactatgcagccgctatagatgtgccccagatggcatctgcagccggcgtaagcgaaagagagtgttaccgcattatcgaaacttgtgcaggaacgaccccggcggcatatctacgcgcataccgtataaaccgtgcttgcgaacttttgacgcacaccacgcgaacggtgcaggcaatcgctcggcaatgcggctttgcgacagcgagccatcttgggcaggtattcaaagaacaaataggctgcaccccttcgagctatcgagcagcgaggcagaatctcgatagtaccgggcagaaatcccactagcccttcttctgtcactgcatcaaacttgcaggcaaacaacagataggagcaaccatatgaagcactttgaccatatcgtgtttgacgttgacggaacattggcagatacagaagaaagcgttctgtcatcgcttgcccagattgtccaagaagagaccggcaaaacgctcccccgaaacgagcttgaatttgccctcggcatacccggcaaggatgctcttgagaaacttggaatctactcgcaagcaacgttggatcgctggtgccaagttgccgccagctttaaaagcaccatcagcgtgtttccaggtttgcttgaagtcatcgcaaaactcgccgatagcggttgcaatcttggcattgtctcctcacgtgcgcgcgacgaatacgcagaagaaatagcaccccttggcttcgataagtattttgagcacatcatccttgtcgaagacacaaccgaacacaaacccgcacccgcacccatgctcgaatatctccgacgtacgggtgcagaccccaacagcgtcatctacattggcgacaccgtctacgacgaacaatgcgcaacttcagcaggggtcaattttgcccgagcagtatggggatcacaccaagaaatcccaaacgccacctacaacctcaaaacccccaacgacctactaaccctaacaaccaagtaacccccgcgccccatcctttccgccctaacgccacaagggcgattgagcaggacggtttgggcgggtcccgtacttagtttccaaaatcattccgcagcgcgatgacttcttattattttccgccctaacgccacaagggcgacgacctcgagaaggtcaactcgggagggacgagggcttagttccccaatctttccgcagggggcaaaaagcctcgccgcacgaagtgcgcagcgaggctttttgcatgcccgaggacgattggggaactaagccctcgtccctccccgggatatgtagcgagtcggagtacccttgctgttactctgctttgcccacagagttgaggttggtcatgcggatcttaaccagctcggtaatctcgcgcatgccctccttggccggcttcttggggtcgaagcagccggggttctcggccatgtaggccatgaagcccttggtgtaggcctgacgcagctcggtggcatagttgaccttgcagatgccgttcttcacggcctcggcaacctgctcatcgggcacaccggaggtgccatgcaggaccagcggcacgtcgacggcgtcgcgaatggccttgaccacggactgctcgatgtgcggatcgctcgtatacacgccgtggctggtgccaacgccaatggccagcgaggtgcagccagtgcgctcgacgaactccttggcctcggcggggtcggtgtaggggctctcgccctcaaccgcgggaccgtcgtcctccttgccgccaaccttgccgagctcggcctcgacgggcacgcccatggcgcggccagcgtcggcgacggacttggtcagggcgatgttgtcctcaaaggactcgtgcgaaccgtcgatcatgacggaggtgtagccggtgcggaaggcctgcatgcagcggtcatagccatcgccgtgatcgagatgcagagcgacgggcacggaagcgcgctcggcggcagccttgaccataccgtagaagtagtccaggccagcggtcttgatggtacccggggtggtctgcatgatgacgggggacttggtctcctcggcagcggccagaacggccataacaaactcgaggttctcgacgttgaacgcgccgacggcgtagtggccggcctgagcgtccttgagcatcttttcggtggtaacaagtgccatgagcgtttgctcctctccctcgcccgcatctggacatcgggcgtccgtgttcgcaaggcgttttaccttgcgttttgctgcgcccattgtatgaaattcggcgagtctgaatgtgcgggatgtcgtcgtcccgcagggaaagaccctcaattttgaaaagcaaacggaagggatcaaggccaagcgcgcgtgtttgatattgagttttgagtcttgattgcctttcttttatagaaaagataagtaatcgaaaggtgttttcttactcaaaaagaaaatgaacgaaaatagagtcaacacaattcctgcaaatattgccgagaatggagtagccatggttcaagcaacaacccgcgccttcgccgacgaacgccgtgccgccatcatggaaatgctcgagcacaacgcctcggtgcaggtggcagaaatcgcccagacctttggcgtgtcctccgttaccgcccgtgctgatctggacgccctcgctgagtccggcaaactgcgccgcacacatggtggcgctgtgtcgctccacaaacgcctgaccgtctccacacaggaccggcgcattaacgtcaatgtcgccgccaagcaggccatcgcccaaagcgctattgagctcgtcagcgacggcgacacgctgctcgtcgactcgggcaccaccgcgctcgaatttgtccgcctactcgaccagcgcgacggcattaccgtcatcacggcagacattacgatcgccgattacatcgacgagagcatgccctcggtcgatgttgttatgctgggcggcgcgctgcgcaaaggccatcgctatctgtacggtccactcactatgcaggcactgcaagtggttcacgccgatcttgcggttatgtgccccggcgcctttgtcccgggttgcggctttacgaccgactttccgcagatggccgaaaccaaaacggccatgatctccgccgcccgccaaaacgtcgccctgatggacgccagcaaggtcaacggacgcggcatgtaccgcttcgccgaacttgtcgatgttgacgccatcgtgatggaccgtgaccccaatggctccgtcgccacctcaatcgccgagatcgccggcgccggcgccccaaccctcatcatcgccaccgcctaaaaacaaaaaccaccacaaaggggacaggcacctttgtggtggtttgagaggcacggtagctcactccgccagtttgtctcaatctgtaacaactagacccttaaaagccggttaactgttacagattgagataatcccgctcgattccgcccttaatctaaatctgtaacagatagagtcgatttagccgcccagatgttacagattgagacagttggacgcgaaacggtcttggcagaagtggccctctagcaaagagacgctacatatcgaccgaagcccggcaacgcaaactcgaaacgtccctgtaagggttcttcaatcacccctgcctcaattagacgttttttatacgtcgagatcgaaccggaacttttcttaagccgcgcagccaattcttgcctggtcgtcgtcccctccggattcattgcacgaagaaaatccaagtccccctgtgaaagttccgctgcagtcgaggcaaaaacgcgcgattcgagctcctcttgcgcaagcttcgcgccacgttcgacgtcttcaagggaaacctcagccgcctggcgcgaagcgttccacgcccgatatcccaccaactggaacataaacggaaaaccatcgattgcctcggcagcacggtcgaccgcctcatcggaaatcgttttgccaccgtcttcaatcgtcagccgaaacgcttcttttacctcagtcggcgaaatagatctcagcgaatgctgggcagcacgacgaagaaacgatgtcgattttcccgtcaacaacgccagcacgcgaaacggcagccccgccataagcaaagctacctttttgttctcgctcacaaaatgttggtaggtggtaacgagctccgtcatttgagcaaacgatgcatcaacttcgtcaacggcgataagtaccccggtgccagtcgcttcaagctgagcaaacagagcgttcatcttagtacgccagttggcgccctcaaattcaatatcaacgttttcccagctcatacttcctatggaggcaatcccaacactgttcacacgcctagaagcgggcttttcgatcagatgggcggccgattcgttgaggcgctgcagaatgtcttcgagcatcccgtccgaagccgtcacattcgccgtaatccagccttcttgctgggcgcggtatgacagatatgccaaaagggccgttttgcccgtcccgcgcgcgccgtagaaaatcgagcataggttggggtcggaatcggcgctttcaaacgccagcaccatatcatcaatgatttgctcacggccggccatgtatgccggtacacgtccaaacatcggcgtgaacggatttgcctgcctgtacgctgtcgccgccgccataaaacctcctttgaactcacgtaattccattatgccctacagcccttgatttctttgagcctccttgatttttttgagcatctttgagttccttgagcatgcttgagttctttgagcatgcttgagttctttgagcgaacggccgacagcagaaccaaccgtcctcttcgactaaaagcaaaaaccaccacaaaggggacaggcacctttgtggtggttttggcggtagaagcgagcgcgttgttacttggacagctcgtcggcgagggcttcgatctgggcgcgcgatgcgtcgttgagcgaacccaggacggtcaccttgttctgcgtcagggtgatgtccttcatgccctcgagctccttggccataaccttggcagcggcgggcgcccaggagccggcctcgacgagtgccaccgtgcggttctggtaggcatgctcggcaagtgtgtggataaaggtgctcatgcacgggaagatctcgccctgataggtgatggaagcgagcaccagacggtcgtagcggaacgcatcctcaacggcctcggccatgtcgtcgcgagccaagtcaaagacggaaaccttctggccgcgggcctcgagcgctgcggcgagctcctcgacggcagccttcaggtggccgtacacgcttgcataggcaatcgtgatgccctcgtcctcgggctgataactcgaccaggtgttgtaggtgtcgaggtagtagcccaggttctcggtaagaacaggaccatggagcgggcagatgatctggatgtccaggtcggcggccttcttgagcacggcctgcacgaacttgccgaatttaccgacgatgccaaagtagtagcggcgcgcttcgcaagcccagccttccgggtcctcgatgtcgttggcgccgaacttgccaaagccgtcggcactaaagagcaccttgtcggtggactcgtaggagaagatcacctcgggccagtgcacgttgggggcgccgacaaacgttaggctgtggccacccaggtcgagcacgtcgccctctttgacgaccatcttacgctcggggtagtcggtgccaaagtagttgaccatcatgcggaaggcgcccatgctggccacaatctgtgcctgggggtagcgctccataaaggcggcgatgccagcggagtgatcgggctccatgtggtgaacgaccagataatcgggcgtacgaccatcgagcacgccctcgatgttgccgagccactcatcaacaaaaccgccgtcgaccgaatcggcgacagcgatcttctcgcccaagataacgtagctgttgtatgccataccgttctcggacacgtcgtactggccctcgaacaggtcaatgtcgtgatcgtcgacgccaacgtagcggatatccttggtgatctccatcaggcaaagcctcctagatagacaaaagaacccgtctatcatagcactcggctgcatcccaacagctatctgccgacatccttaccgtttgttattgaagcgcaagattgagccgttgacctgcgcaaactacgcgcgcggagccgctgtggtatgtcgaacgatgagctggcccggaatacggatcgcgacggtcttgcccggcgttccctccttgggaaccgcatgctcaaacacctcgcgcccgcgctggtgcagatcgaatcgcacggtcgtgagctcgttgtgcgcgacaaaatcatcgagcgaatcgtcgacacccaccacgctcacgtcctcgggcacgcgcaggccgctatcgcgcagcgcggcgatggcaccatttgccatctgatcgtttgccgcatagatcgccgtcatggcgcggtcgtgttctgccagatacctgccggcctcgtagccgctgttggcagaccagtcgccctcgagcggttctgccggctcgatatgcctgcgctcgagcgcgtcttgccaaccagcgcggcggaactgctcgtccaccgagaaggatggaccgccgatgtagcgaatctgctcgtggccgagctcaaataggtgatccataagcagcagcgagcagccgtaatggtcggaatcgaccgtggtcacgcgcggatgcgcatacatggtgacgataaccgtgccgattcccggcagcggatcaaacgtctcaaaatcgggcgccatgcggctcatgccgatgatgatgccatcgaccggcagggccgccatgcgacgcgtggcctcggcaagcgaaaactcctcggtcttggacatctcgaccagcgtgatggcacagccgtgctcgcgagcggcgctggcgataccgtcgatcatcgtcaggttcccaaacttggtgacatcgttgacgcataggccgaccgaatggtagcgaccatcgcgcagcgaacggccggcatagctcgggcgaaagccgagctcctgcatagcagcctgtacgcgctggcgcgtctgctcgttcacattgggcaggccgttggcgacgcgcgagaccgtctgctgcgaaacgccagcggcgcgggcgacgtcggccatggaaaccggacgcgaacccgtgtcgttggaagggtgccttgccacaaaatcaccttcgctcctgtaggaagcctaaataccccatgcgaaattgcaggttacacgggaggctttgctatctatcgataatgttaacgtactctactatacctatcagcagttatgcagcaccccccaacaccgcctgaataccgttcacggctcattttcgaccgattgcaggaaagcgaagaagtccgtggttccaggttatgagtacgttaacataaggcgaaagcacaccgataccatggtggcctgcgctccgggcgcgcaggccatgacgtcgtattcgaaaggacgctcatgattaccacaactccgttcggcaccgcccccagcggctcgccggttacggtctataaccttgtttgcgcaggtgcccgcgtgcgcgtcatggactatggcgcgaccatccttggcatcgaagttcccgatgccaagggcactgtggccgatatcgtgctcggcttcgaccgcctgaacggctactttgacaatccggcatgttacggcggaaccattggaccttcggccaaccgaacggataaagggcagatcacgattggcgatgtcacctatcagatggtccacaacgatggccccgataagaccaacaacctgcacaccgaccttgagcacggtctccacaagcgcatgtgggacgccaaagtcgacgaaatcaccaacacggtgagctttacctgcaagctggacgacggcgagctgggccttccgggcaaccgcacctttaccgtcacctatgccctgcaggctggtccgacgggagccgctgagctcacctgcacgcaaagctgcgccaccgatgccgagacctttgtcaacatgaccaaccacagctactttaatcttgccggacacgattccggcacggttctggatcaggttgcggcaatcgatgccgaggcatttcttccccagcgcgaggacaacgtgtcctctggcgaggtgcgccctgtggtcgacacgccattcgattttcgcgcacccaagacgctcggccgtgacatcgatgcggacgacgagcagctcaagattgcacgcggctttgaccactgtttctgccttgattgctttgcacccgacgccgagccgcgccatgccctgcgcttgcaagatccaaactcgggccgcacgctcgacatcttcgtaaccgcaccgggtgcgcacctgtataccggcaactggctcggcgatatcgacgccaaagacggctgcagttacggtcctcgcgacggcgttgcgtttgagccggagttttggcccgacaacaaccatcacgcacagtgggcacaccccgtctgcacgcccgaccacccgtttagctcgacgatcgtctatcgattctcgaccgtttgttaacccaccctcgtcaaggtgcgagggggcagcgttatgactcccgcctactccctcgcaccttgatatgtttacgtactcataagcaaagcccggtaactcgggataaccaagaaaggaagacaccatgaccgcccccgacgaaaagacgctcgccaccctcaccaagctgtttgaggaggagtttggccccatcggcgaccgccaggtgctctacgtgcacgcgcccggccgttccgagatcagcggcaaccacaccgaccacgagggcggccacgttatcgccggctcgctcgatgtcgccgtcgacggcattgccgtggcgaccgataccaacaaggtccgcgttgccgacgagggctaccccacctttgagattacgctcgacacgctggatgttcaggagtccgagaagggcacgtccgcaagtctcgtccgcggcatggcacacgagatcgcagccctgggcgttgagcctcatggcttcgacttcgccttcacctgctccgtcccctcgggcggcggcctttccagctccgctgccgtcgaggccgcgtacggccgcgccatggagacgctctggggcgcgcccgccattgagcccgtcacgcttgcgcagatgagccagcgcaccgagaacaactactacggcaagccctgtggcctgatggaccaggccgctgtgtgcttgggcggcctcgcctacatggactttgaggaccaggctcagcctaaaactcagaagctcgagctcaactttgaggaccacggctatgcactcgtgctcgtcaaggtgggcgccgaccatgtggccgccaccgacgactacgccgccgtgccgcgcgagatgcaggatgttgccgccgagtttggcaaggcacgcctgtgcgaggtcgacgttgccgactttgacgctaagctgcccgagctgcgcgccaagctgggcgaccgtgcctgcctgcgcgccattcactactggtacgagaacggtctggtcgataagcgctgggcggccctgaacgccggcgacatcgaccagttcctgaccctgacgcgcgagtccggcgccagctctgccatgtacctgcagaatgtcgttgccaagctgggctccgagcagccctccatgtacgccctggcacttgccgagcacgtgctcgacggccgcggtgccgtccgcatccacggcggtggctttggcggcaccatccaggccttcgtaccgctcgacctggtcgacaccttcattgccaagatgaacggctggctgggcgagggctctgcccgccactacgcaatttctgacaagggggcttacgcggcatggctgtaataaccgaagtgcgcgaggccgcgcagggcctgattgagtatgccatccatcgatcgatgatcggtcaggacgatcgcatctgggcctacaacaccattttggagtgcatcggcgccacgggccccgcactcgacatggcttgggcgctgcagaccgagaagatttcgctcttgcaccccgatacactccccgactttgatctggagggcacactcgccgtgctttccgatgctgccgttgccaacggcgctgccgaggacacggcgtcgggccgcgaccgcatcgccatgcgcatcatgggcgcgcttatgccgaggccttcggttgtaaacgaggaattcaacggccgcatgggcgtcaacgagccccgcgccgcgaccgactggttctacggcctgtgctgcgacgccggctatgtgcgccgcgccgccatcgcacgcaacattaagtggagcacccctaccaactggggcgacctggagatcaccatcaacctctccaagcccgagaaggacccgcgcgatatcgctgccgccggtgccgccaagaacacgggcgaaaagtatcccgcctgccagctgtgcatcgaaaacgagggctaccccgggcgttcggcagcagccgacggtggcgcccaccccgcccgccagaatctgcgcgttatccccatccagctcgacggcgagcgctggggtttccagtacagcccgtatgcgtattttaacgagcactgcattgctatgagctccgagcatcgcccgatgcacgtggaccgcaaggggctgacctgcctgctcgactttgtcgacctgttcccgcactactttattggctccaacgccgacctgcccatcgtgggcggctcgatcttgtcgcacgaccacttccagggcggcgcgcacgagtttcccatgatgcatgccgccgaggtctcgcagtttagcgtgcccgggttcgaccaggtcaccggcaccgtgctgcagtggccgctttcggtgttgcgcctgcgctcgcacgatcgcgcccagctgctcgacgccgccgagaagatcatcctcgcttggcgcgagtggaccgacgagtccgtgggcgtcatcgcgcacacggccgacggcgtggcccacaataccgtgacgcccgtcatccgccgcgtcgactcccgcggtaatgccggtggcgagatctacgaggcctacatggcgcttcgctgcaacatcacgaccgacgagcatccgctgggcgtgttccacccgcatgccgagtatcaccacattaagaaggaaaacattggcctgattgaggtcatgggcctggccattctgccgccgcgtctggttcccgagcttggcgccgtccgcgagcacctgctggcagccaaggtcgacgcgagctacgatcttgccgccgcgctcgagggcgacgacctttgccgcagccacgccgcgtgggccctggacgtttatgcccgtcgtgccgatgagctcacggcggataacgccatcgacatcctgcacgaggaggtcggtgtggtgtttggccatgtgctcgacaacgccggcgtctttaagtgggacgaggccggccgcgccgcccaacagcgcttcatcgactcgctgtagcacgcagcctcggacgcccacgctcgacaaatagcacccacacgacaacggcgcccgccggcaacatcgccgacgggcgccgttttctgatgcaagggtagctaatttgggacggggccattttgactacttttacattcaaagtagtcaaaatggccccgtcccaaattagctacctcccatgagagtggaaaatctcccacttggggcccctttgcgagcccaaagtgggagattatccacgctcgttttgttcggcgcgccgtaactctaaagttcggtcacctcaacgctgttgtagacctcgtcccagcgatccatgaccaggtggccggtcttgggatccatggcgttgagcttgccgcaggtattggcggtcttgagcaccgtgacgtcgtcggcaccagccgcaatggcatgcgcaaagccggcgatggtcgagtcaccggaacccgttgcgttcacagccgcaatcgcgggcgtcttggcgcggaacgcgcggccctcatggaagcccaccgaaccggcagcgcccatcgaaacgacaacccagggaataccggcaaagcggtcatctgcggcaagcgcctcgcgcagggcatcgacatcatcggtcgtaaaggacgtacccagcaggccgttaatctcggtcaggttgggctttacgagctcaggcttagcgtcagactccagcgcggcctccagcgatgcacccgaggtgtcaagcagcaccttggcgcccgcctcctcggcgatcttgacgagctcggcatagtagccggcatcgacgccgcgcggcagcgagcccgaaagcgtcacaacgtctgccttcgctgcaagctcggcaaacttggccgtaaaggcctcgagctcggccggggcgatctgcgggccgctctccaacagctcggtctgattgccctcgtgcaggatattcaggcaaatgcgcgtctcaccggcgatgggcacaaagtcgttcttgacgccgtcggcatccataagctcagccatataggcacccatgtggccgccgagcaggccggtcgcgagcacgtcatcgcccagctgcagcagcacgcggctcacgttgaggcccttgccgccagcggtcttttcgggcgtcacacggttaacatcgtcgatgatcagcttgtcgagctgatagcgcgtatcaatcgacgggttcatggtaacggtcagaatcatgttgaactcctgttccggggcggcataacccgccccaaacatacgatagctcgttaaaggatctcgatctcaaagccgcgggtgacggtctcccccggcttggccaccaggcagccgcgcttgtgctccagaatatcgtcctcgtcggagcaggtggacaggccgccccacggttccacggccacaaagtcgccctcgggcttgctccacacaatcaggtacggcatatcggggaacgtcaggcgcacgcccttgtccttggttttcttggtcaacgtaaccacgcggctctcgagcacgtcaaagatggtctccgcgaagtcgaagagttcgtgggtcagcggcaggttctggtcgatcatggggttcttgctgcgatgctcaacatcaatcaagcccgtcgagggaacggcagtacagagctcagcggcctcgcgctgctcaaaacggagctcgtagtcgtcataggactcgccctcgtcgagcgggcacttaaagccggggtgaccgcccacaaaaaacggcatgtcctcggtgccctcattggtcacctcgtacgaaacggccaccttttccgaatcgatcgtgtaacgagcaacgatcttaaacggatacgggtactgctcgagcaactcggcatggtcggcagagcttaagctcagcgcaaccatgttgtcgctctgttcctcgagcttccactcctgcttgcgcgcaaagccgtggcgggcgagctttacctcgcggccgcccatggtcattgcgtgaccgtcacgaaggccaccgcagatcgggaagcaaataggtgcctggcccgaccagaccgccggatcaccctgccacaggtactcacggccgttggccgcaatagaagtgaacgatccgccagccgtgctcagtgccacgcgaatagtaccgttatcaagaacaaactccataggagccttccctttcttacgacagcccaccaagtcaatagggctgatagaaaaccggcccgcgccccctcacagaaacgcgagccgtcaacggactagttaattacgccggatacccgctaatcatggtattcgccgcggtcccacttctcgaggaactcgtcaaagaagtgcgggtcagcctgagcctcggcgtcggccttattgcaggcgtcgatcttggcgatcagggcgtcgtgctcgggagtcttctcgtagggctcctccaggaaggcaagcatgatatcggccatcaggaactcgccggtgatcttgccaccaaagcccacgatgttggcgttgagctcgcggcgggcatacagggccgaggtcatgtcgcggaccagggcgcaacgggcgccgggaaccttgttgacggcgttggtgatgccgatgccggtgccgcacagggccacgccaaagtcggccttaccgctggcaacggcctcgcccacggccttgccgtagatgggatagtgtgtacggctgtggctgtaggtgccgcagtcgagcaccttgtagccagcctgctccaggcggtcggccagatagatcttctcgtccgtaacgatatggtcgcaaccgattgcgatggtcttcttcatcagaacgtcctttcgtctgaattcacaagttgaggtagaagttcgagttctcggtggctctcgttaggccatcttgttgagcatgtcgacacggatctggtgacgaccgccggcgtactgggcgcgcaggaactcgcgggcgatcttcttggcgacctcggtgccaacgacgcccgggcccatggtgaccatgcgcgaaccgttgtgctcgcgggtcatgtaggcggagcgctcgtcggaaatgttggcgacgaccatgcccttcatcttgacggcggccatataggagccaacgccgtacttatcgaaggcaaagccctgggaatccttgtgctccagcaggtccttggcgacggcagtcgcggaatcgacaaagtccgcggcaggggtctcggaatagtcgacgacctcgtggccatcggcgatgagcatctccttgatggactccttcatcgacataccgtcggcatcggaagcgattacaaccctcatgacatcctccttgagagatacgcaggtgcgtagtttctgtttggaagtgttgaatcgcgttcaggtccgggcatctgaatgtgcggttcttcactgttcatgtttatttgaacacattcgaacagtgactgcaacaactatttgtttgtctttgttcttttttgaacaattaccgttcacgggcgtttgctgaccgtttgggcccgacagaggcatagacggtcacgcactcgacaaataagggcgaccgagaacgcatctcggtcgcccttcggcgatatgaatcggtgaaatgatcctttagctactcagactctccgctcttcttagcgtgcctggacggagtacttagaaaacgacctgtcagatagttcgtcgggccggagatatcaatccccagcagtacgtgccccagccacaggaacgccacgagcaccaacagcgggatcacgcacgaggtcacgatcatcacgatgacgccttcgatcaggtcagtcacctgctgcacaatctcgtcggtcatctgcttggcaccactggttaccgacgtaaccaggctcgatgccccatcggtcaactgctcgagcacgtttttggactccgtggcctcggattttttcttgttcgactttgagctggtctcacctgacttgtccgtggcatcagccgtctttgcggcatcgctcgccttttgctcagcttgctcaatacttacgcgatacgtttcatcgaccttctgcgacacccatacgctcgcgggcacgagcgccatgccgatcacggcaaccaccagcacgcgtgtcgccacacggcgcagaacagcgctcgtgctccagcgcccgtgaatgccgagcgacaccgcaaagagcaccaacgcagacgggattaagatgcccaggccaaccgaccacaaaatcgtgagcaaatatttctctagatatagcacggcaagcacgataccaaggttgcctgaaagctgtgcgagctgctcggcaaccggcgttcccgtatcaccaggcagcgcggtaatgcccgcagatagagcaacgcatgaagccgtgagcgccaaaacgttgcctttcttttggtcgataacctcgatggtggagtcccaagttttggtatcggcgaaatgcggacgagctacaaagcccgacagcaacgccagcaccacgagcacaacgatgataccgatctgcagctttttgtttgcgcacacgacatcggacaggctgggctgcagctcggttaccgtcgtgtgctcggttatctggacaggacgcccatgaactatctcgtgcgcgcctcttttttgaatcgatccattgtccggcatttggatacctcctcagtccggcctgtattgcggatggaagtatacccacccagcgaaaaatcaaaaagccctgccgcgaaatgcgacagggcttttggaagggaactgagttgcgcaaaaagggttaggcgagcttggcctcgagctcggcaatgcgcttgtaggcgtcgatggtaaagcgggtctgcttctccagaatcatggtagtcatgagggtgtcctgagcgtgggccatgatgaaggtcatctccatctcgccgccaccggcctcctgcgaaagcagcttggtctgcgtgtcgtgagcaccgatgagcgcatcgctggcatccttgtgcagctgctcggccttctcaaaatcaccttcgcgagcagcatcgagcgctgcaagcaaatcggtctgggcgtcaccggcgtatgcgacgatctcgaatccaaccatcgagatttcttctttggttgccatgttgcgttcctttcacatatgaaccaatggagagcatcgcgtccgggcatacgcgctgcgctgtgtatgctagaaacaataacattcaaacaaaaaggaacaatgcaaaacgcaaatatggactatgaacggtcgatttttgcccgtgaacggtttttaaaccaattcgaacaatatcaaacacgtttggcgacaacccaaacaggtccgcgccctagcgcaaatcgcgtaccgtatcgccctttacgagcacgccgggaatcagcatgtgctccacgccaggcgcaaccccctcggcgccggcgatcttgtcgaccgcccacatgccgacgcgcttgttgttaaagcgcaccgtggtcagacgacgatcgggcacgatctcgcccaggctgtcgtcaacgcccaccacgctcacgtcctcgggcacgcgctttccgcgcgactcgagcccgcgaatgcagccgtaggccatggcgtcgttggaggcataaatggccgtacaggtcggatcgtccgccagagcctgaccggcagcatacccgctctgcgccgtccaatcgccacggatgaatcgcggcggctcaataccatgcgcgcgcaaagtctcgcgccagccctcctcgcgctgcatgcccgaaagcgagcgttcgggacacgagataaagtgcacggtcttgtgtccctgtccgagcaagtactcaacaacctggcgcgagcaatcaaactgatcgttatcgaccgtcgagcacagcgggtgctccaacatggtaacgagcaccgtctgcataccgggcagcggctcaaaggtgccaaagtccgccggtatgcgattcatgatcacaaccatgccgtccaccggcagcgcgctcatgcgcgacgatgcgctctcgagggtataggggtgtccatctactttagtaagggtgatggcatagccgtgtttgtcggcggcggcggcaaagccctccatacggtcgaggttgccggtaccggtaatgttgaacatggcgacgccgacagtcttgaacttgccgcgacgcagcgaccgcccggcaaagtttggacgatagccaagctcgcgcatggcggcgcgcacgcgctccttggtctcggggcgcacactgggcgaatcgtgcacggtgcgcgagaccgtctgctccgagacgcccgcgaggcgcgccacgtctttgacggataccgattttttaacagcgtccataggagatctttctatgtcaacgatgccattgatgacatcctgcgcagtcatgttaaacgccttcaagtatatccaacgcctccccctcaatacgcttaccacccaaaacctaccgttcaccgacaatcttgcttccccaaacggcttttgtcgcccaaatgttaacgttgccattgtgcaaacacagagccaccgggcggctctaacgtttacgcgcaaggaatcgacggtccacaggcacagggaccaccggttcgtgtcttttttcgtgtcgcaaaatggcaacgtcaacattttggcaagctaacgtcaaaagctaccatcgttgctaacccaccgactctaaggagctttgcatggagcaactcatcgccaccatcgaaaaaggccagccctttttcaacgcgatcgcccgcaacaagtaccttaaggcgatccgcgacggttttatctccgtcatccccatcatcatcttctcgtccatcttctgtctggtagcctcggtccccaacatctggggtttctactggcccgatgacatcaacaacgccctgtggaagtgctacaactactccatgggcatcctggccatcgcctgtgccgccaccacggccaagcacttcgccgacgctcagaaccgcgacctgcccaagaacaaccagatcaactttatctcgtgcatgtgcgcggccatcatcggcttcctgctcctttcgagcgacaccatcgccacggacgctgccagcggcttcaacaccacctaccttggctccaagggcctgctgaccgccttcatcgctgcgtttgtgaccggcatcatctataagttcttcattaagcgcaacatcaccgtcaagatgcccgatcaggttccgcccaacatttcgcagacctttaaggacatcatccccttctccgtctgcatcacggtcttttgggtctttgacatcgtcttccgcgctgcctttggcttctgctttgcccagggcgtcatccaggtgttccagcccctgttcaccgccgccgacggctacatcggcctcgctgtgatctacggcgccatgagtctcttctggttcgtcggcgtccacggcccctcgatcgtcgagcccgccatcgctgccgccctcgttgccaacatgaccgacaacctggctgcattccaggccggcgagcacgcctccgccgtcctgacgcagggcgcccagtacttcgtcgtctgcatgggcggcaccggcgccacgctcgtcctggtctttatgttctgcttcttggccaagtcccaggagatgcgcgccgtcggtaaggccgccatcgtccccgtatgctttgccgtcaacgagccgctgctgttcgccgcgcccatcgtgctcaaccccgtcttctttgtcccgtttgtctttgccccgatcgccaacatctggattctcaaggtctttatcgacttcttgggcatgaacggctttatgtacaccctgccttggaccgtccccggtcccatcggcaccatcatgggtctgggcttccagccgctcgcctttgtgatgctcgccatcatcctggtcgtcgactttgccctgtactaccccttcttccgtgcctatgacgcccagaagtgcgcagaggaggccgagatttccgacgaggagctcgccgccaagaacgccgagaaggccgctaagctcaatgacgccttccagggcaaggccgacgccaagagcgttgccgccggcgccgctgccgaggctgtgaagaccgacgccgctcccgctgctgccaccaccgaggctacggccaccagcgaccttaacggcaagcgcgtgctcgtgctctgccagggcggtggcacttcgggcctgctcgccaacgcgctggccaaggctgccaaggagcgcggcatcaatctggagaccgctgccgaggcttatggcaaccacgtggacatgctccccgactttgacctggtcgtcctggccccgcaggccgcgagctacctggccgacctgcagaaggactgcgagcgcgtgggcaacaagtgcgtcgcctgccgcggtaagcagtacatcgagctctcccagaacggcgacaagtctctcgccttcgtgagtgagcagctctcgaagtaagtaacgcgtaaaggccagccgaccacatcaggtggctggcctttttactagacgattggatcatcatgtccgttaaccccgccagcgtcaccaacccgcccgcgcagtttcccgaggactttatctttggtggcgccaccgccgcctaccaggtagagggcgagacccgcacccacggtaagggcaaggttgcctgggacgacttcttggaggcccaggggcgcttttcccccgatcccgcttcggacttctacaaccagtaccccgtcgatctggagctgtgcgaggagttcggcatcaacggcattcgcctctccatcgcctggagccgcatcttccccaatggcaccggcgagatcaaccccgagggtgtgcagttctaccacgacctctttgccgagtgccacaagcaccacgttgagccctttgttacgctgcatcacttcgacacgccgctgcccctctttgagaagggcgacttcctcaaccgtgagaccatcgacgcctttgtggactttgccaccttctgctttaaggagtacgccgaccaggtgacctattggttcacctttaacgagatctgggccgacgcctccaacacctacatcgagggcaccttccccggtggcgtcaaggcgcatctggccgaggctttccagtgcgagcacaacatgatgctcgcccacgccaaggcggtgctggccttccacaacggcggttttaagggcaagattggcgttattcagtcgctggagtttaagtacccgctcaacgagaacgaccccgccgacatcaaggccgccaacaacgagcacgtgttgcagaaccagttcttgctcgacgccaccttccgcggcgactatgcccccgacaccctcgagtgcgccaaccgcctggctgccgtctcgggcggcaccatcgaaatcctggacgaggacctcgagattatgcgcgaggcagcgctctacaacgactacctgggcgttaacaactatcagtgccgcttcttgaaggcctacgacggcgagaacgacctgcaccacaacggtacgggcgagaaaggcaccggacgctggcgcgttaagggtattggcgagcatgtgaacaagcctggcatccccaccaccgactgggactggatcatctatcccgagggcctgttcgatctgctcgtctacattaagcagcgctaccccaactacaagcagatcttcatcaccgaaaacggtatgggttacaaggacccctacaaggacggctttgtagacgaccagccgcgcatcgactacatcgagcagcacctgcgctggttgctcaaggccatggaggtgggcgtcaacgtgggcggctacttcctgtggagcctgcaggatcagttctcctggaccaatggctacaacaagcgttacggcttcttctacgttgactttgaaacccagaagcgcacgcccaaggcaagcgcatactggtataagcacgtggcgcagacccgtcgtctggactagtcaacgtcatcggctgccgtgaccatcacgctgccgtgcaccttaccattcccgatcgcatgggcgctgcgtccatgcacctctttccgtgtggcggatacgaccttcccggtggatgcttcagcatccttggtcgtatccgccgtttttgtttttgggcgggctgggccgcgttcgtttgtctcgatctgtaacatctaactcgcttttggccgtctaactgttacagatcaagacaaagatgatgactgggtagacaaaatctcaatctgtaacagctagtcgagtttttgggtcctagctgttacagattgagatgaacgagccgagcacgtctacgcccgcagatcccgcacactcgcgcgctcgaccaacacgcccgagacgagtgttcggcttctggagcttggggcctccaggcccgcaacgacctcgttaagcgcgcgaatgcccagctcgcggtggcgaaacttcaccgacgtcagaatcgaattgggaatcgtcttgtagagctcgtcgtcgaagcctatcacggacacgtcgccgggtacgctcagccccttgtcgcgcaaagccgtcatcacgccgttggccatgcagtcgttggcggcaagaaccgccgtgcaatcgggcttgtcggcgagcgcaagacccgcggcatagccgctatctgcattccagtcaccccacagcggctcagacggctcaatgccacgcgcctcgagtgccgcgcgccaacctttcatacggcactggctcgacagcgattcttctttaccggcaacgaagtagacgttcttgtgcccgcggtccaaaaagtactcgcacgccatgcgcgcaccgccctcttgatcgtcgctgaccgtagagcaagtagggtgttccatcggcgtgataatcaccgtcttgaggtccttcggcgcctcgaacgtatcgaagtcgtcgaccatctgacgcaagttgaagatcatgccatcgacaggcagttgcgacatcctgcgcgccgcatcggcaagggtcatcttctcccccgcccgcttcttgatcatcgtgagcgcgaagcctcgctcttcggcggcatcggcgataccgtcgatcatgtccacggcaccgcctgacaagtgaaacagcaccacgccgatacacccgtaacggcccaacttgagcgagcgcgcggcaaagttagttcgaaatccgagcgtctccatggccgcatggaccttctcacgcgtcgattcgcgtacgctatcgggctcattgatcacacgagacactgtcttaagggaaacgccggcggcaaccgccacatcgttcattgagacgtttttcttgtccaacgttgccactatttctcccatcggcttcatgtcacatgttttctgcgttctagcatacactacctgcccgactgataaatcaaccgtttaccggacaatattgaccgctcacccgttaatccttgttgcgctttccaaaatgtcttacgttgtcattaacgaaatgataacgttgtcatttcgtaacgccttccttatgcaggagggtttccgggcagtcctgaccatccatcgacgaccagttccatccacatgcatagcgcaccaagcagcaaaggagctccatggacgccatcgtaaagatgctcgaaaagcatcagccgtctttgagaagatctcgaggaacatctacctccaggccattaaggacggattccttgggtgcatgcccatcgtcctgacctcttcgattttcctgctcatcgccacgctccccggcgtcgttggcatcacgttgccccagccgctcatcgactggtgcaacaagctgtacaacttcaccatgggcgttatgggcatcatggtcgccggcaccactgcaaagaacttcacggcttccatgaaccgccgcatgcccgccggcaaggtgctcaacgacggctccaccatggtcgccgcccagtgcagcatgcttctgctcgctgttacgcagttcaccaccaagctcgacggttccgagctttcggttttcgattgcaccagcatgggcacgcgcggtctgttctcggcatacatcgccgcgttcattaccgtgtgggtttataagttctgtgtgtcgcgcgatttgaccattaaactgcccaaggaggtcccgggcgctatcgcccagaacttccgcgacatcatccccttcggtggtgccgtcatcatctgcggcatcatcgatgtggtcgtgcgcaacctcatgggcgttccgttctccgagctgcttatcaaactgctctccccgctctttaccgctgcagaaacctatcctggccttatccttatccaggctgccaccgcgttcttctggttcatcggcgtccacggcccctcgatcgtccagccgggcatcgaccccatccgtcttgccaaccaggccgagaacctgcaggttctgctggccggtggccaccccgcccactccctcacctttaacatgtcgctcgtgggtgagttcggcggcaccggcgccacgttcatcgtgccgcttctgctgattctctttatgaagtccaagcagctcaaagccgtcggtaaggcctcgattgttcctgttgccttcgctgtcaacgagccgctgctctttggcgcgcccatgatcctcaacccctacatgctcatcccctttgttgccgccggctgcgtcaacgtgagtgttgccaagttctttatcgataacgtgggcatgaacggcttctccttcgtggtgccttgggccacccccgcccccatcggtatcttcatcaccacgaacttccagcttattgcccttgtatttgtcgcgatcatcatcttgctggacgccgtcatctacctgccgttcttgaaggcatacgataagctgctctgcgaccaggaggccgagcgcgccgccgagctgggtcttgagtccgatggtgctgccaccatcgctgccagcacccctgcgcccgtcatcgagccgaccgccgctgccgtcgagacgaccgttgccgctgccgtcgacagcgagcctgtcgccgatcagcccgagcccgccgccgacgcatccgccaagaaggacgtcgacggtctgaaggtcctcgtcctgtgcgccggcgctggcacctccgccatgctcgccaacgccattaaggaaggcgccgcacagaccggcgagaacatcgcctcctctgcaggtgcctatggtcagcacaccgccatcatggaccagtacgacgtcatcgtgcttgccccgcaggtccgtagctactacaacgacatgaaggccgataccgaccgtctgggtattaagttgctcgccccgcgtggcaaggaatacatcgaccttacccgcgaccccgccggcgccatcaagtggctccgcgagaacctcgactagtttcctccctctgttggtgcccgaatccccgttcgggcacctctccctattcgtatctcacagaaaggatgactcatgaccaaccccatgcagttccccgacggctttgtgtttggcggcgccaccgctgcttaccaggttgagggcgagacccgtacgcacggcaagggcaaagtgccctgggacgatttcctggctgctcagggtcacttctcccccgatcccgcaagcgacttctacaacaaatatccggtcgatatcgacctgtgccagcgcttcggcatcaacggtatccgtgtctctatcgcttggagccgtatcttccccaacggcactggtgaggttaaccccgagggcgtcgccttctatcacgagctctttgccacctgcaacaaggccggcgttatcccctatgtcacgctcgatcactttgacacgcccgaggccttctaccagaacggtggcgagggcttcctgacgcgcacgaccatcgatgccttcgtcgagtacgccaagttctgctttgccgagttcaccgaggtcaagcactggttcacctttaacgagattcccgcgaccgccgagggcagctttatcgttggcaactggccgcacggcgagaagtatcgcctggacaaggccttccagcttatgcacaacatgatggtggcccacgccaaggccgtcatcgccttccacgagggcggctttgagggcgagatcggcattgtccagaacctggagcccaagtatcccctcgaccccaacagcgccgccgactgcgaggcagcccgcatggccgacgtcatcaacaaccgctgggtgctcgacgccaccttccgcggccactatgcggccgataccatggaagctgcgacgaagctcgcgcatatcgccggcggcgagctcgacgtacgtgacgaggacgtcgccgccctgaccgccgcactcccccacaacgattgtctgggcgtcaacacctacaagtgccaattcctgcgtgccgccgagggcgaaaacgacatcaaccacaacggcaccggcgacaaaggctcctcgcgctggttcctcaagggcgttggcgaggcatgcgtgcgtcagggcatccccaccaccgactgggactggattatctatcccgagggcctgtacgacctgctgctgcgcattaagaacgattaccccaactacaagaagatctacatcaccgagaacggcatgggctataaggacgacttcgaggacggctttatcgacgacgccccccgcatcgactacatgcgccagcatctcgcgtggatcctcaaggcgattgacggcggcgtgaacgtcgacggctactttgtgtggtcgctgcaggaccagttctcctggaccaacggctataacaagcgttacggcctgttctacatcgactttgagacccagaagcgctatcccaaggcgagcgcgtactggtacaagaacgtcgcggagaccggcctgctcatggcctagtttcagccacataccccttgtcggccgcatgcgaatccttccacgggttcgtatgcggcctttttgtttttggtgagctcgagcaggccgtttgtctcaatctgtaacatctagcagggattttcggtcctacctgttacagatttagatggacgggcccgcccgggtcgaaaaatctaaatctgtaacaactaacccgcttttggccgcctacctgttacagatcgagacaaacgcgcaggccaatccgcttaatctcaatctgtaacatctagccgagcttttcggtcccagttgttacagatcgagacaaacggaatcggccaggcagaaaatctcgatctgtaacatctaacgatcatttgaccacctagctgttacagatcgagacaatcagatggtcaaatcctcactttccaggcagctacgaagcgctccactttccttattattatcggtatcacgaacacactttcggtatcttttaatgccgaaatgataccgaaagcgtgttcgaaaatacggttaattccatgcgttagcccaatcaagccccaggcttacaaactccgttttttcagaatgccaatgcattcgcgcttgcgtgtcatttcacgtcacgttgacacgcaaaatgacacgcaaattttttcgtgtcataattttgacgcgtgaaatgacgtgtaaaattttacgtgtcatttttcatgtcaaattgaagcgaaacggagcatcacgatgcaagaatccaaagatcttgaattcaaggaatgcgtcactaattcgttccttaaaaccgtctccgcttatgcaaatggcacgggaggacgcgtgctatttggaattaacgacgacggagaagccgttggcctcgatgaccccaagcagacctgtctggatatcgaaaacaagattaacgattcgatcatcccccagcccgattactccctaaaaatcaacgagtccgatgcaaccgtagagcttacggtctttcccggcagatcgaagccttacctataccgctcgaaggcatacaagcgcaatgacaccgcgaccataccagttgacaccctagggctttcacgcctcgtgctcgaaggtcaaaacctctcctttgaacagctcccggcaaacaagcaagatttatctttcaccgttttagagaatcgcttaacggcgaagctttcgcttcagtcgttcacaaccgacaccctcaaaaccctcggcctgctcgatcagaccgggacctataacaacgcggcagaactgctcgcggacgagaacgatttcccaggtatcgacatggcggtgtttggcgacaccatcaatctcattaagcagcgcaaaactctcgaacatgcatcggttttaacggagattgacggcgctcttgaactatttgaaactcagtactgttacgaagagatcaagggaatggagcgggtccgcaaggagcttattccgctcgaagcattccgcgaggccattaccaatgcaatcgttcacaggacttgggatgtacccgcgcacattcgcatctcgatgtttgacgaccgcgtggaagtcgcctcgcccggcggcttgccagcaagcatgactgtcgatgagtacctatccgatatgctgtccgttaggcgtaaccgcattcttgccgaagtctttttgcgcctgggtcttatcgaggcctttggaacgggcatcatgcgaattcgcgacacctataaagacagcatcaaaaagccccgttttcaagtttcggataatgccattgtggtcacacttcccctactcatggataaccccgggctcgaaggcgacgaacttaccgtattcggactgctgagtagagtacatcctcaatcggcaagtgagcttacggccaaagtaagctttagccgctcgaagcttaatcgcatcctcaaaaaactcgttgagacaggcctggcgacagttgaaggcaccggcagaggacagaagtatcgcctgctgcgctagctagcagatgacctgcgtgtgctcctcgatggcggcacggtcctcggcggagatgctcggctcgcacactacggcgtccaggctgtccaggcggcagaaggtatagaagtcgcgcttgccgatcttgctggagtcggcgatgaggtagcgcgagtcggccttgctaaaggcgagctgctggatgcggccctcgtccatgttcgacgtggacacgtcgccgtccagaatgccgttggcaccgataaaggccgcgtcgattcccagcgcgcgcagggtgtcctcggccgtggggcccacaaaggcggcggtgcggcgacggtacatgccgcccaccagacacaagtcgcagtcctcgcgctcctcgagcagattaaaaaccgaaagcgagttggtcacaatgcgcaggcgaaacgccggcagcatcgaggccatctgttcaaccgtggtgcccgtacccaaaaagatagtcgagccctcttcgataagctccacggcgcggcgtgcgatctgcagcttttcctcggcatgcttggagcgtttttcgctgtgcgagtactcgtggcggagcatcgcatgggggcgaccctgcgcgctgcgggcaccgccatgcacgcgctcgatctcgcccagactcgcaagctcttcaaggtcgcggcgaatcgtcatgtccgagacacctaatgcatcagagatctctttaaccgagaccgtcccctgctcctcgagcagctgccgaaccttatcctgtcgctccgccttaatcacgatgagccctcgacattccacgcgtacatcaattcaaacagtaacgaacaaattgtatcagattcgcgcgggccaaaaatgagcgcttcagctgcgccttcctcactttttttgagaaaaataccccctgctttagtggggtgtagtgataatctcgcctgttcgcgctacagtttgtccgaaatacctcgatgttaggaaccaaatgatcacttccgagcttttcggcaccgcgccatgcggcacccccgttcatcgttacaccctcaacgggcccgagatctgcgttcgcattatggactacggcgccaccgttctgggcattgacgtacccgacatccccggcaacgtacgcgatgtggtgctgggcttcgataagctcgaggattactttgacaaccccgcctgctttggcgcgactatcggccccgtagccaaccgcactgcaggcgccacaattaccatcgatggcacggactggcacatgcccgccaacgagggcgccaacaacctgcatagcgatcttgagcatggcctgcacaagcgtgtgtgggacgttgagctcgacgaggtccacaatgccgtgcgcatgactacctcgctcgaggatggcgagctgggacttcccggcaaccgcacgtttacggccgtgttcaccgtgacgccgacgggccgcttccgtatcgagtacagctgcgagagcgaccgcgccacctacgtgtccatgaccaaccacacgtactttaacctcgccggccacaacgccggtatggactgcgagcacttctttgttgccaacgctgcccactacctgcccattaacgagcagaacatccccaccggcgagattgcttcggtcgagggtacgccgtttgacttccgtgagctgcgtcccgtcgcacccggcatggaggcagacgatccgcagattaagcaggcccgcggctatgaccactgcctatgcatcggcggctaccagtacggccgcaatctgcgccgcgcgatgcatgttgaggagatgtggaccggtcgtgagctggactactacaccaccgccccgggcgtgcagctctacaccggcaactggctgggcgacgagcacgccaaggacgatgctaactatggctggggtgccggctttgccctcgaggcagagatgtaccccgacacgccgcaccaaccgctgttcccgcagggcattgtgggcccgggtcacccctacagcaatgtgatcgaataccactttatgaggcactaagcccataacgcaacatatcgcacagcagcgcccgccggcaccaccgccgacgggcgctttttcatcttttggactcattttcgctgtgactgtatgagtgacatatcaaaactatgcccatttactacgtttagcctgggatgctcgaccatgcaccggtttttgttaaactctcgagccgtctacctgcagttttgtttttctcaaattcgacatgctcggcgatagccgatcaaacgtagtaaatggacatagtttttgacagacggcatcgctcgcatccctcgcaagggcaaaatgatccgttttcctccgtccccaagggatcacttgaacagattgccgatggggtcgggattggagctggggagatagcggatttctagctctacgccgagcgcctgcagttctttgagggcagcgacgtctgcgtcgctcacggcaaccgcgggcgttatggggcgcttgccctcccctgcctgcatatggccgatgctgatcttggtgatcggcacgccgcccttaaccagtgccaatgcatccgcgggcgacgccaccatgatcaggatccattggcgcggcgttgccgcatgaataacgtcaatcgtcctttgcaccgagaagaaacgcgtccacacgccatcgggcgccgccaccctcatgggtgcccacttgcgcgaatccgccgcaatctcgtcgttgacgatgaggacgaggttggtgcccacggcctcattccacagctcaacatcctgcccatagataaagcggtcatcgatacgcgtgagaagaatcttgggttgagccatcgctgccccattctgtttgagacccgtaagggcaagacatcacgtcttgaatattagtgcatttaaagtgagaaaagccgtcagaacacttgcgcggatttgcgatgtcccgtatcatagacagccgttgacgcctcagttgcgtcaccacatggccgccagcgtagctcagttggtagagcaccgctctcgtaaagcgggggtcaccggttcgagcccggtcgctggctccattgcacaagatagccgccttcgggcggcttttttgttgccgattttgcgcacgcccgccaatccaagcgcaacgtcgccggcaaccccctactcaacaacaaaagccccgccaaccgcggtctcccaaacgggaagccacgatcaacggggctcaagcgcgaccccctcaagggaatcacgccaacacacggctcagccgtgcagctcgctactcctcccagtaggcgtcggcaagtagcttgaagcagatcttcttgaccggctgcgcgccatcgcccgggaactcgagcgtgggcatgtgaggctcgccggcaacgaacagggcaaacttgtcgtcggccagatcgccggcgatcgaggcgtcggaatcgaccagatcgtagtcgtccttctcgtcaaactcctgaaccagcgtcaggctgcccgtggcgaccttaaaggcctcgcgaccctcgacgtcgatctgcaggtcgtgatagcgctgatgcgtctcatagtgagcctcagcctcgggacgcgtcgtgggagccatgacgttcgcaaagaccttgtcgcccagaatcggatggctgccgacctcgagctccgccgggtcgttctcctcgagccaatcaatcagcacgtcgaggcccttgagcatgccgcggtattcctcgatatcgcccagtgcaccgtaaatcatctaaatcccctctcggatcgtctctttggcagctactcggtaaacgcgttaccgacgctgttgccgcccacatacgtctcgaccagggtaaggtcgggattgaacacgacaaagtcggcgtcgcgccccggcataatgctaccgcacttgtcgtccacacggaccaacaggaagcgagcaatatcgaggcgcaatccaaactcttacagctcggttacgacaacgccattgtagacctcgtcccaacggtccatgaccaaatgacccgtcatcgggtccatggcgttgagcttgccgcaggtattggcggtacgcagcactgtctcgtcgtccgcgccggcagcgatggcatgcgcaaagccggcaatggtggagtcgccggagcccgtagcgttaacggcagggatatcgggcgtcttggcgcggaacgcacggccgttgtggaagcccacggagccggcggcgcccatggacacgacgacccaggggatatcggagaaacgggtgtcggaggcaagcgccgcgcggagctcgtccacatcgtcggtggtaaagctcgtgcccaaaagaccgttgatctcggtcaggttaggcttgaccagctcgggcttaatttcggacttaagggcggcctcgagcgaagcacccgaggtatcgagcaacaccttggcgccggcgttctcggcaatgcccgtgatcttggcatagtagtccgcctcgacgccgcggggcagcgagcccgagatagtgacgacgtcggccttgctcgcaagctcagtgaacttggcggtgaaggcatcgagctcctcgggggcaatcgtcgggccgctctcgagcagctcggtctggttgccggcgtggaggatattgaggcagatgcgggtctcgcccttgatgggcacgaagtcgttgttgatgccgtcagcgtccatgagctcagccatgtaggcgcccatgtgaccgccaagcaggccggtagccacgacatcgtcgcccagctgacccagcacgcgggccacgttgaggcccttaccaccggcggtcttttcgggcgtcacgcggttgacgtcgtcgataacgagctcatcgagttgatagcgcgtatcgacagacgggttcatcgtaacggtgaggatcattttaagctccttatctcgcaggcttcttgtgcctcgcgatacgagtcgacaaaacggaattacagaatctcaatcgtgaacgagcgcacgacggtctccttgggcttggcgataaggcagccgcgcttgtgctcaagcacatcgtcctcatcagagcaggtcgaaaggccgccccaaggctcaactgccacaaaatcgccctcgggcttgctccacacgatgaggtacgggaagccctcaaagctcaggcggacgcccttgtcctcgcccttcttggagagcgtgacctgacgactctcgagcacgtcaaagatggtctccgcaaaatcaaagagctcgtgcgacagcggcagagtctttcccaccatggggttcttggagcggttagccacgtcgatcaaaccggtcgaggggacggcggtgcaaagctccgcggcctcgtccttctcaaaacgcagctcgtagtccgtataggcctcgccctcgtcgagcgggcacctaaagccggggtgaccgccgataaagaacggcatgtcctcggtaccctcgttggtcacctcataggaaacgcgcacggcattaccctcgagcgtatagcgggcaacgagcttaaacgggtacggataatcactcagcaatgcggcgttgtcctccgaagccaggcacatcgccaactcgttctcgttctggctcagcagcttccactcctgcttacgcgcgaatccatgacgagcgagcttcacgtggtgcccggcaaacgtcatggcattgccatcgcgcaggcctccgcagatcggaaagcagatcggtgcttgaccggaccacacggcagggtcgccctgccacagatactcgcgaccgtcagcctcgattgaggtgaacgagccgccagccgtggaaaccgtaatagaaatcgaatcgttggaaagagcgtattccattgcccatcctttcgaacaactgctttgtcatcgctcgcaagcacccatctcagtactggttaaagagcaaacccgcgcgttcatcgatgtgtccggtatcccagctatccaacggggtaccatattgacattgacttcattacagctgaagggccttcttatgcgaaccatcatcctctacgcctcgcgccaccacggcaacacgaaaaagctcgtggacgccattgtcgaggcacatcccgaaatcgataccctcgacgtaaaggcactcggcaaaaatgagtaccccgacctgcacgagtatcacctgattggtgtcgccacgggcatttattactccgagatcgacaaggatatggcacgcgtactcaccaacgtgctgcagccgcaggacaaagtgtttggtcttatgacctacggcggcaaaaacaagtggtacggcaaggatatcgatggcatctgccgcatgaggcaggccatctttatgggtgtctacggatgcaccggctttgatacgtggggcccgtttaagctcatgggcggcgttcagaagggacacccgaccgccgaggaaattaagggcgctgtcgatttcttcgataagatcgaagatgagtacggcgacatcatcgtcgaagagtacgccaaacgcgagaagcgtcttgcctatgaaaaggagcatcctgcgggaggcctggtggccggcgtcaagcgcacggcaaagaagatcgctaacaagctgtaactgttaaggtgcttttgagcgttaacccatacggcgggtccgagcaaattcgggcccgccgtctttttctgtcgttactcggtaaatgcgttgccgacgctctggccgccaacgtaggtctcaacgagagtgagctcgtggtcgaacacgacaaagtcggcgtcgcgacccggcatgatgctgccgcacttatcctcgatgtgcgcggaacgagccggcacctcggttgccatgcgaatggcgatatcggcgctggcgataccccagtcgacgatgttcttgacgccctgggcaagcgtgagcaccgaaccggcaatgctcttgccgtcggcgagccagcacaggttgtccttcatgatgacatccatgccaccactggtgtagctgccctcgggcataccgccgcaacccaggcagtcggtgatgagcaccgtgtgctgccagccctttgcctgcagcagcgccttgatggcggcagggttcacatgcttgccgtcgcagatgacctcggcgtaggtctcgggggtggtcatagcggcacccacaacaccgggctcgcgatgatgcaggccgcgctggccgttgtaggtgtgcgtaaagcagctggcaccggcgttgatggcggcgacgcactcgtcgtaggtggcatcggagtggccgatgctggtcaccacacccttggcgttcagggcggcagcataggcggcggcaccatcgcgctcggcagccatggcgctcttaacgatgcgcccgccagcagcctcctgccactggtcgaagacctcctcggaaggatcgatcagataggcggggttctgtgcacccacgtgcttcatggtaaagaaggggccctccaggtagatgccctggatgcgggcaccgcagaagtcggggccgcgaccctcgtcggcctgggcgatggcggcgcaggcgtccttgatctgctcaacgccgtcggtaaacgtcgtgggaagccagctggtggtgccgcgacgggcgagctcggtcgagctgatatcaatgccctcggggtcgttatcggtagtcgaatggttataaaagccatggatgtgggtgtcaaccatgcccggcgcgatccacgatcccgtatagtccttaatctcgcaagagggctcgtcggcctgccaagcgccaaagacgccgtcctcgaccatgagatagccgcccagctgcgggcccgccggcaggaagaacttgtcggccttaattgcgtacgtgctcatatgcactccttgcttccaaagcagttaactgtggtgatgcttatacccagctcacgtaaaacaaaaagcgcccgcccgccgttatgagcggacgggcgcccttacagggggacgcgattaagcggtgaaggggtgaatcgtcacgcccttgaccacgcggttgaccgtgccggtagggctcggcgtatcgggcgtgttgcccacgcgcacggagttgagcaggctgatggtctgggcaaacatcacgaacggcagagcaaggtagccctcgggaagcgcctcgtagcccttgaaggtgaaggactcaccctcgtagacggtgtcaccctcctgctgaacggcgacggtgtgctgagcgatgtcgtcgccaccgatctcgttgaggatgtcgatgtcgtactgacgggtgtaggcgtcgttgttgacgaacacgaacacgagggtcttgtcgtcgacgaaggacttgggtccgtggcgatagcccatggaagtgtcgtaagaggtggcaaccagaccgtgagcaagctcgaggatcttgagctggctctcctgggcaaggccaccgaaggagccggagcccaggtaggtcacgcggctgaagtcgccagccaggtaatcggcgacctcgggctcacgagcgatgacctcctcgcccatcttggcgatggtctcgacccactcggccttctgctcatcggaagcctcgtcaaagatgagggtggagagcagggtcatgcaggtgtaagaaccggtcatggcgaagcccttgtcgttggcgcgcgggatgagcagcgtcagcgcgttgggatcatcggcggactcgacggcaagcttgccctcgggagcgcaggtgatgttgaggaacttgacgttgtggacgagctccttggcaacggcgacggcggcaaggctctcggggctgttgccggaacgggcgaaggaaaccacgagcgtgggatcctcggcgcgcaggaagtcgcgcggagcgctcacgatgtcggtcgtggcgatgggcttaaagtcgtagagatcagtgttgccagcgtgacgcaggtacggagcgcaggtatcgcccacgtagtcagaagtaccggcaccagtgaagacaacggacagacggccctcgcccatggcgcgagcctcggccaggaaggcctcgatggcctccttgttctcgcggtagatgttgagcgtatcacgccaaagctcgggctgctgtgcaatctcggccgtggtgatctgggcgccgagctcggtgagctcctcgacactcttctcgaacatttctaatacctctctctagaagtaatcctctgacgtgcaattatacacttcggttggttatctggtagtaaccagttaaatgcaaagaatcatcacatgaaaacactggaggcgctaaacgttgcgctggtgataaaccttgtatttaaactgatcggcacgagcaaccgagagcgtatactccacaacctcgtttgactcgttatacgtagtcctgaccaaatcgagcacaggcgaaccctcgacgatgcccaagagatgggcgtcggtgggacgggctatgctcgcatagaactcctcttcggccacgcgtatcttttgctgaaagtcttgttcaatcacatcgtaaagcggcttgcgctccagaagcggtcgcttgagggataagaattgacgaaccggtagatagctgcgttcgaccatcatgggcatgttgtcggcagaacgaaggcgcttgagcttaaagatacggtcgccgatgcggcatcccatatgctcggccagattcttatcggcctccatctcgcaaaactcgagaatcgtagtctctggatcgcgacccatcgcacgcatctgctcggtaaagctgtaggactgcataaggttggttgcttttgccgaacggtcggtcacaaaggtgccgcgaccgtgctgccgaaccaccagtcccaaacgctccaactcctgcagagccagacgcactgtggtgcgcgagagaccatagcgctccgaaagttcgcgctcggaaggaatcatgtcaccggcatgatattcatggtcaatcttttcggtcagaatatcgaccagctgatcgtacagcggttgcttgcgcgctccgatcgccatcctatcctcccttttgctcgaattcaactagtacctagggtgtttagcattatctgactgctacacccgaatcatcaagaaaacaaaagccgcgcgctctttcgagcacgcggcttttaacatacacatggcttaaggggtcggggtgtgagccgcgtagggacacacccctcaagctagagccttaccagatgctcggccagagaccaagcgggccagcgcccaggatgcccaggacgaagagcaggagaatgcccttggtcggggtccagctgtgcttagcgaacatgtagtaaagcagcagcgtgagcagcagcgggacaagcttcgggacgatggtgttaagggtgtcggcaacagagaagttgaccggatcctcggtaacggtgccgtaggtaacggactccatgccgttgcccaggtcgacgacgccgcacgggacagcattgccgtcggcatcggtggcggtgagggcgtcgccgtcctcattagtcatggcgatggtaccggcctcagcggtctcggtgtcgatgccctccataccggtgaagttctcggcctccttctcggagacgatcacggtagtggcggacaggccacgggtggtgccgttggggatctgaaggttgatctgggtgccacccatggtgacgaccaggcaaccgacgacgaagacgcccatgatggaagcggcgcgggtgaaggcctgcatgttggcggtcagagcgtcaatagcgctggtgccaagcttgtaggaccagttcatgagccagaagcgcagagcgaactggacggcgttgaagatcaccaggaagatgatcggcgcagcggcgttgccgttgatggccatgttggaggtgatgccggccgtgataggcacgagcgtcagccagaacagggcgtcaccgataccaccgagcgggcccattgcggcgacgcggacggcgcggatcgtggggatgtcaaccttgttctgctcgagcgaaagcacgatgcccataacaaaggtgacgaggaacgggtgagtgttgaagaactccaggttgtggctcatggaagccgcgaggtcgttcttgttggtgtggatcttctccagaccggggatgatggagtagagccagccagcggcctgcatacgctcgtagttgaacgaggcctgcaggaagcaggagcgccaagccatcttgttgagggtcttctggtcgagctgcggagcaggagtgagatcctcgtagtgctccgggatcacatactcattagatgccatcttcgaagtcacctccgtcagaaacagctgcacccttcagctcggtctgctgctggaagtcccagaaggcgatgccgaagccgatgagagcgaggatgagcagagcaggggttgccagagaatcgttggcaacggtgatgagcgcgaggccaaagcccatgaggaagaagccccacatatcgcggttcatcataaccttgagcaggacggcgaagccgacgaagcgcatcatgccgcctgcagcggagagaccggtctgcagccaggtcggaatggcggaagcgatggtctgaccgatggtggcgccagcgatgaagaacagggtgacgacgacagcgaagatcaggccgagcagagccatggcgaagtagttcagacgctcgatacccttggtgtcagcgttgtgagccatgttgtccgcggaggacataagcggcgacataagcgtgaagaccagggtgacgccgagctggccgagcagagcgaacggaatggcaaggccgacagccgcgttgggctcgaggcccgtagcgattgcgagaatggctgccatgatgccgccgataacggcgttaggcggctgagcgcctccgatcggcatgttgccgatcgtcatgagctgataagtaccacccacgagaagaccggtgttgaggtcgccaaggataagaccgatgacggcgccggtgacgatgggctgatagagagactcgaggaagttgaactggtcgattgccgcgatgaacgtgacgacgaagaccagagcgacctggatgatcgagtattccatcttgctcctcctttcaaaatgtatgtacgcacttggattcacgtacagaatgtcagggtttcattcctgacaacgtggatacgaggattacgagaagagcttgctcgtgtcctcaacaggcgtgctaggtacgcgcctgatctccaactccacccccaattcctgcagctctttaaacgcagcgacatcctcgtcgttaactgcgacggaggtggcgacttggcgctttccttccgacatgtgcatgttgccgatgtttaccttctttataggcacaccgcccttgacgagcgtaagcacgtcttccggtgtttcggccacgatgaagatcttctggcgcgggctcgccttgccaatgacgtcgatggtcttctgcagagagaagaaacgcgtagcgacgccggtgggagcggccatcttcatgaggttctggcgcatggtgttggtcgacacgtcgtcgttggcgacgaggatgaggttggagcccagggtggagttccactgggtggcaacctgaccatgaaccagtcggttatcgatgcgggtaagaagaatgttgggttctgccatgttgatcagcttcctttcgttgattgctgacgacagttacttgatctcctgaatcgcgtaacgcgagacatctacgacggcaccggatcgaactttgatttggaccttatcgccttcgatgcccttgacggttccgtagataccgccggcgaaaaggacctcctgacccggcttgagctcggtgtgaagctctttgaagtacttctgcttcttcttcatgttgatctgagaccagatggtgtaaatcacacccatgatgacgagcagacccaaaagagcgaccgaggagcttagaacgctggctccgaaatcggccattagatgccgtcctcgtcgccgaagatatcctcttcctcggcaccagcgacggaggcgaccgtctgggcggtgatgcccgtctggccaacggtcacggcctgctcgccaagctcggcgagcgtggcattgccgcggaggaacagaagctcaataaccatgggaaggttggtgccggtcagaacctcgacgttgtcgacatcctgggcaatcatcatcgactgattgaagggggtgccaccgagcaggtcggtaaagacgagcacgccatcgcactcctcacgcatagcggtaatggcggcgcgaagatcctcaccgtaggaggcagcctgatcgccctcgaaaggaacgacggtaaaagcgggctggtcgccagcgaccatagcgatagcgctcgcaaggccgggtgcgaactgtccatgaccggtaagaataaagccaaccattcaaatttcccttccgaaggtgtgtgcgatctgagttcgatggttttcggaagccagcgggcggatgcccttaaagcttcttgaaaagcgttctttgaagaccagtggtctctcaactggtagtaaccacgtgacgtgttgttgtcactatatcaccacagaagaggtcgctttcgttgattcatacagtaaaacgtttttgcaccgctcacggcgataaatcgaccgtttaccgctcattaacacttctacctgcggttttgaaaccgtttcgaaatgattgggcgaaagatcgggtctcacactgcgtctaaacaacgcagggcggctaaaaatggcgtgtagaaaaattgcaggtcattatgaagatttttgaattggtctttttgacttaataccagtttgaaccagtttcgaaattatcggtgaacggtagttttcgaccgttcaccggagaattgcaatcgtttacagccgttttcccagatgaaatggggagacacaatggaatgcttgcgcgatcacgaactcttccctaccggcctcgacggggacaaattcatcaggtagcgcctattccgccccaccctctcgacgcaaaaagcccgccagaacgatccgttctagcgggctcaatcagatatatcggctacgcgctcggtagctcgggcaatctttacgcaaacaggccgtagatgctgatgttggccttggcatacaggccgttagcgtactcggtccacttggagctggcgctcgaggcctgcgaagagtactgctgataggcggtgtagtaggcggtcatggcctgcttgtaggtggcgctatcggcggtaaaggcgtcgtcggcgaaggccttggcgtaggtgctgtcctcgtccttccaggtgcccttcgagctatcccactcgtcgccggcaaggttgatgatgtagtcggcgtaatccttgctcgcggtctcctcgttgccgtcggcaggctcagtcggagcggtcggcatgcttgcagaggtgtcgcctactttcttcttgtagagcttctgcagcgtcgcggactgacggacaatctgcttggcctggtccttggacacaccatactgcgtggccattgtcttgtagtcggaggtgccgatggaatcctcggcgtactgcttcatctccttggaggagacggtaatgccctcgtcctcggcagcgtccagcaggatctgattgcgcacgtaggaaaggataacgtcggcagacggagcggtgtagttgccgtcgtcatccttgacggtgtcgaggctgtactggctctcgatggcctcgcgtgcggtgatgtcgctcttcttgccgttgtagctgtagctcgctacggtcgaatcgagctggtcctcggcgagggttgccgagccaacgcccttgccgccaaaaccaccgttgccgataaagaagccgaccacggcggcaaccacgatggcgatcacaaaggcggcgatcatcgtcttcttgtgcttggaggcgtggtcgtcctcgtcggagtcggcgtcgtcgtcctcatcctgctcctcgggcatcagattctcgtcggcggcgtccgcggcgatctgagcctccaggcgggcatcctcttcctcggcggtcgtaccggcggcaatatgctcggcagacgtaccggcgaccaggtcgatcttctcctcctcgtcaccgtcggggccttcgccgcgctcgatgatctggatgccgtcgatctcgtccttctcgtccttcttttgaatcagacccatagtcagttactccttgttgggaaacatagtcctcaatagaatacgcccgacggagcgccgggcgtattgattcttaggttaaacgcaaacacttaagtactatttaggcgtttgcgggccatttgctttaggcaagatgcgcgataacggcatcggcgaaggcctgcgtgcccacggcgccctcaacggagccggtctgggcgcggcgaacgtcaccggtgacctgcttgccctcgtcgagcgtggcggagacggcagcgcgaatgcgattggccgcatcgttctcgcccaggtgatcgagcatcatggcagcggacagaacctccgccgtggggttggcgatatcctggccggcgatatcgggcgcggagccgtgcgtggcctcgaagatggcgcagtcggcaccgatattggagccgggagccatgccaaggccgcccaccaggccggcgcacaggtcgctgacgatgtcgccgtacaggttgggcagtaccaggacgtcgaagtcgttggggttctggaccaggcccatgcaggtggcgtcgacgatcttgtcgttgaactcgatatcgggatagttggcggccacctcgcacgcaacgcgcaggaacaggccatcggtcgccttcatgatgttggccttatgcacggccgtcacctttttacgaccgcagcggcgggcgtactcaaaggcatactccacaatgcggcggctcttggcgatggagatgggcttgatcgagatggcggaatcggcggcaaaggtcttctggcccgagcgctcgacgagctgcgagagctcctcgacctcggcagcgccctcgtcgaactcgatgccggcgtagaggtcctcggtgttctcgcgcacgatgaccaggtcgacgtcgcggaaacgagaaccgtcgcccggctgcgacaggcaggggcgcacgcaggcgtacaggtcaaaatgcttgcgcagggcaacgttgacgctgcggaagcccgtgccgaccggcgtggtgatggggcccttgatggcaactttggtctcggcgaccgcgtcgagcacgtgctggggcagcggcgtgccaaactcgtccatgacgccggcaccggcctcctggacgttccagttgatctggacaccggtggcctcgaccacgcggcgcatggcctgggtgatctcgggaccgataccgtcaccgggaatcaggactacatcgtgcgccataatctgttactcctcgtcttcggcgtcgtcagattttttaacgctagcacgcttcttctttttggagagatccaggccaaaacgtttaacaagcatttcgcaaatctcgctcgagcgggccttgagatagctgcccttgccgttctcggcatcgaacttaaggcgcagcgcgagcttctcggcaacctcggcgtcgatctcgccctggccaaactcgtacaggcaaccgagcatgtcgcgatactcgaggtcaccgtggtaacactggatggcctcgtccaggatcggccaggcctcgcgcgagcgctcgacgctcgtggcgccccacacgcacagcaggcggaaggcggcgtagcgcagcgtggaggaaagctcgtcgaacagcgcggtctcggcgccctcaaaggcatcgcccatctgctcggggcaggtggtagcgagcgccgccagggcatcgagggcctcccagcgggtctgagcctcggggcggtcgagcgcctcaatcaacgcgggcacgcagggcacgacgcgctgcgggtcgcgctcggccagcaggtgcagcacgcgggcggcaaactggcggatgcggcgcgtgggacagccgagctcctgaaccagacggtcgacggcgttctcgttctcctctgccagctgaagctgtgccagctcctcgtcggtgagctgttcgtctttgttttctgccatagttacctcttcttatttcttagcgtgcttgccagcacccttgctgtcatcggtgaccgagataagctgtcggtcggcagcgccgttgcgacgcgcgcggcggcgctcctcggcgtcgcccgcatcggcggcggcgcggtgagctttgttgacgttaaagacctcgtcatgtttgcgccacgggccaacggactcgccaaagctcatcttaaggccggcgataaaaccgccgagccagccgatcggcgcaaactgcaccagcgggaacagcgagaacacccaggtcagcaggatgactgccgccgcacccgcaaagttggcgatccagtagtcgcgcttggtgatcacgcgcttttcgcaagcccactggccgcacaaaaagccaatgtagatcgcaaagataaagagcaccagcgcgagcaccacgaacgtccagctcatgggcgctactcctcgtgatgatggccgcagcagcactcatggccgtcatcgtggccgtgaccgccgcagcactcgtggtcctcgccgtggtggtggccgcagccgcactcgtggtcgtcgccgtgttcaccgcaaccgcagccgtcctcgtgggcaccgtgctcctcggggcgatactgcgaccagtccagaccggcggcaatggcgtcggcctcctccttgtagagcaccgtgatggcctgggtgcccagcttggcgccaccgatggcgtcgagcatgtcgtagagcgtaaaggccacgtcggcgccgggcagcgcgagctcgcggtcgtcggcgtaagcgagtgccaggcgcaggtccttaatgaagtgctcaaccataaagccgggcttgtagtcgccgtcgagcgccttgggagcgaggctctccatggcgccggacttgccggtaccgcccaggatcatctcgcgggtcttctccagatccaggccgttgagctcggcaaatgccatggcatcggccatgccgaccatgcaggcgcccagcgacacctggttggcgagcttggctgcctggcccttgccggcaccatcgaagcagcagatgttggccgcgaaggtggccaggatgtcgcggaccggggcgatgtcgttctcggtggcgccaacgatagccgtgagcgtgccggcgatcgcacccgactcgccgccggtgacggggcagtcaaacgccatgcggccggagacctgggcggcctcggcaatgtcgcgggcgagctcgggcgagctcgtggtgagatcgatcaggaccgcaccgggcttggtgcaggccagcagaccgtcgcccgccaggtagagctcctcgacttcggagggatagcccaccatggtaaagacgacatcggcgtttgccgcggcctcggccggcgtctcggcccagacggcgccgcgctcgacgagtgcagcggccttggacttggtgcggttgttgaccgtgacgggatagccggcgtccaggatgtggccggcgatgggggcacccatgattccggtgccgatgaatgcgacggagagcttgtttgccatgaaacctttccttttgggttgggtgttgttaccaggttgaatactcggcgccagcgcttgaactgcggggcgcctgtggtcgtagcgcctgcctactcgccacgcacacggcgcgcgatgcgatcggaaagcgaggccttctcggcgcggttcttgccccaaaacgcgcaagccaccatgccggggcccacgtgcgaaccgatggtggggcccacggagctgcggatgatggtgatgtcggcgcagccttcctccttgcggatggcggcctcgagccagtcaccgtccttctcggcgtcggccgtcatgatggcgatgggcatggtgcgatcgggcacgtagttctcgcggaacgacttgaggatggacttgagcgccttcttgcggccgcggttgacaccgatcagcgacagcgagccggcaaggtcgtaggagagctcgggcttgacatcgagctttgccgtgagctgcgccgccgcgggcggaatgcggccgccggcagccagcgcgtcaaagctctcgagcgtaaagtagccgtggacataggtcttggcctcgtttgcccaatcgaccagctgcttggcggtcagtcccgccgaacgctggcgcacggcctcgagcgccaagagcgcgccggtcgcgcagggcagagcgttgtcgaccacgtagagctcaaaatcgggatactcggcgcgcacggcgtccgccgcctggcacgcggagttgtagctcgacgacagcgccgaggtaaagcacaggtagaccgtgggcgtgccctctttggcgcactcggtaaagaactcgatatagcgaccgagcgacacagccgaggtggacacgcgggcaccggcgcgcatccggtcgtagaactccttgggtgtgatgctcgaccagatgtcgtccgtgcgctcttcgccatcgataatgaaggggaaacccaggatatcgacatcgaggttcgcggcgacctcggggctaaagtcgcagcaggtatcgacgacgatgcggcaacggtccgaatgaccggcggatgcggccttgtccatcaaagcgactccttacgtaaaaaggcggccacccgcatgggatggccgccaaccgttaactcatgcaagttaacgtattttactcgtcaagtgtttcgatgcggggcttgatgatgccatatccaccattcttacggtgatacaccacattgatgaggccagtcgtcgcgttctcgaacacgtagaagtcgtggccgagcagatcggtctgcaccagcgcctgctcctcagtcatcggggtgacgtcgatgaccttctcgcggacgagcaggtcgtcctcttcctcgggcagcagcaggtcggccagatcctcgacgcgctcgaccggtgcgacatccgctgcgctggcaccgccctggcggttgtccacgaccttggtcttgaacttgcgcagctggcgggtgaccttatcggcggagaggtcgatggcggcgtacatatctgcaccgtgctcggcaacgcgaatcaccgaaccgcgagcacgaaccgtaacctcgacgattgccgggttggggttcgaggggttcttctcatagcgaagtacaacgtcgaccgtcatgggctcgatatcgaaaaccttgagcgcctcgccgatcttctcatccacatgcgcacgcagagcatcggttaccgtcgtcttgcgtccagaaaccttgatatccatacgtggctccaatctgcctcggggacttactgtactggctatgtacccattgccgtgcatttaatcacgcggattcctaaagacccgaataacgattgcttgataccgcataccgaagtctcgcacttttctgtggcaaagtgcgctataggagggggccggcggctttgtatttggtcccgaaaattggctttgacctgctagttttattgggatgaaaaagccgggctcccccatcggggaagcccggcagtgcgtgttgaaaccgtgaagagatgtcctttccaacgtataggagacaccacccctagcaataactagctattgagtttgttaatgtcgtcgtcggtgatggtgccttcctggctggacgagttgtcctcggaggatgcggtctcattgttggaatcggaggactcgctgccggaggacatggtctcactggactcagagtcacccggctgcacgttagcgcccgaaaccgtcttagtggtgaggtcgtagggcatcgtgccataccagacagagtggaccgcctcgagcgtgccgtcggccgtaataccgtcgagggcatcgctcacggcacggcacagttcgtcattggacgaggcgcccgcaacaccaagcgtcgagggcgcctcgagcgcaccgacataggagacctcgctcatcaggcgtgcaaggtagccgccggccgtggagtcgcagatcacatagtcgacctcgccggactcgagcgcctcaaagcactcgttgatgttggagtaggtcttttggttggcggtgatgctctgcttagcaagcgcctcctgcgaggccgaggacatttggacacccagagtagacgcgttaagagtatcggtggaaacgcttagcgacccaccatcgctagttttaccgaacacggaagtggcatcgtacaggcaggtgccgagcgagctaatgtccccgtccgtggagttaatctcgccgataaagatatcggcctttttgtcgccgagcacggaacctaccgaggacgcatcgacaaaggcgaccttaaggcccatgcggcttgcgagagcgcgggcggcgtcaaccgcataccccgtgagctcgccgtcggcgtcctgcatggcctgcggcgcatcggaagtatcgagggcgaccgtcagggttccgggagtgaccagggcatcgtccgacaccgccggcgtgacggtctcgtactcgatctggtcgatcgtgggagtcgtgaacgtagacagcgggttgaacgcgcatccgctcaggcccaaaacggcgatgaccgctgcggtcccagcacctaaccgagccgcgtgcatcaagctgcccctcaccatgtccactaccctgccttctgtgtcgtatacgatccgtgcgttgcgcggaatatcaggttgttcccaccagctgacctggtatttgaccccacacttgcgcaccggggtgtttgctcgggaggccgcagccaccttcacgactggcccgctcgcccgcgaggcggtattgccccaaagaaagtagaacggacggtgcggcttacatctaggacgcgccatgatcgcgccgcgcgcacgcggtcgcttacgtggatccctttgaccgcgtctgtcttggactaggacgggcatttcgtccgtccgcaaccacagcctggtaggaacgaagcgcattatagctaagttcaagctaaagtttaaggttaggggcgtcattcgcatcgcgagtacagattttgcgggtcggagcggaccattcgtgcccctatgaagcccggagcttccctacggggagctccggggcacccgtctcagggtgccgtgtgcaaaaaacggcaaatatgagtactgttaccaatttagtagcagcgtattaccgcctcacgagccctttttgagttccgcacagcctgcttggcgccaagatattccacattcgtttattatctcttcgctgaatccagattatcggcccaagtttctttgtttttgctgtcactaatctagtaacagtactcatatttgccgttttttgcacagagcatataaacagaccccctataaagccatagttttacgctggtttgagcccaaagcacgctcggagcgtattcagcagagcatcttgcctctttcgacgagcctctacgcgattctgatatcgcttacccatacgctggtggatgcgccatgcgagtgcttccatcgcttccatgtcacagagcatttcgttgttgaccgtcgcgacctcgattcccatagtaatcaagcccgtgttgcgcttttcatcatggatacgtcccctccgagaggaatggcccagctcaccgttgtattccaagtcaaaccgggctgcttcctgaaaggcatcgcaaaccgcatgcggcatccccgagatcgcctgtgcacggtcgttgaactcgatcttgtagtcggtcttaaagggaccacaggcaaatccgccataggaaaacggaagcgaaaacatggcaagcatgatgcactccatgggtgaacgcaggttttccgacagatagggacacagccgccgcagctgcttggccgcgctccccttgcatgccgcgaggtaatctaccaggcaatcgggtgtcagcacggactcgacctcaaagtaaccgacatctggcggctggtctttgtcctttgccaatttgttcacgacaggcgaggtgtagggaggcagatacttcccgcggtcactcagtgaaatcttagaacacagctcctgggccagggcaaatgcctggatgcagccgacctcgcgcgcgacggctacgcaaagggcctcgggagatagactgtacacccccggttccacctctagaatcgagccggcgggcaactcggagcatacggaccagctcacgccaagaatacggcggcgctgcgctgcagaccctaccagcaagcacaaatcctcttgcacctcgccgcttgcggccccaatccgcaccaaatcgggaagatagatgtcctcggtcgagggcgacgatgtgcgcagcacacggcgctcttcatcgggattaaggtccttccagctgatatagcccatctgccggcgctcggcgcgcatcatgcgcagcgccgaggcgccggtcagaattatggaagccgctagctgttcgcctgtcggctcgttgcgccgctcaatctttactgccacaaaaccacccctaccaaacgcgtgcgatagcgaggccatcaacggccgtggcaccggcgcgcttgagttccgccgaagccgctgccatcgtcgcacccgtggtgataacgtcatcgataagcagcaggtggcggccgtgcacgtcctcaaccgtctcgtacatgccttgggcacgctcgcggcgctcctcacgaccgagttcgcgctggtcgccatgcccgtacttgacgagagcatcgagcagaggaacacccgacagctcgcaaaatgggcgcgcaatagcctccatatgatcaaaaccacgccgccgaaacgctgccgccgtcgcaggcacaaacaccaccgcatccgcaccggacagcacgcctccgtagcgatcgggcgctacgacctgggcatgcagggcggtgtcgtagagcagctccgccagatacggagccagacgtcgctcgcccgcatccttgtacgctttaatgatgcgcggcagcggatgcgcatagacggcgcacgccaggcagcggtcgagcgcctccgccattgccgaggacgtgccctcgaccgaacactcagtgcacagcaaatccccaaacggggcgccgcatcgggtacagctatgacgtgggtcgatgagcgtgagcgcggccaggcagtcttggcaaataagcgcatcggcgcgttcgcagccggcacatcgtgttggcgacaatgcctcgagcgcctcgtacgtcgcgcgctcggcaaacggtagcaattcgtccgcaaacggtagggcaccggcactctgcagacggctcaatatgttcagatggctcttcaagacacaaccctccctacgctcgatcgcagggagggttgttgattcggcgctatgataccccgatgcgctcggggcaaggcgggttaaatccgctcgcgggcgttattcgccggcgggcggttgtggtgcggacgaagacggggtcgagccctcgccaccatcctggcgcggcttgcgggaacgacgacggcgacggcgcttttgaccctggtcggccgagccctcgccaccgcgcggctcgcgctcgtcacgagcggcgccatgcgaagccttggcagccgctcccccgccatctccgggacgacggcgcgtgaccttgacctcgccatccgagacctgatcggccacggagggcactgagggcttctgctgcgcgcccgaggaatggcgacggcgcggacgcggcgcgcgctcctcctcgccacgtggcttgccgcccttgtcgacaggcgcatcggaggccgaggcgcccttggaagcggcaccggcctcgcgagcagctgcggcgcggaaggcgtcctcgcgctcctcgctcgacagatgacggcggcggcgacgtgtggggttcatgccgccgccgcgattctgctgctggggctgctgaacctcgcgctcgcgagaggcgttcttgcccgcggctgcaacctcggtagcatcgcccgagcccgcgcgcttgcgacggcgacggccatcggccgccccctcggcctcgggtgtctcggccttaccgcggccctttccgcggccacggccctcgccctgaccctgaccggcgcgagcatcggattcagcatcgcgacgacggcgcttgggcatcgacgtgccggccagacggtcggcactcgacaggccatcgcccacatcgacgccgttctcgcggtcgagctccatgagcgccaggcgcatctcgggcgactcgatgcgctcgagcacgtcgcgcgtcacgcagtcggggcggcagctgcagccctgctcggcggccttctttttgcagccctccgagcacgtcatatcggccaggttgaccttaaagactttaccgttctccaggcgcagcaccagctgctcacgcggcgtgtcatactcctgaatacgcgccttgccaagcggcgtatcgatgagcgtcttctttttgggcgcacggctcttaaagtccttgtacgcctcgaactcatagcgcaggcagcacatcaggcggccgcatacgccgctgatcttggacgagttgagcggtaggtcctgctcttttgccatgcgaatcgagacgggctcaaactgtccgccaaagcgcgtgcagcagagctcctgtccgcattgggcatagccgcccaccaggcgggtctcgtcgcgcacgccgatctggcgcatgtcgacgcgaatgtgcagcgtcgaggacaggtccttgacgagctgacgaaaatcgacgcgctcctcggccgcaaagtagaacacggccttctcgccgccaaacaggtactcgacgccgaccggcttcatctcgaggtcgagctccttgaccaggcgacgaaaatcgaccatggcctcgtcgccttggatggccagatcatcggcaagctgcaggtcgatgtcgctcgccacgcgcagcacgggcttgagcggctgaccgatctcgtcctgcggcacctcgaagggatcggccgtaaccaggccgatctcggttccgcgctcggtggagcagatagcgtagtctgcctcgaggatatccagatcctgcgggtcgaaccacaggtcgcgcgaggcgtaggtaaacttaacgggtacgactaacggcatttcagtgccttcctgatatcgaacagcatgacctcgatggccagctggggagtaacgtttctggcgatgttgcgctcggcggtcgcgactgcctcgagcgcccgcgtggcacccgcaacattggtcgcggcggcaagccgaccgatcgcgtcgcgcacgtcttcgttcaccacgtcggctgcctcgtcctgaagcgtcagcagcacgtcgcgcatgagcgtccgcgcgctcgccagcgcttccatgatacccgaacgctcgcgcgcgttgagttcgcgcttgttgcggtcctcaagctgcttcaatgctccacgcgacaggtagtcggcgttttgctcgagcaccttttcctgtgtggacttgacctcggcgagcggcgccttaacggcgacgatgagtgacttggcgcggctgagcacgtcggcctcgtcggcggcgataagcgaatcgatggcgcgaaccatctgacggcgggcgtcctggcgctcggcgctcttgaggaactcgatgccacgcgtggggcttcccgccacggcgacggccatgcggcaacgcgcagggtcctgaccggtggcgcggctcacggcctgcgcggcgacggcgggcgataccagccgaaacggcacgcactggcagcggctcacgatggtgggcaacatcacgtctgccgaggtgcccagcaggatgaacataacgccctcgggcggctcctcgagtgtcttgagcagcgcgttggcggtgttggcgcgcagttgctcggcacggtcgatgatgtagaccttggccttggcacggatgggcgccagaggcacgtcatcgagcagctcgcgggtctgggcgatgaggtagcccgtggcgctctcgggcgtgtaatagtgcacgtcggggtgcgtatggcgggcgacgcgcacgcagctatcgcatgagccgcagccatcctgctcgcacaggaaggcttgggcgagcgcccacgcggcgtcgagcttgcccgcgccgggcgcgcccaaaaacaggtaggcgtgcgatgcgcgaccgctggcgacggcattggtcaaaaagtcgcgcacgcgctcttgggtgtcaagcttggccagcaggcttgtctgagcgggggccatgttactcggcctcctgggcaagcgcggcggtgacggcgtcctgggaaatgtcgaggccgtagacgcgaacctgctcgaccgtccgcgcgaagacgtcctcgatggacgcggtcgcgtcgatgagctttacgcggtttggttcctcggcggcgatggcgcaaaatccctggtagacacgctcttggaaggccatgcccttagcctccatgcgatctgccgcgccacgggctgccatgcgcagcgccgcctgctcgggcgtgatgtgatagacgagcgtgagcgccgggtgcgtccccgcgacggccaggttgttggcatcgcgcactatctggcgatcgaggccatcggcaaacgcctgatagcaagttgtggaatcgtagaagcggtcgcacaggaccaccttgccggcagcaagggcaggcgcgatgacctcgtgcaccaactgggcgcgcgcggcctcgtagagcaacaactcgcaggtgtcgcccatcgccgtattggcggagtcgagcagcagagcacggatcttttcgctgatggcggtaccgcccggctcgcgcagggtcacaacctggtagccggcaaggtcgagcgcacgggcaagcaggcgcgcctgcgtagatttaccggcgccatcgacaccctcgagcgtaatgaagctatgttgagcgggctcaaaagccatgggcgcagccccttcctacaaggcgcgtaaatgcgagttatagcaaccaagccatgataccccaggggcaggcgcgtcccaaaccccacctagtcattggggacgttcttgaatgactagtcgtttaagaacgtccccaatgacccccacaacctagccatcgaggcatccccgaagttgcggtgaaatagggactgattgaagctctgagaccgccaaacagtccctatttcaccgcaacttatgatggagaattttggacgctgggtataatcgtcgtattgcattgaaatgtggcgaaaggagtggcaatgtctcggtattgcgcctcgtgcggcaagcttcttgcagataatgccaagttctgcacctcgtgcggtgcacccgttgagcaaacagccgcgagcgatagccagcccgctttcgagcagaccggttccctcgatacgccgcaagccaaggcggacgaccccctcgcctatcgccccgaccccgccgcaggccccgcggccgtcgagaccacgcagcgcatacccgtcgcgagcggctcgtcccaacaggagccggctcccgcatacgcgcccgcttcgccacagacccccgcccccaaaaagagcggcaccgggccgcttatcgccgttatcgttgtgctggtggcaatcatcatcgccctggtcgttttctttgtgatcaagcctttcgacaacgccgccacgcagacgactgccgaggtagctaagctgcaccatgacgtcgacgacgatgacctaaagcctctcggcgatcccaacagcctgtacgacgatgatgacgatgacgacgaggatggcggcgaagcaacgctctccgagcagaacctctaccgccgactgagcgaatactacgacttgctcgaagatctcgacaactacgtccgtggctgcgcgcagaacttcaacggcagctatctggaagaggatcgaaccacccgtcaaaatctcgccgacgtcgccgagcgcacggaggacaccatcgagcagtattacgacatcgtcgaggacctagacgtcccgacgagctccaagaactacagctcctggaaggacatcatcgccctgtacgacgacctggatcaccgcattgacgcaatctgtgatgcctgggagatcagcctgaaatacgccaagcctgcggaccacaagaatgagatcgtggcgccgctgtcacgcgacaacgtggcgggcaccaatgacaataagtatcgcttagactttgaggagcgctatcccggcgccaagcccgtcgaagtgaactagcgctttgtcgttcccgagccggcagttagggacgttcctaaactgccggcagagacgatatgagcaggacataaaaacattgagagcccctgctgcgcatttccgccctttactttacggcaaccctattcgtcggactaaaggagaggaaaaaaggcgcagtcgttgcatctgccgtaggcgtgatcacagccattgcctcattctttatctgacacattggtgatctaggggcgatatcgtaggaatacgaccgggagagccgggaccagattacccgggttgcccggtcggctcgcgcgacggcgcggcggttccacagaaagatctccggacttcacgccgtttctgatcgcattgtagacagccatctcgtcttcgcagtcggcgagcacgcggtgtgcgtcgtcgttttggatgtccagtaaatctcgaaggtcctccatgcaccagcgtccgagatctggccatgcgcgttgcgcgagctgataagtgtcgattgcgatgttgtagttaaagtccaggccaaagccgtcccaggcagaacggctttgtttccttgattatcaacttcatccggacacttcccgcattcatccgtgtgtgtacggatgaatgcggggttcaataccccggcggcctgatcggcagaccgccgggaattctcactcctcgaaaaaagccggcactcggttagtcctgcgcatcttgaaatcgccagactcatgggagacgtagagaatgccgtccatcccatctcgtgatgcatacgacaggtggactgaaccgcaatccgatccatcattgtcgagaagatcgaacgaattcgggtcgctcgttgcggccaaacgaccactcagacaagagccatcgtcattacagatttgccattccatgtcttcgcctgcaagaatcgccatagacggcctggtcgcgccatcgttgacatacatcccgtctatgccaaacccattttcagcgccatcgatgaacgactgctcggacctatacctcgcaaatgatgcacatagcaccattgcaagacaaagtacaaagccaacaatcgctatctttgcatagctcttgcctatcatgtcattcacctccctcgtatgtatcgaggtattcctgcttgagcgtctgcgaggacgactcggtcttttccacgagcgtgccggcctcgatgaagtagaacgagtcggtgaggtctgccaggtcgtcgagcagatggcttgagatgagcacgctgcgtccccgctccacctcgctgcgcatcgcgtcgcaggaggttttccgctttcccggatcgaggccgttcagcggttcatcgaggatgaggtacgggcaatcggaccgcgtaactgctcgacgctgcaaacgcccctaagcggcaatctgacgttcaatcgtcgggcatgaccagaaggtcaatgccctcctctttcacgtcaccttgctcgcttaggggcgttttcgctgactttgccaaagcatcggcaggtactcattggggacgtacttaaatgagtgcctgcagaatgagagtggataatctcccgtttttggcctgcttgggggctcaaagtgggagattatccactctcgtcattgggctagtcgttggggacgttcttgtttgactagtcgtttaagaacgtccccaatgactacttgcttgcgaacagccagactaggatgatcgccaggattgcggcgacgatgcagacgatggcgccggtgaatttgatgcgtgagtcgcgggttcgcttacgcacgtcgtcttcggcggcctcgagttgggcaacttcgcgctcggtctcggtatgctcggccttgtcacgtgccaaggacccggcgagcgattcggtgatctcgggatgatcgtgcacctcggtcgcctgctcgataatcgactgcgcatgcgcggcatctgcccgggcgtttgcgatggcctgctcttgctcgcggcgtgccttgtcctgcgtggcaatcttttcgcgcagctctcgctggcgcgtcgcagcggcagtttttgcggactgcagctcgtcgcgcgcggcatcggcttcggtcgtcacggcttggtgcgcgcgttttgcgtcggcgataggggcttgagcctgctcgacggcctgctcggctgcggcaagtgaatgctcaaggtcggcggtgatgcgcgggacatcttcttcggctttacgcagggcatctgccgtgtcggaaatctgcatcgagagctcgctggtgcgcaccgtatagttggcgggatttgccgagggattgcgttgcagctcggcatactcatgacgcagcgtctcgagctgggcgcgcgtggcgtcgacggtttgttgtgcggcggcaatgccggcgtctcgctctgccttcaccttgtcgcggatgcgcttggaatcctcaagacgtcgaacgaggcggttgccggtctcgcgcgagctcgcctcgcgggcctccacggcatcgagcgcggccttcagacggagctcagtcgcgtcatcctctgtcttcatttgttcgagttgacccttgagctctgtcgctttggcggcgtgggcatcacggtcaatctcggctgccgcagcggtcttttgcgctgtggcgatcgcctgacgctggtcggcgacgatctggtcgtagcggcctgcgatatcctggcgcgtctcgagttcctcggcctgatcggcaatgcgctgctcaagttcggccaggtgggcgcgggcatcggcaagtgcctttttcgcggcgttcatctcgcgcatggccgaggcgccctgggcgataaaggtgcccacggcgttcgcagtgttcgagacagcggtccccagatcgcggctcgcggcggaggagtgcggggcggtcgggcgagcggtgtcggcagcgtccgcatcggcagcctgcggcacggcgatattgccggtaccgccctcgatcacagaaaagcctgctgcgtgcgggtcgaccgcatcggcgccaatcgtgggatgctcgagctgcagaaacgagggcatggtgctgccctggtcggcaaccggagtctcgccgggtacaaaggtcgaggccgcctcggcggcctcctcttcctcggcgtcaacgtcagcgtcggccacggcgtctttcatcgctttgacggcatccatcatggagtccatgacggcgtcgagctcttcttccgaagaaacctcgatagggcccgcagcttgcggagcagtatcctgtacggggtggtcgtcctgagcgggcgcatcgtcgttttgctcgcctgcatcttcggcgccgggggtttccgccgtagcgctttcgtctaagatggggtcgtcgaggccaatatcatcgcaggtcacagcgtcagcatctgcagtgacgtctgcggaatcatcaatatgctgttgagtctgggggtccagctcgtctgtcataggcatgtgctcctcatcgttgtttgtcaccctatgataaagtctcgcgccgacatcccgcgcgctgcagcaaagtttcaaaacgtgttcgatggctcgcgtcgatagcaaaaactcggccactttatccagtttgtacttgacaatcccttcgccgaaagacgttatgccgttcgcctgccgaggccttttcttttcacttgaacccgctaaagttgcatttcagcttttggcgcgtgaagttggatgcgcgcagtcgacgggcaggcccgtcgcgatttgaaaggactttatatgggacttttcactggtaagaccgtgatcgttaccggcggcggcaaggccacgcttaaggacggctccgctggctccatcggctacggcatcgatatcgcatttgccaaggagggcgcgaaccttgtcatcactggccgcaacgtcgccaagctcgaggccgccaaggagtctctcgaggccgagtacggtgtcaaggttctgcctgttcaggccgatgtctcggctggtcaggacaacgaggccgtcgtccagaacgtcatcgacaaggctattgaggagttcggccgcatcgacgccgtcgtcaacaatgctcaggccagcgcctcgggcgtgaccattgccgatcacaccatggaccagtttaacctggccatttactccggtctgtatgccacctacctgtacatgcagaaggcctacccgcacctgaaggagaccaagggctccgtggtcaactttgcttcgggcgccggcctgtttggcaactatggccagtgcagctacgccgctgccaaggagggcatccgcggtctgacccgcgtcgctgccaacgagtggggcaaggacggcatcaacgtcaatatcgtttgcccgcttgcttggaccgccgcgctcgagaacttccaggatgcctatcccgaggcgttcaaggccaacgtccacatgccgccggcgggtcactacggcgacgtcgagaaggaaatcggccgcgttgtcgttcagctctgcggtcccgactttaagtatatgaacggcgagaccgtcaccctcgagggtggcatgggccagcgtccttaggggttccgccgttctaccgaacggcggaccggccgacgctgtgcgggccgcatttggacaatctgccgttcaatttcaagggcgcgaccagaaggtcagcgccctttcatttcacggcaccttgtctcaaatgcgacccgctcgctgacgttgccaaaatatcggcgttgccgtggctggtaaatagctccactcatcggggacgtacttaaatgagtgcccgcagaatgaaagtggataatctcccgtttttgggctgtgctttgggcaaaagtgggagattatccacgctcatccggtaagcgtccaaaaatccacgctcatttgccgtgtccctgccgtatcctcctcgcaccagtttctgtcgagtcggtgcttcttgcgggttgcccgtataatggtttgcgtatgaaccgcaaccaaggagttccagtttatggaccagaacctttttaaattcgacctgattgccgaggatccgacgacgcacgcgcgcgccggcgtactgcacaccccgcacggcgacatcgagacgccgatctttatgcccgtgggcaccaaggcaaacgtcaagggcattcctaccgagactgtcaagaagctcggcgcccagatcgtgctcgccaatacctatcatctgtccatgcgtcccggcgaggataccatcgccgagctgggcggcctgcacaagttcatgaactggcacggccccatcctcaccgactcgggcggtttccaggtcttcagccacaacgatgccgtcaagctcaccgatgagggcgtgcgctttatcgtcaacgattacgacggccgccacgtgttttggacgcccgaggacaacatggaaatcgccatgaaactcggctccgatatctgcatgcagctcgaccagtgcccgggctatcccgccacgcgcgcctacgttgagcgcgccgttgagctgtcgagcatgtgggccgagcgctgctataaggcgcacacccgcgatgaccaggcgctctttggcatcgtccagggcggcatgcatctggacctgcgcctgcgttcgctgcgccacctggaggagtgcggcgacttccccggctacggtatcggtggctactcggtgggcgaggaccacgagaccatgttcgagacgctggcgccgctggcctccgagtacatgcccaagcacaagccgcgctacctgatgggcgtcggcaacccgaccacgctcgtgcgcggcgttggcgtgggcatcgacatgtttgactgcgtgctgccgacgcgcaccggccgtatgggcacggcattctccagcgagggtcgcctcaacttccgcaacgctcgctttgcgcacgacgacggtcccatcgatcccacctgcacctgcccggtgtgcacgggcggttacagccgtgcgctcatccgtcacatggtcacgcagaaggagatgctcggcggcattctgctttcgatgcacaacatctactacctgctcaaccttatgcagcgggcccgccaggccattatcgagggccgctacggcgcgttcgtgagcgactggatgaacagccctgcggcggtggattactaagagcagcacgggcgcttgcagagcgcgggcaacggcaaggggcgagcgccggccggtcatcacgtttgctaacaccgcttgcgcgaccgctgaccgatagcttgcaagtgcttgatgcatcgtgggtaccataccgaatagttgatgttcgggcgggtgtttgacgcatggcgtcgaccccgcccgcttttctttttctcgataggagtacccatgattaagaatgagaacgtcgagggcgagcctgcctacgacgagacgtaccgccgcggccccgtggtcatgcgcggccccatgattcccaaggacaacacctacgccaacctgctggcgcccgaggactcgaccgactggttgcacaccgacccctggcgcgtgctgcgcattcaggcagagttcgttgatggttttggcgcacttgccgagcttggtcctgcagtgaccatcttcggcagtgcccgcacgcccaagaccgatccgctctacaaggcggcacgcgccgttggccgcaagatcgcccagcgcggcgtggcggttatcaccggcggtggtcccggcgtcatggaggcggccaacaggggagcggcgagcgccaacggcaagtcggtcggcttgggtatcgagcttccgcacgagcacgggctcaacaaatatgtgaaccttggcatggacttccgttacttctttgtgcgcaagaccatgttcgtcaaatacagctcgggcgctatcgtgtttcccggtggctttggtacgctcgacgagatgttcgaggtgctcacgctggtgcagacgcacaaggtcaagcgcatgccgctcgtgctggtgggcagcgaatactggcagggcctgttcgactggctcaacggtccggtgatggatgccggcatgatcagcccgctcgatcctgatctggtgcacatcaccgacgacctcaacgaagcggtcgacgtcgccctgagcgggctgatgtagagcaatcgtgccgctgcgacatgaatatgcatggcaatctgatgctatctaacatcagattgccatttttattgggtatactgatgcaaaagacgagggcgaggaggtcgcgtatgtctactgcaacgattaagcccacgacggtccgcatcgaggaggggcttaaggagcaggcgactgagtttttagattcggttggcctgaaccttaattcgtatctcaaccttgctgttcggcagcttgtgaaccagcggaagattccgtttgagattgtggggcggccggaggtacccaacgaggcgacgaggcgcgctatggtgatcgccgaggctcgtgagctggggattctgccagacgacagcccgtcattcgataacgttgatgagttgatgtcgttcctcgatgaggattagacgatgtttgaaattaaggtcgaggctcagtttaaggccgactataagcgagcgatgcagagccacccgcagctaaaaaccgagtttaaggcggcagttgccgagcttgcggcacacggcgtgcttccggcagagtacggtgcccacgagctctccaacccgggcggcaattacaacggtcacatcgattttcatctttccgatggcctggtcgacgtggtcgttctctacctgccgcataaaaccaatccggtgattcgactggtaagaatgggttcgcatcaagagttatttcagggcccactgagctagccactcacttctaagttgcggtgaaatagggattgatttgcggctgatgagccaaaaacagtccctattccaccgcaagtgatggagatgttccgtctgttgacgcggcatctggcttccccttgtggctgacttcgtctaagagctccgctgcgatctcgctgtttttgaacctgatgctgcagtcttcgttctttgggaaagctagcagcgggatcgttccgtaccagacagtttcttcgtcaattatcactgcacacaaacgcccttctgctctaatggcatactcgacgttcatttcggccaaagtctcttttgcatcttcacgtggagtcgaggcaacgtaaatctcaaaggcaatccctcgggcaatggcacctctgattgtatcgccgagctttgcgaggcaggcggcggatgcgtagggcgcggcaataaagatgctcttggcggcgccggcaatgtcgtcaaccaatgtctctacggcattcgtcggctctataagaatgttttgatcggactgctcgctgcctccggtcacgtagacttcgtacccaagcttggcgtacgtcttgagcctcttctggtacatgcgggcgagcatgggtatcgacaggtcaacgtagtcgaatatctcaacccgccgcttgccctcgtgacttctatgcagtctgcccgcctgctgcgtgatgctgccgtcccacgatatcggcgtggcaatgaggagagtgtcaaggtaggacagatcgaagccctcgcccagaaggctttcggtggcgacgatgattcgatgttcatgctcgaagcagggaagactgttcagtatcgctcttctttccttgacgtcgatttctccggtcaggagaatgggttcgtgtcctcgatctttaaacagtctgaacagctcctcagcatgctttttccttttagacagcacgagcggatgccgactgtttgacgcggcttcaagagcgtcgttgacaatcaattcgtttctagctgcatgcgcgcacagaaggtcgagaatctgattgaagcttgcacctgactcgtaggcgggtagtcgaattccggtaaaacgaggccgtacgatgcgctggatgccctgctggatcgcttgcgtttttggatcgatgacatagcgaagcgggccgcaaagcatggagagcgccctcgtaaggccgtcggagcgctcgggcgttgcggaaaggccgtatacgtatttggccggggcagacttgagaacaagctcgagctgtggcgcggcggcgtggtgacattcgtcgcagataatgaggccgtaattacgaacaaggtccttaactatcggctccccggtttgagggtctttgccagacagcgactggaacgaagcgacgtcgacgaggccgcttacggcatttttgcctcctcctatttgtccgatgaccggaggctgcctcttgctgattcgtccttttggggttcggacgggttctctgttgtccgtaatgtcgataaatcgctcgagctgggatttccattgggttatgagtgcagtcttgggaacgatgacgagcgttggaagaccaatggcggcaataagataagccccgatgacggttttaccgaagcccgtcggcgctgacatgattccatcttcgtacgagagcatctggtcagcggcgatttgctgttcagggcgaagggcgcctttaaatgtcatcacaatttgattatcggattggcgttcgtctaaatagtgggcagtaacgccggtttcttggagcagctgctcaagcttggttttgcagcctctgggaatcgcgacacagccgcctctaagctcactgaggtctatgagccgcggtttaccgaatactgattgatgcatagattgcgcgcggaagaattccgggttggcgaatgttgcgagcccgcggatttccatttgagccgctggactcagagacttctcggggatgtacagcatatcggcttgtgtgacgggcagcgatgagggaaagtctcgcgatgtgagcggtagccgctttcgtggtttttgggcatatcgtttggttttgtttgccaccgcaactgttgctagcccgtgtgggttgtttccagtggcctcgatcaaattatgcaccgtcgagcgcggaatcagctggatttgggacaggtagagccattggtcgggaaagggctcgaattgctcgtctacaaatacgctgtttccttcacgttgtgccttgccttgaaagggaagtgcgatgaggtttccaaaccctccatcggggatagtgacctgagcggggagcattcgatcaaaggcctcgaacgtgattgttttattaagcgccgcggcttcggttatgaggtaacttccaaactctctggcggcctttgcactgattggctcgagaaagaaaaaccagatgtgtgcgccgttgccggaccttgagcgctcaacggcggcgttaatgccccgtcgttttgcaacaagccgtacggcatttgttgcctctttccagtccgctttgtcaaaatcgatgacgagaactttcgtgttgcagttcctgtcgagcacatattgcccgaggacgtcacggaatcggtcgtccttgcctttaaagtgagcgatgattgtggcatcgcttaattcggagaagacgcgatttgtgtactccgcgcatctgattctttgttgggctgctttggggcaaattcccggtttccactcatttgcgcaagcgggcgtatagccgatgcccccgtcttttctgcgatatccatgagcgtaaacatctttgcggcaagtaaagagactgcgaaagagctcgagtttgtcacgtgctgggctcgcgctggtgacgatgccctcgatttgcgctcgttcatcgaacaaagcgccagcttcttcccactcttcaagagtgacgtagcgtacgtctgaaccgttgttgcaaatgacgatttgtcggtgttggtccgatatatgcgtgatcgtctgatcgtatttaaattgtgcggtcccaaagagggcgtattgatgcatggtgttgcccatttgaatgccgtccttgtactggagttgttgagacgagggtacggcattgcggctttttgggatatctaatttcgattcaagttcgctaatggcgagggattattccgcgagcggctttcggtcgatgtcaaagcgcgcgacggcccttgataaccaggatttgcggtcatgtgggtagccggaggcatacagagcgggcttcattcggacccggtgggtaaaaaatggcaaatatgagtactgttgcttggttagtaccatatcatgtggaaagtatttaagaccaattgacaacgattgcatatattaaaccccctaaacacgacgattcggggctttttggagcttgaaatcggtggaagcgggcaatttcagctagattttgctgttactaaaattgtgacagtactcatatttgccattttttgcccactgggtatcgtcggggccaatcaaagctccccaaacagctgggaacgcgccgatcgccagcaatatcttgtatgtgggcagcgcgcggcaaaaaaagttgcggtggaatagggattgatttgcggctgataagccaaaaagagtccctatttcaccgcaagtgatgggggtgctcctagcgggtgggctggtagcgggggcagtagctgatggcgatggcgtcgacgcctacgtgggtcgcgatggtgcagccgatggggccggtgccggcatcgacgtagtccttgcccgcgagcgcctggttgacgagttcctgctcctcggtggcgccggtcgtgagcacacgcacgctggagcccggatgctcggccaaaaacgcgaggcagtcggccatggtgttggcgacgatgcgcttggcgccgcggcccttcttgatggccttgatctcgcccgactgccattccggcgaaacggccaggcgaatgttgagcatctgcgtgagctggccggcgagcttgggggcgcggccgttcttgacgaggttctcgagcgtgcggggaatcagcagcagatgagcgtcgggcagggtcgcgcggatttgcgcctcggtctcgtctaggctgcggccgtcctcgcgcatggcgagtgcgtactccactagcaggccctcggcgcccgagccggtgcgcgaatcgatgcagcgcacgtcgagctcgtgggtatcggccacctggcacgcgttggcgtagcaggccgaccactcactgcatagtgagataaagatggcgctgtcgtggccgtcggcgcgcacgcgatcgaagagctccttgaactcgccggcgctcggctgcgaggtgtgcggcagctgctcggagccggccatgcgggcgacgtactcctcggcggtgatctgcacctggtcgagcaggtcctcgccttcgataatcacatgcagcggaatcacatagatgccgagctcttgggcgcgggcgggggggatgtccgacgtggagtcggttatgatggcaaaagacataattgcacctttcgatggggcgcctgcgcgccgccgattgagagcaaagtgcgtcaagtatagtggagttgttccacattgccagctttaattgttgaatagtcaacggtttgaagcgtcggtgtggaaatcgccaattggggaagagggatgtcgatggcggcattacagctatgcgagcggccggtcgtgctgttcgattttgacggcacggtggccgacacgggacgggcggtgatgacctcgacgcgcaagacgctggctgcgcgcgggttttcggaagtgcagatgggtgacttgcgccgcatgatcggacccccgctgtggaagagctttcacgacttttacggctttacgcgcgaggagtcgctcgtggtggccgacgagtaccgcgccttttttgacgagttggggccggaggagtatcccgtgttcgacgggatcccccaactgctcgacggtcttgtcgcgcagggacatcgcatggcggtggcgacgtcgcgcatggaagcgaagtgcatcgacatggtgcatgagctggggctttgccagttcgatgccgtggttggcatgaatccgccgcaggggcgcgagaccaaggcggattcggtccgcgacgcgctggctgccctgggcgcgactgcggacgaggccgtgatgatcggcgatcgctttaacgatgtggagggcgcgcacgcgatgggcgtgccgtgcatcggcatctattcgggcgcggcggcgccgggggagcacgaggccgcgggcgccgacgcggtggtgcactcggtggccgagcttgctaaacttttctctatataagtatctgatgtgaggggcgggcgcgctcgctgctcattggttgggaggttgtccatgaatcaggtggagcagagcgtcgccgagtatgtcgacgaggtctgggaggatgtcgtcgccgatattgagcaactggtgagttatccgtccgtggcggtttctgccgatgcggagcccggtgcgccgtttggccgcccggtccgtgacgcactcgattgcgcgctcggcatcgcgcaaaagctcggctaccagacgagcgacgacgagggttatgtgggcatcgccgatatcccgggccgcggcgacaaacagctcgcgaccatctgccacgtggacgtggtgcccgccggtccgggttggaacaccgacccgtttgcgatggagcgtcgcgagggctggctgctcggtcgcggtgtgattgacgacaagggcccggccgtgctgtcgctctacgccggcgcctacctgctcaagcacggcattaccccgcgctacaccttccgcgcgctgctgggctgcgacgaggaagtgggcatgtccgacgttcaccattatctggagaactaccccaaccccgactttttgtttacgcccgatgccgagttcccggtctgcaatgccgagaagggccagtttggggcgacgtttgtgagccccaagatcgacggcgggcgcattgtgtcctggagcggtgccgaggcgagcaatgccattccgtcgcagtccatttgtgagcttgcgattgccgccgaggagctgccggcgccggtcgagaacgccgaccgtctggagatcacggcgctcgagaatggcaatgcacagattttcgcccacggtatcggcggccacgcctcgatgcccgagggtacgatcaatgccgtcggcctgatcgtggcgtacctgcgcgaggtcgaggacgcatttggtgcgcgtgacgagcgcctgctgacgcctgccgagcacgagtttgtcaagttcctggccttcgtgcacgcggatgcctatggccgcggcctagggattgatgcgacgagcgcggcgtttggcccgctcacctgcaatcccggcgtcatccgcgtggcggatggccatattgagcaggttattgacgtgcgcttccccgatagcaccagcgccgacaccatctgcgagcagctggagccgctcgtcgggcgttttggcgtgacgtgtcgcttgggccgtgctaaggtgccgttctcggtgtccgccgacgatccggccgtgaaggcgctcatcgacacctataacgagtttacgggcaagcacgccgagcccttcgccatgggcggcggcacgtacgcgcgcaactttgcccgcgccgtgtcgtttggtcccgaggagaccggcctggagctgcccgcgtggggcggccagatgcacggccccaacgagtgcgccaacgaggaccagctcaaacaagcgctcaagatctatattgtggcgatcctccgtctaaacgaacttgaactgtagggcttccccaggcacccgaccttgcccctcaaaccgtcgcttgcgtaccaaagtacgcggcgctcctctttcggggcaatctcgggcacatgggaaaccccaacattttgcttggatataaacttgcatgatcccttggggacggaggagagcggatcacttgagcctcgctgtggcaaagtgatccgttctcctccgtccccaagggattatttggtgtaaaaggcgtgccatggttggggtggggattgttattcgtttgtaaaggctgagccgtgcttgcggtaagggtctatcagatgcccgtaagaaaccgcagctggcgcggctgccgcccgatcgaggtcgtatctttccaaacagcaaagcgggcagggtgcccgcgagtcgcatgtatgaaaggaagatcatgctcgatcaggcttattctcgtcgtcagttcctcggcctcgctggtggtcttgccagcatcgtcggtctcggtctcgttggctgcggtggctccaacgcttccgatgccaccgacaagggtagcgccgccgctgccgagtccgtctccggcgaggtgacctacgacggcgcctcttcgttccaggctctcgtcgaggctgctgccgagaagttcatggacgccaaccccgacgtttccatctccggttcgggcaacggttcgggcaagggcctgaccgctgtcgccgccggtaccgtcaccatcggtaactccgacgtcttcgccgagactaagctcgaggccgaccaggtcaagaacctcgtcgaccacgaggtcgccgtcgtgggcatgggccccgtcgtctccaagaacgtcaaggtcgacgatctgtccctcgaacagctcaagggcatcttctccggccagatcaccaactggaaggaggtcggcggcgacgacgccaccatcgtcgtcctcaaccgcaaggccggctccggcacccgcgccaccttcgaggccgccgtctttggcgacgaggccgtcgactttaagggcgacgccgagctcgacaagtccggcgacgtccagactcagatcgccagcactgacaatgccatctcctacctcgacttctcgcacttcgatgactccaagttcaacgccgtcaaggtcgagggtgtggagcccaagagcaagaacgtcaccgatgactccttcaagatttgggcgaccgagcacatgtactgctccaaggatgccgacgaggccaccaaggccttcctggactttatgctttccgacgacgtccagggcaagctcgtcgaggagcagggctttatccccgtctcggccatgaaggtcgtcaaggacgccagcggcaaggtttcctccaagtaattattcgcccccggaaaggtttgcaatggcaaaacagctgccaaagcgcgaccttgagaacgtgggcctgggcgtcacgggcgcgtgcgtagcgctcgtgacgcttgtcgttgccgcgctcatctttatggtcgcccaaaagggcctctcggctttcgtaaaggacggcgtctcggtcgtcgagtttttcaccggtaccaagtgggacctggccaacacagccgaaaacggtctgccttacaccggcgccctgcctctgatcgtcacctcgtttgcggtcatggtgctctccgcgctcatcgcgctgcccatcgccatcggctctgccatctttgcggtcgagattagccctaagtttggttccaaggtctttcagccgctcattgagcttttgaccggtattccctcggtcgtctttggcctgatcggttttcacgtggtcgtcggccttatgaagagcgttttccacgtgagtacgggcctgggcatcctgcctggcgccatcgtgctggccgtcatgatcctgccgacgatgaccaccctttcggtcgatggcctgcgcgccgtgcccgacagctaccgtcagggttcgcttgctctgggctatacccgctggcagaccatctggcacgtggtactcaagtctgccatgccgtcgctcatgaccgcggtcatcctcggtatgacccgcgcctttggcgaaacgctcgctgtgcgcatggttatcggcggcatcgaggccatgccgacgtcgctgctgtcgccggcgtccaccatcaccaccacgctcaccacgtctatggcagtctatgccgagggctcggcccaggacgatgttctgtgggcgctcggtctgctgctgatgggcatgagcctcatcttcatcctgatcatccaccttatcggccgcaagggggcgaaggctcgtggctagcacgcgcatccatatcgacgagacgagactcgggcgggtccaaaggcaggaccgcatcgccacgggcgtgctgacggcaatcgtcgccatcgtcatgctcatcgtcatctccatggtggcctatatcctgttcgagggcgtctcgatgctgttccagccggggtttctcacgcagcccgcgcgcgccaacggaacccaaggcggcgtgctctaccagctattcgactcgttctacctgctgctgatcactctggtcatctcggtgcccatcagtctgggcggagcggtctttctggttgagtacgcgccgaacggccctatccgcgacatcgcctccaccgccatcgagacactgtcctcgctgccgtccatcgtcgtcggcatgttcggctttctggtgttctcggtgcagctgggctggaagtactccatcatctccggcgccgtcgcgctcaccatgttcaacatccccattctggtgcgcgtgattcagcaggcgctcgaggacgtgccgcaggcccagcgcgatgcgtgcctggccatgggccttacccgctgggaggccacgctgcacatcctgatccccgaggccatgcctgccatcgtgaccggcatcgtgctttcggccggccgcgtgtttggcgaggccgcggcgctgctctttacctcgggcatgagctcgccggtgcgcctgaacttcttgagctttaacctgtcgagtcccacctgcgcctggaacgtgttccgccccggtgagtcgctcgccgtgcacatctacaagatttacggcgaggggagccccgaggcacagcagatcgtttggggcaccgcggcgctgctgatgatttgcgtgctgctgtttaacgtagtcgcccgtatcgtgggcaagcaactggcaaggaggatgacggccgaatgagcgagataaatgcaacgcccgcaaccgaggtagtcacgtccgagacccaggactttttgtcgagcgtgggggagagcgagaagcgcgttcgcgtgagcggcaaggccgtgagcgacgaggtcgcgctctccaccaaggacgtcaatgtgtactatggcgaccaccatgcgctgcacaacacgtcgctcgacttccacaagggtgagatcacagcgctcatcgggccttcgggctgcggtaagtcgaccttcttgcgcagcctcaacctgatgaatcgcgagattcgcggctgccgcgtggagggcgagatcaactaccgcgggcgcaacgtgaacaccaggaccgagaacacctacgagctgcgtcgctccattggcatggtgttccagcagcccaaccccttccgcaagtctattcgcgacaacatcacgtttgcgcccaagcgccacggcatcaccgaccgtgacgagctcgatcgcatggtcgaggagagcctacgcggcgcggcgctgtgggacgaggtcaaggacaagctcgacaagagcgcctacgcgctttcgggcggtcagcagcaacgtctgtgcattgcgcgcacgctggcgctcaaccccgacgtgatcctgtttgacgagccctgctcggcgctcgaccccatctcgacgctggcgattgaggacctgatgtcatcgatcgttgccgaccgcgccatcgtcatcgtgacgcacaacatggaacaggcgtcgcgcgtgtccaaccgcacggcgttcttctacatgggcgatatggtcgagtacgacgagaccgacgagattttccaacggcccaaggataagcggctgaatgattacctcaccggcatgttctcctagtccgggacatgcttgaggcccgcggcggccacggtcgccacgggactgattggagaggcgggtcatctcttttgcgagatggcccgcctttttactctgcgaccgaatcgaccaccacaaaggggacaggcaccttcgtggtggtttggggtggggctcgctgctatcatggacaacgttgaatttctacgaaggagcagggcatatggcgattcttttgggatgcgattccatcagcctagagtttcccaccaagcatattttcgatagcgtgacgctcggcgtgggcgagggcgaccgcattggtattgtcggtaaaaacggcgacggcaagtcgacgctgctgagcgtgctcgccggcacgctggagcccgacgatggccgcgtgacgcaccgccgcggcacgacgatcggtctgctcggccaaaaggaccagcttgtcgacaccgataccgtgcatcatgccgtcgtgggcgacatgcccgagtacgagtgggcgtcgagcccgcgtacgcgtcagatcctggccggccttattagcgatgtgtcctgggagggcacggtgggcgagctctcgggcggtcagcgccgtcgcgtggacctcgcgcgcctgctgatcggcgactacgacgtgctcatgctcgacgagcccaccaaccacctggacatgcgcaccatcaactggctcgcgcgtcacttaaaggcccgctggcagcgcggtcagggcgccatgctcgtggtcacgcatgaccgctggttcttggacgaggtctgcaccagtatgtgggaggtccacgacggccaggtcgatcccttcgagggcggttactccgcatatatcctgcagcgcgtggagcgcgaccgcatggccgccgttaccgaggagcgccgtcgcaacatggcgcgcaaggagctcgcgtggctgagccgcggcgcccaggctcgttccaccaaacccaagtttcgtgtggatgccgctcgcgaactcatcgccgacgtgccgcccgtacgtgacgagctggagctcaagcgcctagccgtgagccgcctgggcaagcaggtcatcgatgtggtcgacgtggacgccggctatgcggataccgatggcgcgcccaagcaggtgctcaccgatgtgacctggctcattggtgcgggcgaccgctatggtcttttgggcgagaacggcgccggcaagtctacactgcttgacgtgattcagggcaagattgaacccacgcgcggccgcgtgaagattggccagacggtacgctttggcgtgctgtcgcagcagctcgaggagctcgagccctacatgggcgacacgatccgcgaggtgctcagcaactataagaagtactacgtcatcgacggcaaggagacttcgcccgagaagctctgcgagcgtctgggctttacgacgcagcagctctggagtcgcatcggcgatctttcgggcggccagcgccgtcgcctgtcgctgctactgacaatcctggacgagcccaatgtgctcatcctggacgagcccggcaacgacctggataccgacatgctcgcgattgtcgaggatctgctggacggttggcccggcacgctgatcctggtgacgcacgaccgcttcttgatggagcgcgtgaccgaccagcagtgggcgctgctcgacggccacctgacgcatatgcccggcggcgtggaccagtacctgcgcctgtgcaacgccaccgccgagggcgagcccgtgggtgcgccgagcgccaagaccggcacgttcgacaccggcgccgcagcggttgcggccgaaaagcccaagacgagcgggcagcccaacggtctttccaacgccgagcgccagaagctccgccgcgaggtgagctcgctcgagcgcaagatggagacgcagcgcgctcgcgtggaggaggccgaggctgcgatggctcaggtcgatcccaccaactacacggcgctcggcgagcaacaggcaaagatcgacgaggcccacgccgccatggacgagctggagatggcatggctcgaggcgagcgaaaagctcgagggcgaggagtagacgaggatgatcaaagccgcgtttttcgatatcgacggcacgctgctgagctttaagacgcaccggattccggcgtcggcgcagcgggtgctcgatagctttcacgagcaggggatcgcatgcgtgattgctacgggtcgcccgacctaccagatgcccgattggctgttcgacttgggttgggatgcgtacattacgctttcgggccagcactgctttgatgccgagggggtttaccgcagctgcccgatcgatccggacgacgtcgcggtgattgtggaccaggtggccgaggggcgctacgactcgctgtgcatgcagggcgagaactcgtttgtgaaccgcctgtccgagcgcgtggtgacggccggcaacaacgcggggatcgtctaccacgaggagccgtttgagcacgcctttgaagcgccggtctaccagttttgcgcctttgtggatcctgccgacgagcatatcgtgaccgatgcggtgtcgcattcgctcactacgcgctggtgcgacctgttctgcgacattattcccgctaacggcggcaaggacctgggcgtggcagcgacgctggagcgcctgggtgtcgacgcgagcgaggcgatcgcctttggcgacggcgagaacgacctgtcgatgttctcggccgtgggcacaagtgtggccatgggcaacgcgcaggataccgtgaaggccgcagcgacctacgtgacgaccgtcgtagacgacgacggcatctacaacgccgccgagcactttggcctgctatagctacggattcggcacttggggacgttccttttgcgccggcagtcgggggcactccttgcggggcgtgtccccgctttgttttcgtcccgtgcgttttgtgaaacacggttaactttttagacaacgtagtaagacataggcaacttttgcggtaaagtaaatcaagcaaaagtatccaaaggctaactagaagccatcgcgaaaggcggcccatggccctgcgtgaatccggagaagactatctcgaatcgatctacgttctgtcggaacgtcagggcaccgtgcgctcgatcgacgttgcggagtacctcggcgtaaccaaggcgagcgtttccaaggccatggcgacgctggaaagcaacggctatgtcgaaatgggcaaacgcgacgtgcatctgacggaacgcggtcttgaggttgcccgtcaaatgtgggagcgccactgcttttttgtaggtctgctagaggacgcaggcgtaacgcccgaggttgcctcgcaagagggctgtcacatggagcactgcctgagcgaggagagcttcgagaagctgaggtcgatgctcgccagggaagagacgtcgaactcaacaacggaatcctaacaggtccccagtagcgcggagttcgcgcaaagcgcgaaccagcgaaaaggggagagggggctcggacaataacgagcccgacgcagtccaaagtgcagcaatcggtgcgtgacgtcaccacagctgggctatctctgcgtccccaaagaggcgcgcctcccgcgccggaacggcgcgggacagcgaccgggatcagtggccccaccaactaagtccaactcagacaaggaaccccgccagcaagcgatgcccaagaaccaccagcaacgtcaccgcaggccgggaccgggcttgggtttgaaaacaatccgcagcgcgaggcgaggtagccctcctggtcgaagtgcacgatctcgatcttctcggtctccttcattcccgctcctttcacgagcagtttgaattgtcgcacgggtacgaacgggcttgccgccccattcgtctcgcttaatcttgcggtcatcttggccgcaaactcaacaattcaaaggttcttaataccagtgaacgataacaggttagccgtttttaataccgatttttcgatttcatcctcccctctcggtagacggtcagttttggccgctcatcggtcaagcggcacatatcctcaaaaaacgagcgcccccgccgtgcgcgaggacgctctcaacgctaatagttgtaggaataaccgccggcgtcgccgcgggtaaaggacttggcgtgctcgatgacctgtccgctcgcatcgtaggtcaggcattccagcacaagtgccaaatcgcccgcctcaagatcgagcaggctcgcgtcgcgcgcacccagcgcctcgatatcgagcttctcgatcgacttgtccggctttcggccgagcatgtcgtatgtctcgtacagactaaagaccgaaatatcgacatcctcgatacccgggaacagcaggcacggaatcagcgtcatctcgatcgacacgggctcgccgtcgatgcagttaaggcggcgcaccgagtaaagaaggtcgtcctcggcgataccaaacaggtcggcatagtacggcccggcatagcgcttggagcgcgccaagatgcgcaccgacggcgtcgcgcccgaggccaggaccgtctgacgaaagccgcccttgcgaacatgttcgtcaaaccacttgtgccccacaaaggcacctttgccctgcacgcgacggatctgaccgctcttgaccagctcgtccatggcgcttcgaatcgtcaggcgcgtggtgccaaactcctcggcaagctcgttttcggacggtatcatcgaacccgtcggatagtcaccgcgttcgattcgctccgcaatacaacggcgaatttgcttgtagaccggcaggccctctactgcttcagccattcgacacccaccttcgtcgcaacgccgtccgcctcgccgttatcggcaaaccgatacttggtcggcagaatcacggccttgcagtactcgacaaaaccattgttctcgtcgcgctcgtgcgaagccttgtagaacaccggcgtgccctcctgggcatccagcagcttggcctcttcggcgttcaggcggctgatagaaatatgctccttgccgtgcgtcacatgaacgttgccttctttgagcaaaacgtcgtagaggctctcctgctcaaaatcgtgatcgggaagcgacgggcacaaagacaggttgacgtaagcagtctcgatcgacgccggagaaccattaaccacgcgcacgcgtcgaatacaaaagagtggcatgcccagatcgacctgcgccttttgagcaaaatcgatatcggcatacacgacctttgaccagaccaaacgcgcagtcgactttaagccgaccctctcgacggcctgggtatagttccatgtttcctgaaagatgttcagcggcttgggagggcacacataggtacccgagccacgacggctttctagggttccacacgaaataaggcgcgtaatggcagcgcgcagcgccgtgcgcgacacgcccagctcctcgcagagcacgcgctcggcgggcagtcggtcgccaccttgtaagtcatagtgtttgatataccaaagaatgccctcaaaggcgcgatctttgggcggaatcgcatatggttcgctcgacatgggtaaggctcctcaaccgcttgatgctgcgggcatcatttctccgaacaccccatggcgtcgaaggcttccttaatctgttccgcaacgttccgatacgaccgatacaggccggagtctcgcttgacttcgcccgcggtcaccggaatctcaagcttcgaaatctcatcctcgccggtttgcacggcaacgatgacacccataccaaggcacatattacgcttggcggcgttatatttggtagcctgagctggattaatcagaatctgctgagcgagctcacgattgctgagctctggcacatcctcgggatttccagtctcaacgatctcgcactgcagcacatccgcatagtcaaagatctttggctcggcaccacgctgatgcacagcccacttgtggcgcgtggcatcttggtagatagccggcaaaagcgtaaaccgcggcgggtccaaaatagtatccgtgatggtaaacacatcgggattaaaggcatcctgcgggtttttcttcttgaacagccccatatcagcctcccgtactagtattaaacaactcaagccgaatatagcaccaatttgaagttgcaacggcaacccttcggtacacggcggcaatcacgcgctcagcggaaaagtgtacgggcgagggccggggtgcctgcttggttttggaagtgggctccgcgaacttccaaaaccaagcaccccgccccggccccgacaatgtaaaactggctgaccaaagtgagatacacagcctccaaggccataacagccatggccccatcgctttaaaaatatatcagcccccgcagatcgaaacggtcgagagggccgcctccgggcgggttgccttgctccgggaagttcgcgaagcccacttcccggagcaaggcaacccgcccggaggcggccccagcgcgagaccgtcccggatgctattcgttgtcgcccgcggtcatctgggttgcggagagcgcgccgtcggctgcggttgcggcagcggcgtcgggccagacccagtcggtgaaggccgggtgatcgtagccctcgtcgcaagcgaactcgaaggcctcggtgcggaaggcctcccactcgttgatctgctcggcaaacttgtcggcatcgaccatgcgcagcacgtcggcagccagggcccagcggtccatgttgttcaggcgcagcatgtcgaacggtgtggtcgtggagcccttctcctcgtagccgtggacgcggaaggcgtcgtggccggggcggttccagatcaggcggcgaatcgtgccggcataggcgtggaaggcaaagagaacgggcttctcgccgcagccgaagaattcagcccagcgctcgtcgctgatggcctggtcgttctcgcagacgttctggatcttgagcaggtcgaccacgttgacgaaccaaaccttgatgcccagctcgcgcagcatgtcggttgccgccagagcctcgagcgtcggcacgtcaccgcaggtggcaacgacgatgtcggcctcggcgagcgaggcggcggtcgatgcccactcccaggtcgcaacgccctcggcaagctcggccttggcctcgtcgaccgtctggaaggtcggggcgggctgcttgccgcagaagatggcgttgacgcagtcggtggactggtagacgcgctcggccacggcaagggccatgttggcatctgccggatagtaggcgttcacgatatgcgtttcgttggccttgttgagcagtaggtcgataaagccggggtcctggtgagagaagccgttgtggtcctggcgccagacgtggctcgacagcagaatgttgaggccgctgatgggggcacgccacggaatctcacgcttggtggcctcgagccacttgcagtgctggttgaccatggaatcaaccacgtggacaaagctctcgtaggagctccacacgccggagcggccggtgagcacgtaggcctcgaggaaaccctcgcactgatgctcggacagctgctcgacgaccttaccggaaccagccagcagctcatcgttggcctcgtcctcgtagaagccggcgtcccactgcttcttggtcaccttgtaggcagcctgaaggcggttggatgcagtctcgtcggggccgaagatgcggaagtcgtccatgttcttggtcaggacatcggcggtgtactcaccaaagacgcgggcggcctcggtggagccccagccgtgacccttctcggcaacgggaatctcgtgggcgtggatgtcgggcagctcaagctcgcgacggaccttaccgccgtttgcgttggggttggcaccaatgcgcagctcgccggtcggcataaaagccgtcacctcggggcgcacctggccctcgggcgtaaagagctcctcgggcttgtaggaacgcagccactcgcgcagcacgcggaagtgctcatgggtgtccttggcgctcgccagcggcacctggtgcgcacgccaggagtcctcggtcttcttgccgtcgatctgcttggggcaggtccagcccttgggcgtgcggaacacgatcatggggtaggcaggacggacaacggtctcgcccgcggcagcctgggcctgagcggtcgccttgatgtcgcagatctcgtcgaagacctgctcaaacaggtcggcgaaacgctcgtggatgctcgcgtggctctcgtcgtcaaagccggcgacaaagaagtgcggcttgtagcccatgccctcaaagaacttggtcagctcctcatcggacacgcgggcaaggatagtggggttggcgatcttatagccgttgaggtgcagaatcggcaggacgataccgtcggttgccgggttcacgagcttgttggactgccaagaggtggcaagcggaccggtctcggactcgccgtcgcccaccacggccacggccagcaggctcgggttgtccataacggcgccgtaagcgtggctgagcgtgtagccgagctcgccgccctcgtggatggagccgggcgtctcgggcgcaaagtggctcggaatgccgccgggataggagaactggcggaagaacttctgcaggccggcctcgtcattggtgatgtcggggcgaatctcgcggtaggtgccgtcgagcagcgactgggcggtaccggcgggaccaccgtgaccagggcccatcaggaagatagcgttctggttgtgatcggcgatgaggcggttgacgtgaccgaacaggaagttgacgccgggcgtggtgccccagtggccgaccaggcggtgcttaacatccggacgaccgaagtcgcgcgtctcaccggtcttctcgtcgacaaagtcggcacgcatcagcgggttggagcgaaggtagatctggccgacggacagatagttcgaggcacgccagtacagatcgacgccttcgagctcggaagcgggcacctcgtgtcccagcttttgccacggcgttcccagtgttttagccattgtttatgtcccttcgctgcgcggtcgccctccgatacggcaacctttcgttgggactagtatatttgctaaaacgttttatcactgtgaaaaaacgttttatcatcgctatctatcctgcagctcggcaaaactggacactcacctgcggcattgtctgtcacaggtgctccacattcaatctatacgaattggtaaacgtgtttagttgtgtttagtaaaattgagcacgctgccctttacgatgagcgcaggctccaaaaccacttcttcggcacgcctgccgcccttaccggcaagccgcttggacatacagccaaaagcatgctcggcaagcacgcccggatcctgctcaatcgcggtcagcgccggctcaaagagcacatcggctgctgagttgtcatagctcaccaccgagatatcgcccgggatgttcttccccatctcgtgcaagcgtttgagcaagcccagcgcgatgttatccgaacttgcaaacacggcggtggcatcggtcgcgagcaccgcctccgatgcttcgtatgcactcggaatgtaatactcgctctcaaactccaggcgcgcgtcgatgggaaggcctacctcgcgcagcgcgcgctcgtagccggcaaggcgcttacggcccgtattggaacgacgcgcgttaacgagacaggcaatgcgacgatgtccctgctcaaccagatagcgcgtagccatatagccgcccatctcgtgatcgaacatcaccttgtcgcactcgagcccttcaatggcgcggtcgaccattacggccgggatgggcagatggctgacctcttcgcgcagggcacggtcatcggaaaactcgtcgcccacgaccaggaacacaccgtcgacgccgcgcgtcaccagctggcgcaacagctccagatcgtcctcggcacttccgcccgagctggtaataaagagcgcatagccgtcctcgcgacagcgcttttccaggctcccggcgagcgaggcaaaaaagcggctctcgatgttagggacgataaggcccagggtgcgtgactcgcgcatgaccaggctgcgcgcaatctgattggggacatagtggttgcgcgccgcgacctccttgatgagtttgcggttttcttccgagatgcgacagggccgattgttgagaacaagcgagaccgacgagggggaaagccccacctcctgggcgatctgcttgagggtgactttgttggccatctcgctccttccgggtttgcgcgcaatctcttgaaagtatagcgaccgcccatctacctcgatgataaacgctttaccaatccggtagacggctgttttatcgccgcgattggtgcaaagtaacctgccccctttgcaccatgtggtgcattggggccaggttactttgcaccaaatccatccaggtagggtatattgcattcgattgatgaaaacgaccaccataaggcggatattcgtatgcacgagaacgacttttttaacgaggacctgctctgcgcgctcgccggtgttgccggcgaggacaacgtgctgatgagcgagcccatgcgcgatcacaccacgtttaagatcggcggccccgccgacgtctttgttacgcccgataccgagcagggcctcgtcgccacgctcgacacttgctatcgctgcgacctgccgctcaccatcgtgggcaacggttccgacctgctcgttggcgacaagggcatccgtggcgtcgtcgtggcactgggcgaaggcctctccgacattaccgtcgacggcacgcacgtcacggcagcagccggcgccctgctctcggatgtggccgccgcggctgccgaggccggtctcactggcatggagcccatctcgggcattcccggttcggtcggcggcgcctgttacatgaacgccggcgcctacggcgcctgcatggccgatgttctggagtccgtgcgcgtctataagcccgcccgcgtactcgacgacggtacccgcggcagcggcaatatcatcgagttcgatgtcgatgagctcaacctgggttatcgcaagagccgcatcgccgacgacggctttatcgtgctctccgccaccttcaacctcgccccgggcaatgcggcgatgatcaaggccgacatggacgactaccgccagcgccgcgaggacaagcagccgctcgacatgccaagcgccggctccaccttcaagcgccccgagggctactttgccggcaagctcatcatggacgctggcctgcgcggccacgccatcggcggcgcgcaggtgagcgagaagcactgcggcttcatcgtcaacgccgaccgcgccaccgccgccgacgtcgacgaactcatccgccacatccaaacaaccgttaaggaccagttcggcgtagacctagaacccgaagtccaccgagtaggcgaatttatttaaaaaaagaaggccccgaaaggggccttcgccatatttattcagctaacccagtccggagcgaagcgcaccggacccgagaggtccgcggctgtccgaaaggtataaggttgatcgcgagttccgcacgagccggagagcacttaatgtgctctccgtgcgagcaggagcaggggactcttaatcccaaggtccagggttcgaccccctgacggcccaccaaagaacgcacaggtcagcgcttcggcgctgaccttttttgtttaccgaagagccgaatcataaccgtccgttaccgttcgcgttttacgccccctgccgtttatgcgcggcagggggcgttttatgcatttaacagataatagacctagagaacgccgttttagagcgtctcggcgctgcgaccggtgctattaaaccgccgtccgtgccgccgccctcgacgatctgcagggcgcgcccgacctgcctggcggccttctcgcgttccgcgaggcccggtttgatgtaatgacggtaatctgtccccaggtccgtatgtccgtgcaaatccatgatgctcagggggtcgacctcggtagccgccatgatggtctcggacgtgtggcgcagggccttgggcgggatataccgcaggtcatggcgtgtgcacatgcgccgccatgcgcgcacgagattgtcgccgcgcatgttcacgatccgctggccgctccactcgcgaacctgctccgtaaccgaagtgccgccctcgacggttatggacgggcgcagctcgtccatgatctggtgcaggcgctcgcggcccgccaataaaaccggcacggtgcgcacggaatgggtgttcttagtctccttcacgccgtcctcgtccgtgtacgcgcggcagacctcgatgtactctgacacggtcggctggcccgttgcgaagtcgtaggtcgtggtgaccttgaggtcgcacgggcgcaccgccagtgcctcctccttgcgcaggccgctcaggccgaggatgaggtgggcgttcatgaccaggtccgcgcggtcgtcgctggcggcgagcctgcgcagcgcctcggcagcctcggggatgctccacggctccacgggcgcctgcttcgcctttggcgcgatgacgcggcggcggaagggctccaccgtcacccagccgtcgtcgaaggtccggcgcatggcggcgcgcagggtcgtcttggtcttggccggcacgcccgagcgctcgatgcagctgcgcatcatgtcgtgcgtgatctcggagatgtcgatactccccaggacgggggagacgtagttctccatctgcccgtcgtgctcgcgcaggctcgccttcgagcgcggcttgccgcggttgctgggggagtcgcggaaaactccccaataatacacatcaagcgtgacacccgcgtgcgtggcctgggacacgccgagctcgcggacgagctgggcgatgtcgatatcggccccggtctcggtgccgtggacggtgcgcgacgcgcgccgcacgtgcccgtctgcgcggaagcccgcctgcacgcggatgacccacttgcctggcgcgacctctcgcttggagccgagtttcgaccttgaagtatcgttggctgccatataatggtcctgcctttcccttttgccggagggcatacgccccgtgcggatccgccaagattgccgcacggggctttttgtttgcattgaggccgactatgcgattgcgtggcgcttgggcctgcccgagcggggcgtgtcggtcaggcgcgccgctatgctctccacggtcacgtaggtgcggcggcccttgcggtagcccgtgaggatccccgagtcgagcatgtgggtgatcctgccgggggagacggagagcctgcgcgcggcctcggccgccgagaccgtctcgccctccacgatgtatccctcgtccgtggagaaggcgaccatcatagagaggccgccctctgcgggctcgttgaactcgggctccggcacggcgaggccgtccctcacgagcgcggccacgtaggtgctcgccgcgtccacggcctgctcggcggcctcggcaatcgtgtcgccgcaggtgaagcatcccggtagcgagggaaactccacgtcgtagccgccgtcctcgtcgggcgtgagcaccgcctggtaaacgtatgtcttcatatctttcgacccccaagggggcggggctagagccaccccgccgtcttagctatcttccggtacgtccctatcggtatctccttcttggaggtgggaacgctgatctggaccccgtcctttcgcgcgaccacgtggctgcccttgccggtgtagagcgtccaaccttccttcttgaaccgcttgagcacctgcgcgggctcttgctccttgggcatctctcctccttccgacaatttaattataaacagttgatagttatgaatcaagtaaactagcaagtatttatagttttatacggcccacacggcccggttaagattgctgtgtgggactttagttaaatcagcggctggttttttggcgctgtcttcttgtcatggacctttacgatctcgtagcgttcgttcatgtacgtgttgaggtccttgttgtagcgcttcgtgatcttcatgtcggcgataagcacgtcgccgattccgaagctgtagtcggagaaatggtcgaagaagtcggtatcggatatgttcgcggagatggggacgccgttccagccgaagcgccacatgctcttcgtcgatttccttagcacgactttgagcagggataggggctgttcgatcgagatgaccgtcttggtgtcggctccctcgtagagcggggcggcggccatgtactggaagtcgtcgcgattagccttgaagtgcgcgccttcgggtttcgggtcgatgatctcgagtgactcgatctcggggcggctctcgagctccttgaaagagttgacgatagatttcgtagcgccggggttccccgtgtagatgttgtacgtgttctggttgaccgtcatcttctcggcgttcgatgccacgacggtcacacggttcttcccggactcgatcgttgcggcctcttccttgccgttcttgccgaggaaggagagcagcttatacagctccgttgccgtcgcgaccacctgcgggaggatgggtgcggcagcggaggcgaagtcgatcattccctttatggagtcggtgacgagcttgaggtcgacctccaggcatccgggcctcgtctcgccgatgcggatgtcgagcgcctgggacgcatcgatatccccacacgccgcctgcatggcgctcgcatagccgaggacggtcctcgtgaacgtattgatgtcgacgctgtcgatatttccgccgaatttgacgataacgtttgtctcgtccatctttattctccacatccgaatcacctcggtggatgattctatcctctcgttgggatgctcataaacgaaggaaggcggccgccccctgggacagccgccttccttccggacgcgggccccgtggggtccccgcgtcaataccgctgtccaaattaccgtttgccgtcggcgcggtcaagccgtctcccattttcgcgaccccacgaaaatggggaataactggcgctttgtcggccatcgtactgcccgttacgccttgccgttcaggcgcttcaccatccgctcgaagtcgttctcgtaggtcttgtcctggagcttctggaactcgtggaagcgctccttggcgatcttgtccgccgtcttcttgttgcggttgccaaggcccttgagcacctcgcgcccgctgaatgtcaggaagccgtcgagcaggcgctcgcagtcctccatgctcgtcaggatgtgccgctcggccctgtcctcgagcgtgtcgagcagtatcgtgacgaggcggttcagctgcctgatctcgtcctcggacaggtagttcttggctacggtgacgtccgaggagtggatgcgcccctcggggccacccttccatgacgtgagtcccatgttgggcttggacgggtcggagcgcccctggacgatctcggccgcggtgtgcccggtgacggcgtagtgcatcttgttctggaccgcggcgtagaagttcttggccatggtcgagtccctgtcgtagtcgaagctgcactcctggaagatgtcggtgatcttgagccatacgcgccgctcgctcgcgcggatgtcgcggatgcgggcgagcagctcgtcgaagtagtccttgccgaagggccggccgttcttgagcatgtcgtcgttgaggacgaagcccttggtgatgtactcccttagggtagccgtcgcccattggcggaagcgggtcgcgcgcatcgagttgacacggtacccgacggcgataacggcatcgagattgtagtaggttttcggtctgccgccctttggggaggtttttccggaaaaaccggaaaaactagttgagctggccttttgtagttccccgctggcgaagatattgacgagatgctcggaaatcgtcgagacggagacgtcgaacagctcggccatcgccgcctgtgagacccaaagggtctcgtccttgtagtagacctgtaccggcacgtttgccccctcggactggtacaggattatctcggcctgaatggggtcttccatatctcttcctctctggtcggcgggctacgcgttattcgccttcatcatgtggtagctacatgcctaaagaggatacgcgaccgcgaggacataaaagggtctatatcacggatatgatggcgtttcttttctagcacaatttcaatggtgctaaagtccgccgttgggctcaataaatatcgagaagctgtgttctgctctagatgggtgctcagcctagtctgcgcgatagtgcgatccgagactttcggttcgtttgcgcatggctttgaccatttcctgtgctagttgaatctgcgattgcaggcgggcgagggctgcgacttcgctgtcgttggcatgcggtttatttagagctgtggcatcatcttgcaggctttcaagctcttgcagcgccttggaaaggccaacttcggtcctgttgatcatgcaataggtacttatcgtgtgcttaaggctgcgtgtcaggcgctcggcgtctgttgtggcaatgccgtactgggggagggcgatatccgccttcagggatgcctcaggctctttctgcgctgcaagggctgccgatgcgcctgcgatgcgtccgaacacgatgccgttggcgctcgacaggccaccaatgcggtcggcgccgtgcatgcctcctgtcgcctcgccgcaggcatagaggccttcgacgcccgtgaaggctgtcttatcgatcttgataccgccgttggcagcatgggcatacatcgctacgcgcatctcatcggtcggcgcgattccgtgctcgtcctgtagccaggtggcaaaggtctgcacaaactcggggatgtcctcgcgggggaagtcgtagtggagcgccaggccctctgcacctgcctgatctatgacgaggtcgatggcgcgggaggccaagcgcgaggtgaaaggaccatatccagagcgctgctcgagcaggtcgtccagcttgtcgtcggcaatatctgccggctggtctacatgtacgtagcgccaggttttctcgttgaagaccaggttgcgcttgggctcgatgaagccgggcatcatctgcatgaactctatattagtaagggacgcaccgtgcgccagcgcgatggcctgtgatgagctgagcacatcagccgatgtaaggctgcgctcgaacaggccgccagtgccaccggctgcgatgatcgtggccttggcagcaaagggcacgattcgatctttggtgaggtcgtagagcacggttccggtgattctgccgtccgtatcttcaacaaggtcgataagctcatggcggggtagcaggcgaataccgagcgactcgatccggttcgccagagcgtcctcaaggggcttgcgggtgaggccgcgccacatgcgcgtcttgtggtcaaagcaggggataaactgcttttgctgagcgctttcggcgctttgcggacgctgaagttcaacacctagatcctgctcgagccattggatggcctgaggaataccgtggacgaacgtctggacgagctcggggtcggcgacaccgccgccgacggtctggatggtgtcgatgaggtcttgttcgtcgtcttcgttaacgggtccgataagccctaagccccaggttccggggaagaagctcgatccactcatagtcttgccggcgcttgtcacagtgacggttgcacccgtgcgtgccgcttcgatggcggcgcaaaggcccgcaatgccagatccaattaccagtacatcagtcgattccatcggattcctttctcgttcggcgcattgtcgcacgggtgatcggcaatggggccgcaaagactcggcaaatcggtaaagggcaaatatggcaggtgggcgtcatggacgttctgacgctttgtctcatcacatctcgtacttcgccccaactgatatattggcattagctaccctgcgacagcgcaaacaaaaagagccgctacctcgaaaggtagcggctccaaagctcaactatttgagcatcgcgcgggcgcgattaggccttgagggcctcctcgacggcgacagcgcaggcgacggtggcaccgaccatggggttgttgcccatgccgatgagacccatcatgtcaacgtgcgcaggcacggaggaagaaccggcgaactgggcgtcggagtgcatacggcccatggtgtcggtcatgccgtaagaggcagggccggcgcccatgttgtccgggtgcagggtacggccagtgccgccaccagaagcgacggagaagtacttcttgccagcctcgatgcgctccttcttgtaggtgccagcgacggggtgctggaagcgcgtggggttggtggagttaccggtgatcgagatgtcgacgttctcgtgccacatgatggcaacgccctcgcggacgtcgtcggagccgtagcagttaacggcagcgcggggaccatcggagtaagggatggtctcgacgaccttgagctcgcccgtgtagtagtcgaactgggtcttcacgtaggtgaagccgttgatgcgggcgatgatctgggcggcgtccttgcccagaccgttcaggataacgcgcagcggcttcttgcgagccttgttggcgttcagagccaggccgatagcaccctcagcggcagcgaaggactcgtggccggccaggaaggcgaagcactcggtgtcgtcggagagcagcatagcgcccaggttgccgtggcccagaccgaccttgcggtcctcggcgacggagccgggaacggtgaaggcctggatgccctcgccgatgatggcggcagcctcagaagcggtcttggcgccacgcttgacagcgagagcgcaaccgagggtgtaggcccactcggcgttctggaaggcgatggactgggtgttgttgacgatctcacgcgggttgaagcccttgtcggtgcagatctgcagagcttcctcgagggaggcgatgccgttgtcggcgaggcacttgttgatcttgtcagcgcggcgctcgtaaccttcgaacgtaacagtcatagttatttccctccctttctactcgtgaaccgggaacacgctggcgacggagtgagtctcctcgtcggtgcgcgggtcgatgtacttggcagcgttgtcccactgaccatagtggcccatagcgccagcgatggcctcctcgggggtcttgccggccttgacggcgtcggtgaacttgccgaggttcaggaactcgaatgcgatgatctcgttcttgtcgttgagagccatgcgggtgacgtagccctgggcgagctcgaggtaacgagcacccttggccttggtgccgaacatggtgccgacctgagagcgaaggcccttgccgaggtcgtcgagggaggcgcccacgggcaggccgccctcggagaacgcggtctggctgcggccgtaaacgatctgcaggaagatctcgcgcatagcaacgttgatggcgtcgcagacgaggtcggtgttgagggcctcgaggatggtcttaccgggaaggatctcggaagccatggcggcagagtgggtcatgcccgagcagccgatggtctcaacgagggcctcctcgatgatgccgtccttgacgttcaacgtgagcttgcaggcgccctgctgaggtgcgcaccaacccacaccgtgcgtaagaccggagatgtcggaaatctccttagcctggacccacttgccctcctcggggatgggtgcggggccgtggtatgcacccttggcaacggggcacatgttctccacttcctgtgagtactgcatgcctctcctctctatcgtgttggcgtcccgtctgggggtcgtggctggcgattgccgggcgacccttcgaaagggacatgacatgcagcccctataataccgcgaaatgcacggaatattcggcgaacggctcagttttcgtagcgagaagcgcggaactttttattgaagcgatttaacttagcattttgtggtcgcgtagttgtctgaagggggtcagtcttgggcaagcttttggtcagcttttggaaacgttatgacgtttgacctgtcgctccgttgccgctcgccgtctatttgatgcctttggccgcgccggggtgtcattttgcgtggatgttttgatggggcgcttcaatcgtgctgtattggatggtaagcagatcccggcgaagggagcgccatgcagcgcgtttggagaacggttaccggcttttaccacgtctgtgcccgcggtacgggcaagcagctcatctttgagtgtgacgatgaccggtgggagtttttggaactgatgcgcgactgctgccgcgaggccggggtgacggtcgttgcgtggtgtcttatgggcaaccacgtacacctggtgcttgcggattacgaggacagaatgagcgcggcgatgcaccggctgcttttgacctatgctcgtcggttcaataaacgcacggggcgcacgggccatctgttccagaaccgctttgatcgtcgctcgcttgataccgaccggtatctgatggcggcgattcgctatgtgcatgccaatccgcaggaggcggggattgcccttatcgagcgctatccgtggagcagctttgccgagtatctgcgagcgtatgacaacgatgttgcaaagagcttctctgatccttcttgcgtgcttgagctctttggctctgccaaggggtttgtcgactactcgctgtcgatacccgatggttccgatccggtgattcacgatatggatgagacggaatgggagcggcatgcgtttgccgacaaggtgacgaagcgcctaggcgtgccgctcaatgggctcaagaccgtgccgccttcgcggcgcgatggaatcattttcgccctgcacgatggcggctatacggtgcgcgagatcgagcggtatacgggaattagcaagagcaccgtttctcgaatcgtgcgcgcctatgcgcaggtgagagcacaggccgagggctcgaaatagaaaatggccgaaccgcccttgtcaagcgattcggccaacaaaattcttaagatttgggacaaatactactgattattttgtcccgtgagcatgccgtcgagggtgcgccaggcgagctcggcgcatttgacgcgggcgggcatgtgcgagatgtcctggagctgggcggcttcgtccaggtcttccaggtcctcctcggagagcttctcgccgcggatcatggcgaggaagagctctgccaggcggtgagcttcctcgacggtctcgccggtgatgaggtcggccatgatgtcggcactggcctggctgatggcgcagccgtggccggtaaaggaggcctcctcgatcacgttgttctcgacgcgcagctgcaaggtgagctcgtcgccgcagctggggttgatgccgtcgtgctcgtgcgtgggggcgtccatctcgtacttatagtcggggtgcgagttgtgctccataaatgtggtggaggtgtacagattacccattgaacgtgctccaaacgtgatgcaggccggcgatgaacttgtcgatgtcggccttgtcgttgtagaaggctacgctggcgcggcagcaggcaaggttctcgacgcccagccaggtgagcagcggctgcgcgcagtggtggccggcgcggatgcagacgccgtccatgtccatgatgctcgcgacgtcatgcgggtggatgcccttgacgttaaagctcacgacgccgtggtggttgtcccaatagatggagccgatgatctggacaaagtcgagctgcatgagctcgcccatcagatagtggacgagtgcctgctcgcgtgcctggatgttctcgtaacccaccgtgttgaccaggtaatcgagtgcggcgcccgtggcgaagatgccggcggcgtcctgcgtgccggcctcgaacttctcggggacgggagcccagacggcgtcctgctcggtgaccgaatcgatcatctcgccgccggtaagcatgggcggcatggcgttgagcaggtccatcttgccccacagcacgccgatgcccatggggcccatggccttgtgcgcactaaaggcaaagaagtcggcgcccaggtcggccacatcgaccggcatgtgcggcagcgactgcgcgccgtcaacgaccagatagccgccgtacttgtgcacgagcttgccgagattcttgaccgggttctcaacgcccagaacgtttgagacctgtcccacggccaggatcttggtcttgggacccaccttggcaagaacctcctcggtggtgagctggccggtcttggtggggtagaggtagacgagcttggcgccggtctcgcggcagacctgctgccacggaatcaggttggagtggtgctccatgatggtgatgacgacctcgtcgcccggttcgagcactgtgggcgcaaagctcttggcgaccaggttgagcgactcgctcgtgttgcgggtgaagacgatctcgttggcccgtgaggcgccgatgagatcggcgatctgttggcggaccttcgcgatggcatcggtggcttcgacggacagcgagtacaggccgcgcagagggttggcgttcatgcgctggtagaagtcgcgctcggcgtcgagcacacaggcagggcgctgcgcggtggcggcgctatcgaggaaggcaatctcggggtgctgctggaacagcgggaactggcctttgtaggggttggtctcgatatctacggtgggccagccgcgcgaagcctcgtcgctggcgtcgagctccatgggctcgggggcagtgcaggtgtcgcatttaacgtgctcggtgtcgatcatgcgagctcctcttcaaagttgtcgatcaggttgttgcctaggcggacgacggcggcgcgggtgcgctcgtcggtggcggaaagcgcggcgtcctccagcttggcgcggatgaacaggtcctcggcggcgttttggtcaaggccacggcaggcgaggtagaacagctgctcgtcgcggacgtgaccgatggtggcgccgtggttgccggcgacgtcgtcctcgtcgcagagaatgacgggaacggtcttgttgtcgacgcccttgttggccaaaagcaccgtctcgcgctcggtgccggttgcgcccttgcagccgtgcacgaggtcgatggtgccgcggtagaccttcttggacgtgccggtcagcacgccgttggcgtcgatctcgcactcggtcttgcgaccgcggtggcgcagctcatagttaaagtcgcgcacctgctcgcgggcgcccaggtagtcagtatcgatggtgaccttggcggtatcgcccagcaggtcgccggcaaggccggtggcgctggcgccggcacccaggacggtgtgctgcacgttgacgcgcgcgccctcgtccaggaacagaccggtgtcgtcgagcgcgatccagctatcgtcgagcgtctgcgtgcaggtcacgttgacgatggcgtactcgtgggcgcagacgcgcagcacggagcccacgacaccctcgccagcaacgggggagtccagggcgatctgcaggtcgagcgttgcctgcgggcgggcgacgacgtcgatggcggcgatggccgcggcggcatcgataccgctcacgcgcacggtaaccgtggcgtgcttgtatgcgggcacatcgatgacgatgcgcttggtagcgtgctcggccaagtaggcgtaggcagcctcgcccatgccggtttcgaaggctccagcgggggagagctcctcctcgagcttgatggcgccggcctggtagacagaggtggcgggcacgtcgagctcggtctcgggcgtgatgcgggcgcggtcggcggcgtctccaggggcggaggcgcggcgctcggggaagcgctcggccatggcgtccatagcggcgtcgaaagcgtcggcggaaccggcaacggcctcgtccagcccctcgacctcaacggcatcggcgggcgcggcggcaagctcagcagaaagctcaagcttggtctggttcatcttgagccaaccccaagtggcagcaggcatcgcattaacctgctcgagcgtggtagcagcggtgttcgtggtctgtttcattatccgatcgctccttccatctcgagcttgatcaggttgttcatctcgacggcatactccaacggcagctccttggagaccgggttggcaaagccgttgacgatcatggtgcgggcctcttcctccgagatgccgcggctcatcaggtagaacaccttgtcgtcgccgatgcggccgatggtggcctcgtggccgatgtcgacgttcttggcgcggatgtccatggccgggatggtgtcggatcggctctggtcgtcgagcatgagcgactggcagctcacggttgccttggagccctcggccttgggcgtggccacgatggagctgcggaacgtctggatgccgccgctcttggagatacccttggtctcgaccgttgccgaggtctcaggcgcgttgagcacgaccttgcagccggtgtcgaggttctgaccggcgccggcaaaggtgatgccggtaaagctcgagcgggcgcggcggccattgagcacgctcatggggtagaggtagcccacgtggctgccgaaggagccgctgatccactcgatgtcgccgtcctcgtccacgcgcgcacgcttggtgttgaggttgtacatgttcttggaccagttctcgatggtcgagtagcgcaggtgcgcacgcttgcccacaaagagctcgacggcgccggcgtggaggtttgccacgttgtacttgggcgcggagcaaccctcgataaagtgcaggtcggcatcgtcctcgacgatgatgagcgtgtgctcaaactggccggcgcccttggcgttgaggcggaagtagctctgcagcgggaagtccaacttggtgcccttgggaacgtagacaaacgagccgcccgaccacacggcgccgtgcagggccgcaaacttgtggtcggtgggcgggatgagcgtcatgaacttctcgtggatgagcggttcccactgcgggtcgtgcagggcttcctcaataccggagtacacgatgcccatcttggacgcggtgtcctgcatgttgtggtagacgagctcggagtcgtactgagcaccgacgcctgccaggtagctgcgctcggcctcggggatgcccaggcgctcaaaggtgttcttgatgtcgtcgggcaccgactcccagtcgtgcttttggtcggtgttgggcttgacgtaggtgacgatgttatccatgtccaggccctcgatggaggggccccacgtcggatccgggaagcggttgaagatttcgagggactttaagcgcaggtcgagcatccactgcggctcgtcctttttggcgctgatctcgcgcacgatgtcgggcgtgatgccggcgtcgaggcgctcgaatccctcctcgccataggtgaagtcgtagaggctgcggtcgatgtccgcgacctcggtgcggttcttggtcattgcgtcgcccctttacgcctgctgctcggcagcggcagactcggcctgggcgcgctgctcggcggcctcgcgctcgaaggtctcaaagccgttcttgtcgatccaggggatgagcgaggcgtcgtcctcgcgcacgatgtggcccttgaccataacgtggacgcggtcgacatccaggtgctccaggatgcgcgtgttgtgtgtgatgatgagcatggagccgtcgcagctcttgcggtaggcgtccatgccgtggctgacggtggacagggcgtcgacgtccaggccggagtcggtttcgtccaagatggcgagcttgggctgcagcagcaggagctggagcatctcgaccttcttcttctcgccgcccgagaagcccacgcccagctcgcggttgaggtaggcggtgtccatgttgagctcggccgcgagctccttgacgcgacggcggaactccttgcccttcatctccaggccggggcggccggcgatgctggcgcgcaaaaagctcgacagcggcacgcccggaatctcgaccggggcctggaagctcaggaacaggccggcgcgcgaacgcttgtcggtggtgagctcggtgatgtcctggccgtcaaagacgatgcggccgtcgttgacggtatagacggggtcgcccatgaccaggtggccgagggtggacttgccggcgccattgggtcccatcagcacgtgggtctcgccggcggcgacgttgaggttgacgttgtggaggatggtcttctcgtccacggaggcggtcagaccttcgatggaaagcagcggatttgcgctcatgctgtccctctctgtatatggtgtactcataggtgtactaaaccctaggaatcttctcggaataaagttactatgggttcggcgttagtcaagggaaaacccgactaatccactcgacttttcaaattctgggacaaaataacctgttgtgtttgtcccacttacttaagatttgggacaaacaaacctggttatgttgtcccagatgcgatgggagggtaggtatgctcatttcttccaagggccgctatgccctccggctgatgatctatatcgcggcgctcggtgacgccgagggcaagattgctctgcgcgaggttgccgaccgcgagcatatctcgcaaaagtatctggagcagctggttcgtccgcttatgaaggcgggcctgcttaagagcgtgcgcggcaagggcggcggctacatgatggccaaggacccggccgaggtgcgtgctggcgacatcctgcgcgctgtcgagggcagcacggcgcccgtggcgtgcgacggcatcgacaacagctgcacccgcagcgatctttgctcgaccgtcaagttctggcgcggtctggacgacgtgatcgaaaagtacgtcgacggcgtgacgttggccgacctggccgccgtccccgagatcaattttgacatcaagctgtaagggctggctttcgtgaagtcgtacgaagcctttggttcgcgtctggcgctgctggagacagctcgattccaagatttcgacaacgactatgttgtctccggatgcgcgtatatctatgagcaggttttcggtatctcacttacgctccttaagcgtctgctcgagtatgagggcgccacgcttgccgcgtcggggtctcctcgtgccatcttgaaggagtcgtaccgattctacgactttattgatgaggcggcctggctagacatgctcagagaccgcaatacgaacgtccatatctacgacaacaagctcgctcaagatttgattcaacgcatcttgaacgtctatatccccgctttctgtcagttgagggacgggctgatggagcgatacggcgagcttctgatggcgcccgacgaccagtttgtctaattccttaagatttcgcggaaggttgttgccgtttaccgacgggttgttgtgcaacaacgggcgagctgcaatactttttttatctttgcaaactgaactttaactacaccaatgcagggaggatcttatgcagcccaagcattctgctattgtcgcgggcctgacgctggcgctttcgtttggcgccgttaccgcacccgcgcccgccgctgccgaggagcccacgccgggcgttgcctcggatgccaccgatatcgataagggtctctacacccagcagtccttctcgggcgtgctgaggtcggtccagggcgtttcgtttgtcaacgtgactcccgagatgaagtactttaccaagtacgagagccatggcaactataatcagggcttttcgtatggcgacggctataacgcgctgggttattaccagttcgaccgtcgatggtcgctcattccgtttatgaaacaggcctacaactacaaccccgaaaaatacagcatgctcaaggatgcgattgatcgcggcagcgagatttccaacgcgaacaaccccatgtacgagaacggtcagctcaccgagttgggccatatcgctcaggatgccttccaaggtgcgtacaacaccgatcctgttgagttctcagcacttcaagatgcctatgcgtacaactcgtactatgcggtgaccgaggcgtggctcaagagcggcctgggtattgatatttcgggccgcgccgattgcgtcaagggcatggtgtggagcattaccaacatgtgcggcactggtggctgcagggactttttccgctgggcgaatctttccaacgatatgtccgaccgcgagtttgtgacggcgctctccaatagtgtggtcaacaatgtcgccactaagttttcgagtcagccccagtatcatgagggctggaagaatcgttataagaatgagctgaaggactgcttggcttatatcgccgaggacgaggcagccgctgcgacgcccgtgcagcccgagcctacgccggcgccctcgccgacacctgattcgaatgacgactcgagtgacgatcccaacgatgacaggatggatgcgccctcgaccgatgctgacggtaatggctctgctggtggcactaccaacgacggctctacctcgaacggctccgattcgaacagctctgctgcgggcgattcgccttcaagctctgccggcaatacggacagcgacgcttctggttcgaccggcgctgacacctctaactcatctaccggctcgagcgattcgtccgttgacaccggctctaacaacggctccggctctgacacgacccctgattccgatgcttccaaggacgactcgaataaggcgccggacgctcccgctgcttcgccggacaagaagccttctttctccgagcagcttggttctacgctgggttcttcgctgatggctggcgtcaataacggctcggcccagaacaaggacaactctgatcaggtttccacggaaaagaccgaggccgcaagggacgactccaaggacaaggctttcgagaagaacgaatctgataagggttctagctctgaggagaaggacgacaaatccgctcagaagaaggacgagagcaagaccgagggcgaaaagaaacagcccgaagacgacgacaagagcggtgctgacaaccaggtccaagagcaaaatgactccaagacggtgaccactacaaccacgacgactacaacgaccaagtcatctggcggtaacatgcccaagacgggcgaccttatcgttatggcgagccttgccagtgcaagcttggccacactgggcgctacgtctatcgtaagtggtaagcataagctcgatcagcagaagaaagcttccggggaggacggctcggaggagtagcctcttggttgctagataactaaagagttgggacggggtccggtgcgaacgcatcgggccccgttttgttgtgcaacgattagttatgccccctcacacctcttgttgctaccgttgcccgatatggtcgcgcggcgtcgtcggtacgcgcgaggcggtcattacaattggcatcgtgcagcgatttagggggatcgttttggtgtctgaacaggcaaatgttgattgtgctgctggctttggcgtgcgcttgatcggctgtgccgacgatgcggttttgcccattggcatgcacgactatgcggaggcccttggttgctgcatgctggttgacaagaccatgtttattgccgatgtgttggactgcgacgcgtccgttgtggtgtgctgtcgacccgagggttttggcaagagcatgaacttgtcgatgctcagggcttttctggagcgtccagcggtcggtcgctctggtcagcgtttgtttgccgatgctcagatttgggatgcgaacggcgggcgctatcgggatgagtatgcttgctatccggtgatatcgctggacttttctggcgctgcgaggcgtggccccgctgttgccggcgtcgtgcgcgatgccctttcgggcgagtgcgctcgcttgttggcgctcttggaggctccggatttagctcgagataaggtgcgtcacatcgaacgtgtcgcgcgtggcgtggcgagcgcggacgaggttgactcggtgctcggtgtgctcatagagctgctggagattgcctgcgatgagcaggttgtattgctcgttgatgggtacgatgcggcgtggtctcgccgtgcgagcgcgagggacgcttccgacgccgatccggcagaactacttgaccgtgtgctgtttgacgccattgccactgcgcgcgattcgttgcggctgacgtgtctgatgggggagtgtcccggccctgctgaagcggcgctttcttcgcgcggctgctcgtattgtctgacgacgccgctgtcggcgtggtgtgaccgatgtttcggtttttcggatgccgaggtcgaggctctgctgaatcatgctgggcgcgaggaatacctggatgatgcgcgtgaatggctcgagggatatcggtttggtagggcctattgctcgagtccagcgcgtgtgatcggttttctggaccgaggctgcacggcgcctgtgcgcgccgatctgtatggatatgccgattgcctgagtagggtagttgccgggtggaatctcgaccgcctttcggtcttgtttgatttgctcgaggcccatgggtgcgctgaggtcccgctttgtttgggcactgcagagccagatgtctcgcctgacgatggcatgtggacagcgctgtatctgtccggttttctcacgacggatatgactgaggagccagagcatggcgatcgcctccgtgctttgcgattgcccaataacgagcttcgccaggccttgcgtctagtgattattgagtggtttgagtgcgctgcagaagacattcgagacgtcgatgcgtttcgcgacgggctgtgccatgggaacgaagataccgtgaggcgggcgctaagccgcatcttgggagatgcgggaatcggtgcgaccgacccagatacaccgctgccatatcacctactcttgcaaggactctgctttggattgccgggctatgccaatcctgcttcgaggcgaaagcgtggcgcgggtcgctgggacatccaggtttttcctacgggcgccgtgttcgacatagccgatacgatcggtatgctcgatgaacgtccgctgataacgatcagcatgatgtatgaccccggtgtggatgcgctgggcctggaattgctggccgtgcagtcgctgctcgacatagagcgcgacggtatcgacgaaatccgtgtgccgcgacccggcgttggccgcatgcgctgggggtttgggtttgatgggcagcatgtggctacggtgtgccagcggctttaagcgccgaggtgtttccggcttccgttactcggtgtccttcatgggcggcatgggcttccagttgggatccttgatgatcttgcgggcgtccttcatgccgcggcgcagcgccggaatgccggtcttaaagcacttatcgaccgcagccaggcgaatgaattccttgcagaaggtcgcggcattgcccagacggaacagcacagggtggtagtcgccgtagatctgcatatagcgtgccagataaccgcggttgcgcatgatgtagtagcggttggtgtcgctcgtggagttgagttggcgcttaccggcgatgtcccagttggagacagcgcgggcgcgcttgagcaccacgtcggcaacaacggcggcggggaagtgctggctggctacgtagccgtagcaggcatcgtcgccgtagataaagaagcgcgcgtcgggcaggccaatcttgtcgaccacgcggcgcgagaacatgccgccctcaaagcacagttggttcatggtgcggtagccctcggggcctagatcccacttagcgatggggttagggatgccgagtgaaaggatgagctggtactgccaaaagaaggcgccgccgtcaaagtctaggcgcgaaccctggatgacatcgtagcggtcggtccacttggcaagacgctcgatgccttcggggatgacgagcacgtcgtcgtccatcacccagaaccactgggcgcccaggtcgtaggcgcatttggtgccagcggagaagccacctgcaccgccgccgttttcgagctgtggtgcgtagatgacgcggtcggtgccgcccttcgcgtcgggctgttcgatgtcggtgccccacaggttggccaggcgctcgttgaatgcggtgcacatggcctcggtctcgcgcgaattctcgttatcgacaatcacgatgcgccagggcgttgccgtgagctcggtcatggagtcgaacaagttggccaggagttcctggcgcttgtacgtaacgacgacaatggcgagcttatcgatgggagcgggaagggttgaaggcatggggcaatatatcctttcacgcgcggcgggcgagtgcagcgcggaagctatcgaatacgtccttgggactgtcctattgtaaaggctcggcgcaccttggcggcaagctttgaataaaacgcaggaacctgccacggctgtagcggctttagcgtctgacggcagcgtgtctattgcctcttgagcttgcgttcgataagacttctagctgcatcgatgatgagaagtgccagagcaaagacgatgctaatgacgatacccgtgacgatacatatagctgccgggctgttttggctgatcagtatgtttgcgagcaacgtattgaagacgggacgccacaggctactggtgagcgactgcatcacatagaaaccaagcgtggcggtcgataaggtgacgatgacacctgcggtccgtggattgcctgaggccctgcgccgggtcgccgcaaagagcagagaggcggcagcgagggcaaacgagatcaacgaggttgatttgttggagaggactgccatcgccgtgaggttgccggtgaaggagagtgctccttccaggatggtggcgagcgccaaaaccgttacgagcgagcgcatgcccaaggcgcccgccctgtccgaatccatggcgtcggttacgtcgcagagcagtccgccgatcaaaaacgcgataacgtacgtgacggcgctcatgagtttctggagccaagaaaactcaccgccgcttgtcgcactcatggcggccaaatacccgttaacaataaatgcgaggatgccaacggcgatgaccgtcgtcgtgtagctcttctgggagagtcgactcttagccagtccaaaccatggcgtcatgaagaccgtggcggcatagacccagataaactcaaggcccagcgtgtaccagtagtgcgtgttgagggtaacatcgggaatgggggagacgaccgtggaccacgcgagtgccacgaggcaataaaacgcagtgggcataacgaccttgcccaggcgctgcgccgtccgttgcatttgcgacttccacgttgctccaccgtcccaagcacgcgcggccgaagcgatgagaaaatagaccgagatcataaagaagacctcgttggcccagcagccaagcaagttaatgaaccccagcagtcccgaataggggaaggcggcgagcggtgcatattccggcacgctgatgcagacggcctggaaggtccactgaaacgtgtggaataccgcgatgccagcgaccgctaccaagcgcagcgcttcgatggaggtgtttctgcttgttttgctgcccatcagactattttccagcgcgtgcgttgtatgaaccaaagtgcgatgtgatcatttttagagtttgcttgggccccttgttccatacgttatacaggccctcgcccacgaggtccttggcgtatgcgcagtagctgattttagggttggcgatgcccatatactcggcatagagctttttggccgcaggggtaatgcgaggattggcaaataccagctcttgcggcatgcgttcgaacatcctgtggatcgcccgctcgatttcggggtggccatcaattccggtgtgctcaatcatgatgcccatataggtgaagccacgtgtgatttggggtgtccaaacggcggggtcggtgacgttgagccgctcaagaatatcgaccatgtcgttccagcgattaaacggcatcaaggggtcacgcttggccagagctgccgccttttcgggtgtttcctcgcggtagcagtaatacggcttgggccagtaagcgatggcctttgcctggcatagcgtttcgacgaggaatggattatcggcccaacctgcaccggggatttccttaaaccagatattgttttgcatcaggaagtcgcgacgatagattgccgaccaaatggacggatgatgggccagcagatgtggagcgtcgtgaatggtgaacggttgccgagacggtttgatgcgaccacgatatgcgcaatgtagtttgacctcttggggggtatcggggttgcgaatgatccaatacggggtctcaataatatcgagcttgttcggaccgccaaattcgcgcttggcaaaggcaaacatgtcggagtacattccgggctcgatccagtcatcgggctcgaggatggcaatccagtcgcccattgcctcgcgaatgcccagattgcaggttgcgccgtaaccctggtttgccttatcgatcactcgaacgcgtgagtcgcgcgcagcgaaatcttgcataatggcgagcgagttgtcggtggatccgtcgttgatggcgaggatttccagttcgattttgttttcgtttaataggctgcctatagcctgagaaagatacggctcggcattgtaagtaggcacgattacggtcagcattcaaacactttctctaggcgatttggaagaattatacctaattgcatttgcaacggttttagttgcgttcgcctaatactgccaagggctgcacgactattgctgacgctgcgcctgtaatggatgtcagcgatcggctgcaataaaaatgtcggcagtggcgagacggttgtccttcccattcttgctcgttatgggaccgatcgattgtggacgcggactgaacctaaagaccaatcgttgcccaacaggacgcgtgggttcgaaggtgccctacaggcatcttcgaacgatgcacgtatgaatgcatggtttaaatctcaatccatttgggagtagcagaataggcgtgacagcgcactgttctctgcggttaaaaaggcaccggcctcatgttttgatgccgctgcttctaccgtggacgcgatggtcgattttgatgccgaactcggccagctggtgtttacatataagcactgccgatggtagttaccatcgcgataggattcactctatgagcgacggatatcgtggcacgtcgagcctttttgcggacatcgcatatcgcatggcgatgttgaaccccgcactaggggatcgtgtgctcaagacgccgggcgtggtaatgattgacgagatcgaccttcatttgcaccctcgttgacaggcacgaattctggaggacctcgttcgcatcttccccaacgtgcagtttgtcgtgaccacgcattcgccggttgtcgtggcttcagtgcctcgtgacaatatttgcattcttgatggcgagaccacgtcggttcctgcgacggagacacacggacgtgatgcgggagacattctcaacactgttttagatgcttcctcgcgtcccgaggaagcagcccatttgttcgatgcatttaaccgtgctgtagacgaaggacgtcacgccgacgctaactgtgcgggcttggcccccgtccccccaatctagtagactctaaaccgttgctagattagggggattttccatgaatgagccagtagccgcagggcagctcggccgccgtgcccgcgttaagggccacggaagggacgccggctttgcaaattgctctggcaagttttgccgtcagcgtggtcgtcatgtgcccgtcggcattcatccattcggctgccgattgcgccgtcgagaccgtgctaccgagccccgcatcatgaagcatcggaaggacagcttgacgaaccgtgtcattcgcccacgttacatcagttgcaaccttttggtcagtatcggcgtcgtcgacaacggtcgccgaaaggagctggtacgcgtcataccgcgtcacaaccgtaccgtccaccgtaatggcaccggtatcggcagcatgagccgtcccaggggcaatcgcgaaagacagaatagcgaccatgattatcgtcgtggcagccaacaagcggcggttaagcctactcacggctaccacctcgaccttgatcgcgatggcgacgagcatgcatccatgtcgcagcaagacacagcagcgacgcaccagccagatacgtcatagtcaagccagccccgcccgcctcaggaagcgtggtcgaatacttattggtaaaggtcggtggggttgtagagccgttgtcgtaggtgacctcggtgtttagctctccttctccattagtcacgacaaccttaacctcatgtttggtcgtgtcgtaggtgatgtggtccttgacgttgttctcagcgcccgcgggaatgacctcggagatggcgtactcatagatccccgtcttggtgtaatccaagacaaagtcgatatcaccatccgcaccgttcctgatggtctggagaaccttaccggtcttcttgtccttgagcacaaacccgaactggctttcttgcaaggtcgagccttcgagcaccttggtggcagaaattgtagcttgaccgctatagggcgcatcatagaccgtgatgtcggtactcaccgttggggtgccaatgtcgacaccctttgccctcagctcttctgccttagtaagggccttctgatagtcgtcctcattggtgcctttgagcagaatccacaccggtttagaggcaatattgtatccgccgggtgccttggtctcctcaaggcaatacaacttgtaggcttccatcttttgcgtaggagtgccgaacgttaccgtgccctttttgtctgtttcatcactccgaatcagcgttttcgcagaatcgaggccgaaccctaatgccttgtccatatcaacctcgtagagcgtgaactcagcaccgggcagcttttttgtgacatcgctctcgtcgaccttggtaaccgttacgccgtaaccgctaccgccagccgaaccagacgcctttttaatagcccagtcttttgaatggaccgtatcaccgtcgtagacacccgtaagcgacgctttgttgctcagagaaaccgtttctccctcgttacctgcagggatcacttcatactcaactttgagatactccttatcgggcacgcggagcgtcatctttgtacacgccgcgccgttttcatcttcaatggtcctagcggaaacggggcatttgtcagagccaagcaacttccagcctgtcccatcgtattgggacacagtgaccgaatccgtcaccagcgtgcacttggcatccatgacatcgacaagctcgaggaactcgctgtcgctcttaaggttaactgccgattcgttaaccaagatggtgtacttgatgcggttgctattggcgacctgatcgccggtcttttgcagtacgttactcttaatggtgacggtcccactaccggagttgaacgttttgctccccgactcggcactggccgagtttttgagcgtagtcgagttcgtagaagtgttgagcacgctgcgctttattgccgttttatacgtaagcttggcatagccggcatatttacctagtgccgtcgtggggatggagaaggtaacttcattacccgaaacgctcccttcaacatccagattcgttgccacttcacgttcggcttctttacgctcgtcatagggattcgcataaagcgtatatgtggccgatccgggaacaaagctcatagttccgtccgccggcaaggtatccttaatcgttatgggctgaccgtcaagctttccagcaccatagcattcaccagcaggagtcttatagcggttggcgtagaccgtccacgttgcaatccaagcacccttttcagtcgaaccgggctcgacctgcgaccaatcaaatttgccatcccacgtatatccatccgatgatttgtcaacgtcaggggtctcagagttattgatgatgtaatacggctctgacgagtactgcttaaagttctttccgacaaatggaaactgcacggccgccagattccagtactgtccgtcaaggttatcagtcacagtcgtgtacacaacatcaatctggtatccgttggccctgagctcatccattactctatcggtggcacgcaactggatattaaagttaatcttgttgcctttcgttacctcatcacgagtgtagaaataataatctccactcgtactggtcccctcggagagcgtgacatcaccgatttttacggccaatgattcgactttaaggtgctgcagatacgtgcttttgaacgtgtccagaatctgaacttgggacacatcgaccgtctcgggaatctttacatgggtgatccaggtggcattgccgttttcatcatgcgactccagctctttggtgatcagctgctcgacaatgccgcgcctaaacgttgccgtgctcgttcctgatggcgacgtcgtcccctctcgcttgattcctgccgtattcgtgacgggatcatacgagttctgatcggtcatttgggtatgatactcaatctgataaggctggtacttctctgcttctttcagatcgcggaacgtataactaaatgtctcggcagaattgctgagatcaccttcatcaaccttttcgctcttgttaagtcccctataaaccgtatagctgcctatatatttctgtttcttgtccagtgtatcggtgaatgtatagccattcatgtcggttttgatatcaccgttgttgagcgtaacggtccatttgatatcggacggcgttccggtgccatcgctcttgttgatcatgtcatagcggaaatcatttgctaaacccggcttttccaatccacctctacggtctccgccccatgtccagctggcattgttttttgaaccgtcgagttggttaatccaaactttgttgcccacggatacatccgggttcatcaccgaatcataggtaatcgtatgagtccctttggacaagttacccaaattaagagtcgcggtctgctcgttaatgctcggctgctgcttgagcgtctcgccgttcaacttaaacgattcaggcacaaacgtaaaattgctacccaactcatcggtgagctggacattgtgagcataggactcgaccaccagcttaagagtccacgttacttttccttcaccgccggattgagagaacttgccttccttcgttcccgccacgtcgccgtctttggtcgaaatgtcaattccggccgttccgggaaattcgacttttgttgtatcgccggagccaacgttctcatttgctagcttgaatgaaaaatcaacaccgacatgaacatcggacggattcgtattaatccagttttggtcgaaagtgaaaatcagcttattattctcgcacttccaggtgccagcctctttgcccaaaccgtcatagagcaacccgctttcatccttcaataacttaacattgctcggaagagagtactccgcaacgttttgcgccgagctcggggtatggttcggcctaaagtccgcgctaaacgaaccgtatagggtgtcggtcgaaagcacggcagtattacccaaaggcactttacggttctcgtcggtataaagctcaaccgtaacgtccgcagtattctcatcaatcacaatcggcgtcggcgtcgtcgcatcctcggcacgcacgggggctgcaccgtgaaaaactgcggcggtgaggctaattaaaatgaagatcagggccgccatacccagcgaccgtgagcggtgtgcgtccatagttgtcccctaattcctacaacacagagtggaatacggcgaatcgtcggatcgaacacaaccccaacatcaacgagaacctacctagcgcattgcaagaacccactggggagcaacttctaagacggttcgtctatgccacaatgcataaaatacaatatagataccagtcatgtaaaccgcaggtaaaaaggtcttttaatttaataccagttgatatttacctgttaacagttttgtatcaaagtgtttgtatttcaatgattcatgtatatgtttaaacaactcaactttgcctgaaaagccgctcggggggggataacctcctccaccgtggtgcagaccaactcaatctccatgcaccaaaaagggcgccgaccattgcggtcgacgccctttcttgttaggcgctataaagcccagcgcttatttgttgacctggccggcgcggacggcggccttcttgcggtcggtggcgttgagcagacgcttgcgcaggcggatgttcttgggagtgatctcgaccagctcgtcatcagcgatgtactccagcgcctcctccagcgagaaggtgcgaggcggcaccagctggacggagatatcggaggtcgaggaacgctggttgcccaggttcttggtacgggcgatgttgacgaccatgtcgccagccttgctgcgctcgcccacgatcatgccctcgtagcactcggtgcccggctcaacaaacagctggccgcgctcctgcagcgtgcccagggcgtaggcaaccgccttctcggtggtcatggagatcatggcgccgttctgacggttgccgatctcgccggcgtagggaccgtactccaggaaggtgtggtagaacacaccctcgccgtgggtgacgttcatgatgcggttcttaagacccatgatgccgcgcgttgggatcttgaactcgaggtgcgtcacgatgcccgaggtatccatgctcgtcatgataccgccggaggtaccgaagacctcaacgaccttgcccgagtactcgtccgggcactcgacgacggcctgctcgacgggctccatcttgttgccgttctcgtccttcttaaacagaacgcggggacggccgacctggaactcaaagccctcgcggcgcatggactccatcaggacggacaggtgcaggatgccgcggcccgagacctcgacgccgctcttgtcctcgagctcctcgatcttcatggtcacgttgttctcggcctcgttgaacaggcgctccttgagctgacgggcgcccacgatgtcgccgtcgcgaccgacgagcggggaggtcgaagcctcaaagacgatggacagagtcggcgggtcgatctcgatgggctcgagctcaacggggttctcggggtcggtgtagacatcgccgatatcggtgcggtcaataccgacaacggcggcaatgtcgccggcgccgacttcctggcactcggtgcggcccaggtagtcgaaggtaaagagctgcttgacggtagcagttgcgctggagccgtcgttcttgacaaccaggatctgatcgccctggtgaatggcgccggaatacacgcgaccgatgccgatgcggccgacaaagttggagtggtcgatggtcacgcactgcatggccagcggggcgttctcgtcaacctcgggggcgggcatgtcgtcgatgatcatatcaagcagcggatacatgtccatgttgccgtcgttggggtcaagacgggcaaagccgttcatggcgctggcgtagaccacgtgctccatggcgaactcgagctggtcgtcggtggcacccaggtcggccataaggtccaggcagtcgttgtaggccttctcggggttggcgcccggacgatcgatcttgttgataacgatcatgatcttgaggccggtgtcgatagcgtgacgcagcacgaagcgggtctggggcatggggccctcaaaagcgtcaaccagcagcagggcgccgtcggccatacgcagcacgcgctcgacctcgccgccaaagtcggcgtggcccggggtgtcgatgacgttgatcttgacgtccttgtactcgatagagatgttcttggcgagaatcgtaatgccgcgctcgcgctcctggtcgttggagtccaggacgcggtcctcgacctgctggttggcacggaaggcgtccgtggcacgcaggagcttgtcgaccatcgtcgtcttgccgtggtcgacgtgggcgatgatggcgatgttcctcagattgtctacgcgcatgtagttcccctatcttctatccatatacaaacggcacgcgtatgcggcccgcccagcgatacaacgctcagcgggaatattgagccttttaccgaaaactcgtttattttagcgattttagataagaggggtttcctcacctgcaggttcagggtcgctccacataaaaccatcgccggcacccatgccctcatacagcacgtatgccgaaaaaccgctctcgagcgtggtttcgaagaagctcacgagcagggcgtcgtgatagccgccgtcaatttcgacacaaccggtgtagccgatggcatagcgggcgatgcggcccaggccctcgtccttaagacccatcttgtgctcggagataaagttggtggccgcctcgaggcacgcctcctcgccatcctcatcgagcgccgccagataacggttggaagcagcgtcctcgatcgccacaactacacccggattctcgccggcggcaaggtcgtccaagaacgcaccaatcaggtcacacaccatggcgtcgagctcggcggagacgttaccggcgtcctgcatatcctgtgccatctttagaccttcccatcgagtctggcgtcgttacagttcttgtgcctcggcagcgatcttggcggcagcgtcgcgggcgcgcatcatatccatcgcgcgcttgtcgagtaccttgatctggctggtcagcattactgcatcgaccacaccccagattaccaagcctgttgaaatcgaaaacccaagcgcaccaactgtaccacgaaggcgcgaacagattgccgcgacaaggacggagacgacaaccatcttgataaacgagccgcggcgctcgcgaagcgtgcgggcctgcgtcacataggcaatgcgagccgcctcagaagcctccgagcgcatctgggcttcacgcgcgatggcggccgcttcagccgatacgcgggtacccatcagcgacctctccgctcgcgtgccagacatttagaagtcatcgggggagagcgtatggacgaactcgtcgaacttctcgaactcctgctcgtcgtcgacatcctcggcgtgggtggaaacagtgcccaggcgattcatgatgtcgtcctccacaaacatgggggcattgctgcgcacggcaagggcaatggcgtcactggggcgggcgtcgatcttgcgctcggcgccatcggccagtacgacgatcgtcgcgtagaacaccggcggctcggcgcgaacgatctcgatgcgctcgagcttggcgcccagggcgtcaacggtatcgagcagcaggtcatgggtaatcgggcgctcggcgcggccgctatcgatgccgcggctgatggcagcagcttcaaacgaaccagtctgaatggaaagggagcgcagtggcgcgggcgagtccgatttgctgctgcgctcacgaagcacgataagcgatggcacgggaccggcggccatgacgatggtctctatgtcgacacgaaccatggaacacctccggtacatagcggttaacacacggcagggtcgccgcattgaatagctatactacccaatctttcgcccagcacacaaaatcaaagtagttaatttgggacggggctattttgactactttgttggataagaaaaaagccccgaggcaatgccccagggctcttaacgttttgatggtggacctgacaagattcgaacttgtgacctcccggttatcagccggacgctctgagccagtagccgcagggcagctcggccgccgtgcccgcgttaagggccacggacgcggcgccagagctctggagggaacgagcgagctgtgcgctcagcgcgctcgtaaggtgggaatcggcgttgagccactcggcagcttcctgcgcggtgatctgggagtggggcatgccggcgctgtgcagcacgggcaggacagcgtcgcgcgcggcgtcgcttgcccaggcgatctgggagtagaccttggcgtcgttgtcgccgtcggagacatcggcgccaaagatctggtaggcgtcgtagctactcgctacggtgtcgctcaccgtgatggaaccggtcgaggtcggcgcggcctgcgcggaagcggggaacacaaccgcgcaggtgctgaccaagagggcgagcagcgcaaacaagatcgggaaggagctaaacttcttattcacgacgctcacctcccttcgcattcgccttgcgacgaatgtgcatccaggccgcagcagcgcaaagcaccgccgcgccggcaaggtacgtcagagtgacgcccgacataccagaaaggggcaaagacgtggagtaggtgttggtgaaggtgggggcgtcagtgtcggtgagctcgtgatcttcgctattagcgtctgccacccactcgccatcggagtcaacggttcccttcctgtaggtcaccgcacagtcgatccttccttcggtgttatccgttgccgtaaccgtgaacttgtagaccgaattatcgaacttgtaatgcgagaaaatcgagttatcgtccttctcgcacatatagtacgtgaaggtcttggaagcgccacggcccggaacatcagaatcactctgcttcagactggcaagattgtaattaatctcgccgaagcccagggtctgggatttgtcgccgtcggcagtagtggtaatcacgccgtcggggtcggtcttaaccgtctcggcttctttgaagcccgtgttatccgcaaactcgagcgtaaactccttcatctcgccacccttaacgaccttggtcgccgcaggcgtccaggagccggtagattcgtacggagtgtacttgttggtgaaggtctttgatccatcggggttggcaatcgaataatagccgttgctatcctgcactacgccccacggttctacgttgtcccactccccagaagacttgtcgagtttgtgcttggtcacactgacgttttcaattgtgtagttatggatcttgagagctacctgctggttcgggtcgttctttttcggaacagtcatgagctcggtcgggttatccttggcgcttaccacaatctcatacacagcggagtcgtacgtgatacccggttcagcgccggaatcttcgaccaagtagtatgtgatagtggttatgtcagctgtaccactcgttgcgaactgttcatcaagatcaaacgtgatgttaccgcttgcgtcattttttgcagttccaacctcggtgcaaacgttacgattgaatgtcgcgctagccaaagggtcggttgagtccttgcggtagaccctaaaggtaaactgattctcttcgagcccctcgttcacatttgtctgcgaattacgtagtaccttggtcgccttgagcttgaggctcggatagacatacgtgtcctcaggcacgcccatgtacaggtcgccgttcgacatgatgccgccgccatggtcccaggaatagttgccggtgatgaacgttgtcgcaactttttgcgcattgatcgcggcttcgtcttgagctgtaacacccgagctcaggccgatgcttttatatacctgcacgccaccgttagcggggatagtaatggcttgcgtaagctctttacttcccttgtatttggcgtcaccgccgccaagcattttgccaatcaccgccgcgatcggggtcttatgatcctccgccgcaaggaagaagtccgcgtggccgttttcgcgaaactctttggcattgtaggcgtcagcatcctggttctttttgtgttcaaggccttcgtagccaccagcggataggtgaggggtgccttcgttaccgctattcgtttcagaattataatcagcttttgcgtcctgctgatctttggcagacgaattgccaaagattgctgtgccctcagtgttcgttaccaacgtcttgcccgtagggcagactgcaacgccaccgccatagccgtcagcggtattggcgctaatgtacgagttatatatgaatagcctaccagcagtcttctccttgcccaaatccgagtttccctggacaaagataccgcctccgccccagtcaaagcgagacatgcaagagttattagtgatgtagactgggctatcgtttgacgacccatttatcatcgcgtcaaccatctggcccactcgaatgccagcaccttcagatcggtagctcacgttagaggcaataattcctcccgtgattttcagccacgccatacccgtacgggattgcttattacggtcgacatccgtgacataaacgccgccgcctgcttcctcagaatagttgcccgtgatctggccgcccgaaatggtgacatgagtaccgtttctagcggcaagtccagcgccgccatgatcgccataaccatcatggccacagaaattggcatatttattgttagtgatgtagccaccggaaacagtgacgctgccgccttcggccatgatgccgccgccgaaaccagtgccagaaggaagtgtgctgttgccggagattacgccaccagttatggtgaccgtggaacctccagcatacacaccgccgccactaggagcgctgttgccggcaattacgccaccggtcagttttagggtcgaggccttacctttatcgttggacaccttaatgcccgcgcccgcgcccgagctagaagcgccacacacatagccaccgctcatgttgacagtagagccgttctcggcatagatgaggttgccaacattgcaattatactgttgggtaattacaccgctatcaagattaaacgtaccgcccgcataaacgttgatgagcctcatcgtggagccggcagcggtacccacgatggcaccgttgatgctgacctcgtgcctatagagagtctcggttgtccccgtaccgttcggcgtagattcggtcacgtaatacgtgagtttggtcggaatgccagagctggtgtcgtagtccatcgaggcaactcgcccattattgccgccatccgaagtctgcttttgatcagacccttggttagaatctttaactgtaagcgccgcgttattggtgatgttgaagagtggcttatttgaattgtcgcccgaatgcgtgattttatggccgcttaagtccagcgttatattgctgccgctcttctcaagtttgatttcgccgggatagtcgatatcgtttgcaagctcaaagctaacagcttgattttcctcaatgccctgaagcttatctcgcaattcaccgccattagcaatagccgtggctgcttcttcgttctccgcagcttcttcggctaccgagacagtgccatcgtcgaccgcttcattatcttctgcctgcgactcgtccttgggctgctcctccggttggggatcgcccacgccgttttcgacatcgtcactattctggttttcggtatccccgttgttggtgttttctacatcagtagactcacttgaagaatcccccgtcacagtttcttcggtagaaaccgtctgggcatcgttggcaatagcctgcgagatcgggggcatgacgagcgacagcaccaggctcaacacggaggctccgcacaaaacgcctgccagtacacggcgcgtcgcttttttactctgcttagttttttctgaattcgctttcatcgatgtctcctccccaagagaccgcgatcttgctctttcactatcaaacgtatctgcgcaatctgtaattgcgctcgtttagttatgcacttataacgattgttaaacagctgagcaaataaaaccgatagttttgtagtgagttctcaattctcttgacaattgctcggatttgccttcgtttattcgctatctattttttgtttctgctggtaatttagttgcgtattatttttaatggcattagatttatttgcacaacattttgctcaagagcaaacatcctgtgaacggtcgaaaatcgaccgtgagcggtaggtcatcaaccggaaggaatatcctaccaaattgatgagaatatcttgaacccaccggtggttagaaacatgatgttcagacagcaatatttgatttttcacacagcttttaggtatcaattcgcccaaatcgcctgaggccaccgcaaaagagcctgcccccttctgcggtggttctcccccagcgctacaacagatgttcctcgataaagatcgcaatgccgtctttgtcgttgctggcggttacaaaatcggcggcggcgcgggtggcgtcgctgccgtttgccatggccacgcccacgccggcgtcagccaccatgcaggtgtcgttatcggcatcgccaaacacgcaaatgttcgtaagctccatgtcgttgagctctgccacgcgtacaaggccgcgcgtcttggacacgcgcggatccatgaactcgtagaggcgctgcgtggtttgcagagccgccgccttaacagtgttatcggcaaacgtcgacgcccgctcaatcacccgcggcattacctcgggcgccatggtaaacatcaccttgggctgcggctcgcgcaagaactcggcaaaatcgaccacctggtagggcacgccgtcgacgcgcgacaagtgctcgacgcacgcgttgctctcgggcacgtagaacacgccgtctcgggggcagacgggcgttgccggaaggtccgccatgtgcttgcagatgcgcgcgatggtctcgcccggcagcggatagctcagctcgttgatgtcgtgcgcgcggtcgatgacctcggcaccaccgcagcccacgagcacgtccaccaggccttcgatgccccagagctcgtacatggcctcggtcgcgtgggcgtcgcgcccggtgcacaggccaaagagcacgccacgctcgcgcagggcgcggatcgccgccacggtgtgcggggacaccgtgtgctcgctcgtgagcaatgtgccgtcgatatcgcagaacacggctttgatgtggctgaaggtggcgtccatgggggcctttctgggttgtgccgcagcgtggggtgtattcgcaaacggcgtacatggtataccaaggcgcgggtcgttgggacccgaccgccacaaaggtgcctgacccctttgtggcggcttgtggtgctcgggcctcagcacaatccatcacaacattcgacgtttttcggcaaaatcgcgattttcatcgaatgttgtgacggtttcttaccgttctgcagcacgatccaaatgtccgcgtccaaacagcagcagcgccgcgggaactgccgttacgaccaggcccgcgcctacgagtgtctgctgcacgccaaatgttgctgccagccacggggcgatcgctggcggcgccacgccggcaaacatgttgccaaagcccatgaccgagttgacgcggccgagctgctcgagtggcgccgtcgtttgcacgatggtgttgtggagcgggttgacgacgccccaggccacgcccagggcgatctggccgacgagcgccacgcccacgtacggcgtgcccacgtagagcaggcttcccagacccacggacataagcgccacgagcagcgttttaagaccgatgaggcgcggcggcatgcggagcgcgaccacggcgcccaacaccgcgcccacaccggatgccgacgagagccagcccatccactcgacgccaacgtgcaggacatcgcgatagaagaacgattccagcggatcgaaggccccatagccaaagttcgaaaggaagatgatgcagaagagcagggcgaggacgctgttggtaaagaccgtcttgatgctggtcgcgaaggtggcgctggcggacgtgttggggttggagcggttgggctggcttgcgcgctccccttcccccgctgaatcgttgttcgcttgcccgacgatgtggcccgcctgcggtctaaaaccccagccggcaatgagcgcaagcagggtgaacagcatcatgagcacgaacaccgcgcgcgacgatgctgcagccgccacaaagccgcccagcgtggggccaacgataatgctcacgttggaaaacatggtgatggcggagttgatgtctttgagctcgacggggtcatcggtgagataggccgggtaggacgtggcgatgggctgggcgaaccccatcacaaagcccaagagtactgcgccggcaaggaccgtctcggtcgcgtcgccaaaggcgataatcgccgcgcccgttgccagcgtgccgacgatgctcaacagaaaatggtggcgcgggccccaggcgtcgagcgccgcgccacccgcaaaggatcccaagatcacgaagacgttcataaacagaacggccagcgacgtcgcgacgaccgaagcgccgtccgcataggtaagcgttccgataacgccgataaagtagctggtctggaagccggtgtagatgagaaaccgcattgccaccaggcgcttggcctgcgcggacagcgatggttgggattttgagattcgagatagggacatgggcgctccttgttgcatacgaatacgggccgcgggcattgaccgccggccatcgactcaatctttctgtatgcaacgttaaggacgcatcgggccccttctctccgtcttcgcccggatgaactacttggtagattgtaaggcatgtcccacacatctactaaagcaaaaaccaccacaaaggtgcctggcccctttgtggtggaaatgacgtttgcccagataaaacctgccaaaattaacctgtccctttttggcaggttttaggcgagatggtcttgaatcaaatcgcagatggctcgggcgtcgttgatgttgatggctcgggtcgcaaagccggcgtcaaaagcctggcgcgccagggcctcgttgcaggcgagggccagcgtgcggccgtcgaccagatcgagcgagctcttgccgcgcaggcgatcgacaccggagcgcgcgaccacgatgttgtcaaagccctcggtcttatagccctcgatgatcaccacatcgacgtcgttgtagcgcgacagcagctcgcgcgcgggcatctcgtcctcctcgcgcgtgtcggcgtactccgcccagcgcgtggcgcaaatgagacccacgtgtttggatcccgcctggtgatggcgccaggtgtccttggcgggcacgtcgatatcaaagccgtgatgcccatgatgcttgagcgagcccacgcgcaggccacggcgggtaagctcggcgatgaccttctcgacgagcgtggtcttgcccgagttctggtagccgataaacgcgattgctggggcagccggagtgggaactgcgggcacggccggggcggatgcgctcgcgggcgcggcgccgtcgtcagcggcggcctcggcagcggcagcttgacgctccgcgcgatcccacacgcccgagcgtccgccctccttgtgcagcaaacgcacgtcgacgatctccatgccgcggtcgactgccttgcacatgtcgtagatggtcaagcatgcggcactcgcgccggtcagcgcctccatctcgatgcccgtcttgcccgtcacgcccgccgtgaccagcacgtgaaagccgacctgtccgtcgggacgcgccggcgcccagccctcgggcgtctcgtcggccggcgttcctgccggagcgatgggctcgatatcgcacttgctcttggtgatgagcagcggatggcacatggggatgatgtcgctcgtgcgcttgatggccatgatgcccgcgacacgcgcgcaggcgagtacgtcgcccttcttggcgcggtcctgcagcaccatggcctgcgtctcgggatgcatgaggatggtgccctcggcgatggcgatgcggtgcgtctcggccttgtcggatacgtcgaccatacgcacctcgcctttggcgtccacgtgcgtcagctcgtcgcggtgcgcgtcgcgggaaggtgcggcagcgttatcgctggcggccgactgtgcggtcgtggacacggcgtctttgctggctgccgcagctttgtgggcagacatcgcggccctgcgagcggccttagtagcatcggcgtacctgctcttggccatatgatcatcctccgatttgggacataaatcgttgcgtgccctcaattatcgcgtgttcctgcggtttgtgggccacggcatcgcgccaaatcgaaagtacctgcatatcatcaccacggcgcagcgcctcgcggaccgaatactcggcatcgctaaacaagcaggggcgcacgctgccgtcggccgtcaggcgcaaacggttgcaactcgcgcaaaaatggttggacatggcgctaatgaagccaaccgtacccgccgcgcccggaaagcgccagtagcgcgcgggaccggcaccggcaggagcgtcgttgatgtcgagtggctcaagctcgcccaggcccaccgcagcggcgccggcattaatgcgcgcccgcagctcgtcgcttggcacggtgtcgctcgcgtcccacaactcgggattgagcgtgggcgcatgaggatccacggcgcaatgcgagctcgtgtgctcatcgccgatgggcatgtattcgataaagcgcaggtgaatggggcggtcgacggtcaggcgcgcgagggccgccacgtcctggttgagccggcggacgaccacacagttgaccttaaccggctcaaagccccaggtcagcgccgcatcgatgcccgccatggtttgctcgagccggccaaggcgcgtgatctttccaaagagcgcggggtcgagcgtatcgagcgaaatgttgacgcggtcgagcccggcatctttaagctccggcgccagcttgggcagcagggcaccgttggtggtgagcgagatgtcctcgatctgcgggatcgcgcggatatcgcggatgagcgggataatgcggcggctgaccagcggctcgccacccgtcaggcgcacgcggcgaatgccctcccccgccaccagacgcacaaaacgggcgatttcctcggcgctgagtaactcgtcgtgcgcgcgcggcgccacgccatcggcaggcatgcagtagatgcagcggaaattacacttgtcggtcacggcaatgcgcaaatagttgatatcgcggccaaaaccgtcatgttgcgcgcgctcgtccacgcaatcctcccctcgcgcagcgatttattcttcgggaaacataataccccacaagagaaccaggtcgacacccgtacgacaggacaggccattcgagcaagaagggcttcccgagcccatcctcagtattcaaaccgtcccaacattcgatgcttttccgatattggcaaaaaacgtcgaatgttgggacggtttaggtgttcgcagggctcggaagatgagctagacgcccctagaggccgccgttccagtgccgaatcacgaattcccgcaggtcattctgccgtttctggaacgcttcgcttcggtcgcacttgaggcccatagcgagcgcgatggcattcatcgcccggtgcaattgcagccggttggcaaactgagtcccagtgaggacgatcatcctaaagcccagcgcgctaagaacggtcatgcgctccgcgtccgacgcactgcgctgcttatcaagatggtccgagccgttgtattcaatccccgtaccgctcgcaggcgcaaatacatcgatctcgaaatacccggccttagcgagatatttgaactcgttgggaacatcgacccgatggttgagttcaaccctggtgtaccctagcccgccttgggaacgcttcgcgacgaccatgattgcagtggccgtctccatgggcgatcgtgcgccatcgtgcacgcgcttgagcacggcggccgcgcgtatagccccctgacgagatcggttttcatcgcaataagcgatcaagtcggcaacggtatacctctgccccatctcgatataatcgcctgacgacaaatgattcaaatggtaacgggcgcagatttcatacccatattccagctgctcaggctcactcatccacgagcccgcctggacaaagcacatggcctcatcaaccaccaagagaccctctgccacctcgataagatgatccgagggtatgggcgctccaaacacatggcgtcggagacccgccggtcgagagcgttcaaaatcgaaaccaaccagcgtgtcaatacgatcgagctcttcatgcggaatgccaagtaaggccaggtagtcggtgacaatctcgaccgccgcagatattctcagtcccttggcatcgagtcccaatttgggcaggcccgcagtcggctccgcctcgttagcaagcgagtcctcatcgtataggctgcttgctcgcgagagcggctcggacgggcgcaccacgttgtggtacagccaggcagtcttatgggacaggacgatcggcaggtccatgagccctccaatgggtcggataaccaaccttattcccctgctcgcggattcgcacaccttcgcatgcaagttagcgattccacccgatcgagtggcagaaaaaccgtcccaacattcgatgcttggtcgcgcgcgcagacgtggtgtaagagtgtcctgaggtccgtcgctgcaagtggcatgaccagaaggtctatgccgtcctcttttcatgccaatttgttcgctctggcgggcgctcgctgtccgtcctctacctgcggcgccgtcacggttcaaagtaaacgttggacgttcttgtttgactagtcgtttaagaacgtccccaacgactagtcagaatgagagtggataatctcccggttttggcctgaatgttggctcaaggtgggagattatccactctcaatttctatgtgtccgaaaatccactttcgttttatctgcctacatttgcaggaatagttcgtggaggcgggtgtcttcgtcgagttcggggtggaaggttacgccgagctggttgccttggcgggcggcaacgatacggccgtcgacttccgctaaggccttggcgtcgccgtggacctcgacgatgcggggcgcgcggataaacgtcaacggcacttcaccgtcgatgccgactacctgccctgtggttcgaaagctgccgagctgtcggccgtaggcgttgcgctcgacgagcacatccatggtcgccaaacgtggcgtgcccttatcgtcatgggcggcaagatcgtgcgccagcagaatcaagccggcgcaggtgcccatgacgggcatgccctcagcaatgcgggcgcgaagctcgtcgagcatgcccaactcctcaagcagcttgccctgaacggttgactcgccgccgggaagtaccaggcggtcaaagttttgcttcaaatcggctgtctgtcgcaactcgacgcagcgcgcgcccagctcggacagccttgcctcgtgctcggcaaaagcgccttggaccgccagcacggcgaccgtctggtctgcgtaatcgctcatgtgcgatcctttctgccggactagcgtccgcgctcctccatgatgatctcgatctcgtcggcgttgatgccgaccatggcctcgcccaggtcctccgaaagctctgcgatgagcttggcatcggtgaagttggcgacggccttgacgatggcggcggcgcgcttggcggggtcgccactcttaaagatgcccgaacccacaaagacgccctcggcacccagctgcatcatcaacgcagcgtcggcgggggtcgccacgccgccggcggcaaagtttacgacggggagcttgcccgtggcgtgaacctcgcgtaccagctcgaccggaacctgcagctgcttggctgcttcaaagagctcgtcgtcgcgcagggcgacaacatcgcggatctgcttttggatcttgcgcatgtggcgcacggcctggacgacatcgcccgtgcccggctcgcctttggtgcggatcatcgtggcgccctcggcaacgcggcgcagcgcctctcccaggtcgcgagcaccgcagacaaacgggacgtcaaactgggttttgtcgatgtgatagacatcgtcggcaggggagaggacctcggactcatcgatgtagtcgatctcgatggcctgcaggatttgcgcctcgacgatgtggccgatgcggcacttggccataacggggatggagacggcctcctgaattcccttgatcatcttggggtcactcatgcgcgacacgccgccggcggcgcggatgtcggccgggatgcgctcgagcgccatgacggcgcaggcgcccgcctcctcggcgatgcgtgcctgctcgggcgtggtgacgtccatgatgacgccgcccttgagcatctgcgcgagttcgcggttgagtttgacgcgatcggccttgctagtctgttctgccatggttactcccttgtgtggcatgtgtattgcttgacggaacatcctataggggagctgggtatagcggaataatcagttttagagataatagtaaggtcagactaataccagattgaatgacacgataaggtcaggtggcaagttcatgcttgactacgatttggaacaacgcggcgaagcatcgctctacgagtatgtttaccagcaaattcgagacgatatcgttgccgggcgcattgcggcgggggagcacctgccctccaagcgtgcctttgccagtcatctgggaattagcgttattactatcgagaatgcatatagtcagttgcttgccgagggctatatttgctcaaagccgcgtcgtggctactacgcatgcgagcttcccgaagccccggttctggcttcggctgcggaggatgccgatcgagattccgctcctgtgggtctcaacgcacaggatgctggtggacagcctgagcaattcgctccgctctctccatctgccttggaagccgcgcgcctctggcaaagtgctctgcgggcaacgctgacgtccgaagatgagcgcgaaatcttctcgcccgcgcctgcgcaaggtaccgctcggcttcgacatgcaattgcgcatcatcttcgcgggacgaggggtatgaatgtcaatccagacaacatcgtcatcggtgcgggcgcccagttgctcgatacgatgctggtgcagctacttggcgcggacaagatatacgctgtcgaggacccgggctatttgcgtctgacgcgcatctatcaggccatgggctgcaaggtgcggcatattccgctggatggtgagggcgttaacttgggtgagctgctcgatgccggggcggatgttcttcaccttatgccgtctcatcaatatccgactggcctggtgacgagtatcgcgcgtcgctacgcactgctgagctgggctgccgagcggccgggtcgatatctcattgaggacgatttcgattgcgagtttcgccttgctggcaagccgatccccgcgctcgcatcgatcgatgctgcccaatcggtcatctacaccaataccttttctaagagcctgtcatcggccttgcgtttggcgtatatggtcctgcccgatgagctcatggaacgatttaggcgtgagctgggtttttatgcctcgtcggtcagctccgtagatcaggttgcgttggcgcgcttgctcgaatcgggcgattacgagcgccatgtgaaccgggtgcgcgttcgtgctcgtgaggtgcgcgatagcttgacgacgcttgtgcggaaggcatttccggcgggggaggtctcgattgaacacgcagacgcgggtctttactgcaccgtggttgcggagtgcgaagcgggcggaaactcttttgcacgggccctcatgcactcgagtatcccttttatcgatatcagtgactgtttttggtgtaccgatggcgcatctgtccctgaaaactcaactcaaattcttgtccagtatgacgatctgagcccgaaggtgcttaataccttggaattgcagctaacgggggcgctctgtaacctaagtgagtagacttgtggcactttggcgactaggcagttttgtaacaagctatctacctgtggttttgagaagcagaatgaccggtctgctcggggtgttccaaatagtctactcacttgccgcgcaaagcttcggcatgagaaataaaaggggttttcaacagggcttcgtccagttctcggcaagcttttggtcagttggggagggctgttgaaaacatagtagtccgttcgacgccattttttggtgcgttcgcgccaatgcgagaccgattgggttgaaattcgtgttttcctgtgcttatgaaggatctgctttgtgacatatcggcttttaggtactggcgtttgccccctcaggtccgcgctttgtgtccgccgcttccacggccggaagaagaccggcagcgatataatctcgcccgtaacccgacggctgcggttgcgctcggctttccgttgtatacattggttcggacgagaaacaagcggacttgtcctgccagcattaggcagcggctgttcctcggtgagctccccagggaatccgtgctggaaacggagcatggatttttgattacgtctcctctactgacggcattcatcatgttgcggcatctgacggatcttcagcttcttttggtattggcggagatgtgcggcttgtttgcggtgtgcgctctgccggcggcgcttgaggcggagcttacgcgcgcaattgattcgggcgcgatttcgacagcgttcggttgggtgcgctgcccgtccgaagacggcaccgcttcaaatttatggcgtcgagacgctttggttttgggcggagaccttgaccgtttttgttcagatgtttgcgggatgcgttacggcaatagatttatggcggtatcgcaactcgttccattgggtgccgcgtcgccttttgaggtcgaggcgtatttgttgcttggactgccgcgagccctgggaggcgaagggttctgcggcatagagctcaatgtcgaagtgaagctaagcacaagtgctcgagcgattgtgggaaagtcccgtgtatatatcgacctacttctttcttcgccggacggcaggcgacaggtggccattgaatgtcaggggaaggcctcgcacggacgcgcaggggatggcttgcgtgacgctgaccgcatgacagcccttcaggccatgggctacgatgtacttctcctgacacacagacagatatccgatgagggtagattccgcgcgattgttaaggccgtatgcaggatgctcgatgctgaatatcgtgataaaagctcagatgagcaaagggctgagacattacttcggtctgaactattcgttgactggacaaaattgggagtaattgacggaaagatgcccgttagacacaaaacagctcgatcgtggacggctgcggttctaagtgagtagacttttggcactttggcgaccaggccgttttgcaacaagtcatttacctgcggctttataaagcaatatggatggtgtgctcggcaagttccaaaaagtctactcacttagtttttgacgagaaaccgatgcctaaggtggtcttatttcagggagttaacaagttcgtgaggcacgaaaaaggcccgaaccgtgcggtccgggcctcatcgagctagagattgtctctcaggcggctgtcttagccaaagtagcgcttgagcaggccggcgaaagccttgccgtggcgggcctcgtcgcgagccatctcgtgcacggtatcgtggatggcatcgaggccagcggccttggcgcgcttggcaagatcggtcttgccggcggtggcgccgttctcggcctcaacgcgcatctcgaggttcttcttggtggagtcggtcacgacctcgcccaggagctcggcgaacttagcggcgtgctcggcctcctcgtgggcagccttctcccagtacaggccgatctcggggtaaccctcgcgatgagcgacgcgagccatggccaggtacataccgacctcggagcactcgccctcaaagttggcgcgcaggtcggcaacgatgtcctcggagacgccctccatcttggcgacgcccacgacgtgctcggcagcccactcgagctggccctcctcctgcttcaggaaacgagaaccgggaacgccgcactgggggcacttgaagtcctcgggcagctggtcgccgtcgaactcttccacataaccgcatacggggcaaacaaacttcatgattcgatcctttcgatcgatggcgatggggcgcttgtccggtcccgtaagggccctctccggacgcgcgtcttgacgagttctattatccataaatgagaccgaatgtgaagcctattaggaatgatttttaataaaacaattttgatactgtcttctaacagcgcccgcatagtccgcagcggacgcagccgttgcagatgaacttgcttccgcaggtttcgcaccactcataatacggtggatcccaaagctccgagctggggatttccaagccgagcgggtcccttaggtcccattcgatttggctgccgcggtgctggaggcctgatttccatgcctgctcgctttgcagatttttgccacgaaggtgataggtttgcccgtccttaacgaaggtgcttccggtttcgatgaaagcgaacgttgcatctgccgccacgcattcggcatacagctggcgcacccattcgtaatggcaggggcgtgctcccgcgtagttttctccgcctgcgatgacctgctcgatcccatcgggctttccaaggctgccgggggcggctttctcgaccgacacacttccgataaatggcgcgcacatgatgccgcggtgtgctgcgggcgtggcgagcaggaggggaatccgctcatctgcccggcgctggttctcgcaggttacgttgagcatgacgtttcgccagccatcgccccagtcgccgggaaggcattcgctaaaacgctcgggacgtttggtcagaataaagaactttacatcgggcctctggcgaatgatgtcccatacttctggtcgccagggatcggcctcgggcaacaggaagtcgctcgtcatgcagatgcggataagctcgccggcgcgaactttgtagctgccgtcccggcggcgttggaggggataggtaaagcccgacttgcttttgctaatcacggaggggtcgataccgcgttgtccgtccatgtaatacatgtagcagttgtcgcatccctcgctgacgcgcgtgcagccatgccaggggttccagatgtcgtgcatcttgatgcctcctttgcggtagatgcgcgtctgatggactctgaaagattaacaccggcagatgagcgcgatggccccgaacaatatgaagatgttgattgattaacgattaatgggtcgcttgcgttccgcgatgagtacaatcggtcgagcaaatgttgacccatcaacaaatgaaggagtttcctttatgcatctagcccgtcgcgcctggtgccgaacatatcagacggtttttcgcatcgcattgccgatcctgccctataccgagccgcgtattttggagcatgccgaggatgtgcccgcggtgcttcaaaagcgttcgattcagcgtgtgctcatcgtgacagaccctggcattgcccgtttggggctcacggcgccgctcgagcgcgcgctcgcgtccaaggggattggcgttacggtctatgccgatacgcgtgcgaaccccacggtttcgaatgtggaggaagcggcggcgctgtatcgcgagaacgactgccgggccattatcggctttggtggcggttcggctatggactgcgccaagggcgtgggcgcgcgcattgcgcagccaaacaagcccatcaacaagatgcgcggcctgttgcgtgtccaccgtctcctgccgctgcttatcgcggttcccactaccgccggcacgggaagcgaagtcacgctcgcggcggtgattaccgatgacgagacgcactataagtaccccatcaacgactttgtgctcatcccgcgctttgcggtgcacgatcccgagtttacgcgtggcctgcctgctgccattacgggacagacgggcatggatgccctgacgcatgccgtagaggcctttgtcggccgcagcactacgccctacacgcgcaagatggcgcgccaggcggttcagctcatccacgacaatttgctcgaggcctatgaacatggcgacaacatgcgtgcgcgccgcaatatgctttcggcggcgtataaggcgggcgtcgcatttacgcgctcctatgtcggatacgtgcacgccatcgcgcacagcctgggcggccgatacggcattccacacggtttggccaacgctatcatcctgccgcacatgcttcgcgcctatggcgacaccgccgctcccaagcttgccgatcttgctcgcatggcgggcatcgcgccggccaccgcgcaggacagtcttgccgccgaggcctttatcgattgggtcgatcgcatgaacgaggccttgggaattcctaaatatgtctcgggtattcgtcgctccgatattccgcaaatggcggcccatgccgatgccgaggccaatccgctgtatcctgtcccgcttttaatggaccgtttggagctcgagcatatgtacgaggtcgtcgcgggtggtatgtttgaggacgagaactaggagggcccatgaacaccgaggaaatcgcatgcatcgttagcagtcagcgcgcctattttaagacgcatgccacgttcgatgtcgatgctcgccgccgcgcgctcgtgcgcctgcgcgatgcggtgcgggcgcacgaggacgatatcgcccgggcgctcaagaccgatttgggcaagtcgcacgacgaggcgtatatgtgcgagatcggcacgtcgctttccgagattcgccatcagattgcgcatgtggcccgatggagtcgcgcacgcctgcgcccgtgcgacctcgccaatgccattagcgtgtgcaggacgcagccggttccctatggcgtgacgctgattatggcgccttggaactacccgtttttgttgacgctcgagccgctcgccggtgcactcgctgcgggcaacacggtggtcatcaagccgagtgcctatgcgccggcttcaagtgcggtgctcaagcagatttgcgaggaagcgtttaatccgcgcctggtgacggtcgtcgagggcggccgtgccgagaacgaggcgctgctcgatgagcgctgggacaaaatcttctttaccggcagcgttccggtcggcaagcttgtcatggagcacgcgagcaaaaatctcacgcccgtgacgcttgagctgggtggcaagagcccctgcatcgtggacgcctccgcaaatctgaaggtcgcggcgcggcgtatcgcctttggtaagtggctcaacgtgggccagacctgcgtggcgcccgactatctgctggttgacgcgcgcgtgcacgacgagctattgggcctcatcaaggaggaagtccgccgcatgtttggcgagcacccgctcgacaacgaggactacggccatatcgtcaacgccaagcatttcgcgcgcgtgcgcgggctgatcgatcccgacaaggttgtgctgggaggtgcggcacgcgaggcctcactcaagattgagccgacgatcctggacggcgtgacgcccgaggatgccgtgatgcaggaggagattttcggccccatcttgccggtgctgacgtttgaaggtctagacgaggccgaggcgtttattatggagcgtccgacgccgctggccctgtacatctttagccgggaccgcgcggtgcagcagcgctttgtgcgctacgtgccctttggcggcggctgcgttaacgacacgatcatgcatctggctacgagccatatgggctttggcggcatgggcgcaagcggcatgggacagtaccatggccgtgaaagcttcgatgcgtttagccacaagaagagcatcgtgagcaaggcaacctggctggacgtgccgttccgctatgcgccctacgcaagctggaagcacaagttcgtgcgcatgtttgtgcactagaaaaaggcgcgggcaatacgaacaggtgttcctattgcccgccatttgcgttagactactgccacggggtacggatgggccaactctctttagaagggaattggtatgagcgtaagcgatgttatttcgttattggcgttgttaatcgcggctatcgaactcggcctgtttatcggccgaacgaaatagccgcccccgcgtaagcgaagacggccacttctcacgatgtaaacgtgtatcggagttggcaagacccgctgccacgggtgccatccgtgctcctatcttatctgcaagcgctctggcatgcaagcgttgcgacaaacggtcgaaaagacccgggttggtctatttgtgtccgcacgagttcgtagacttctcaataaggttaagtgccggttattccggccgttagaggagctgccatgtacgagccttcacgtgttcttttatcgtttcacatcgctggatttcagtatgccgacggcgcattggttctgggcgatctgaaagcgggcgataaactgacactgtgtgccgagcgcgataatccccacgatcccgaggcggtcgcgatctatttcggcaagatcaagctcggctatgttccgggaaacgaggttggcccgctgtccgtgatgatgtattacgggcacgaagatgtgtttgaagcccgcgtgcagcaggttgcgcccgagcgcagcccctggcatcaggtgcgcgttggcctttacgtggcggatgcccgctagccgctaggggaggctgtcatgtttgatgacgacgacctgtttgatctgacggatgaaccgtttgagtgggacttgctgctcgatgacgatgagctggagcaggatcgagaaaagcggaaggataagaacgcacgggacgacgtatcgaagaagaatgacaagcgccgccgtggactgtttggcgggctctttgggtaaccgctgcgccaaagcgtctgtatactaggcacgtgttagacgcgttgcgaaatgaggacacagacgatgatgtggtttaccgccgacctgcacctgggcgatacgaatatcctgcacgatatggatcggccgttcgcctcggtcgaggagatgaaccgcaaggttattgacgccattaacgagtgcgttgctgcggacgaccgcctctatatcctgggagactttacgtatcgcttgcccatggcggaggccgtgctcctgcgcgagcgcattgcctgtcagaacgtgacgctcatccgcggtaaccatgacggcgattgggaagatccggacgcaccgcacatttgggatgacgtgcgcgattacctggaaattgcccccggctatgccaagggacatcgcctggttttgagccattaccccatgctcagttggaacggcaaagcgcgtggcgccattatgctgcacggacatatccacagcaggggagaccgcaccaacacgcgcaaccgtgatcgcgaacgccccatctaccgctacgatgtgggcctcgacgccaatggctacaagcccgtaaaccgagaccagatcttgagcttctttggactgtagctttcaaaccgccataaaggggacaggcacctttgtggtggtttttccatagattggagtcgttgtgaaacaactgcttattcgtgccgacgatatcggttattcgtacgctgttgatttggggattgcccgtagcgtcaacgagggtttggtgcactcggtgggccttatgcccaatatgcccgaggcggagcgtggttggtcgctcgtggccgatgccggcattgcggtgggccagcacaccaacgtgtgcctgggcaagccgtgtgccgacccggcgctcatcccgagcatgctcgatgagaacggcgagttccatagcagccgtaccttccgcgatcactttaagcgtggcgaggaactgattgacttcgacgaggcctgcattgagattcgcgcacagcatgaccgctttgtcgagatcgtgggtcgcgagcccgattactttgaggcccacgctgtcatgagcaaaaacctcaatcgagcgatttcggcggtggcacaggagctgggccttaaggagcaaaaggcgagtttcgaccccacggccgtggtacgctgcggagacaccgatctgcgcatggtgatgcgctcgatggagccgggctacgagcccaaggactcgattatgcagacggttcgcgagatggacgatggcgagacggtcgtcttcgtgtgccatccgggttatctcgatcgttttatcctcgagaacagttcgcttacgaccgatcgtaccaaggaagtcgatgcgctgatcgaccccgaactgcgggcgtggctcgaggctcaggacgacctgcgtctgatcgactaccgcgacctgtaaagcacccaaaccaccacgatggggacaggcacctttgtggtggttttggcgccgttgccattatggcggcggcgccttttttgtccgcgcggcgcggtagagtgtaggcgattagaatttgcgtccatcgaggagctgctatgaacgagatcaagtgcccgcattgcggcgaagtctttaaggtcgatgcatccggctatgcggatatcgtcaaacaggtgcgcgatacggagttctcgcgcgacctggatgagcgcgtgaaggccgtccagcgcgagggcgagcaggcactggagcttgagcgctcacgctcggctgccgccttacaggaggcggagtcggagcgtaacgctcagctcgttgagcagaaaaacgccgcggctcaggagctggcgcaggaagttgccaggcgcgacgccgagctggccgagctgcgtgccaagctcgagggcgctgccgcagagcgcgagagcgcaagccagcgtgcggcggttgaggctcgtgccgatgcgcagaaggaaaacgctgagctgcagcgcgaaattgacaacctgcgtgcgcagctgggacgcaaggacgacgaagccaagcttgccgaggccgcggtgcgtaacgccgctcaaaacgacctggccgcccgtgacgctcagattgccgagctgcaggcaaagctctcctcggcggacaaggcccaggagatggcgcttgccgccgcggccgccgaatcgcagcgcgagcttgatgctgctcgcagcgaagctgagcgtacgcttgccgactatcaggcgaaagtgaaggagaagttcttcaccgcaaaggctcagtccgagcaggaggcagagggcctgcgcgcccagctgcgtgagcaggagctgacggcaaagatgaacctgtcggaagcagtcgccgcggcggagcgtgagcgcgacgaggcgcgtgccaagctgacgagcgagctggcagtgcgcgattcacgcgaggagcaggccaaggcagcacacgagctcgagcttgcgcaggccaagcgcgcgagcgatgagctgatccgctacaaggacgaagagattgagcgcctgaaggacatgaaggtgcgcctgtccaccaagatggtgggcgagtcgctcgagcaacactgcgagactgagttcaatcgcttgcgcatgacggcgtttcccaacgcgtattttgagaaagacaacgatgcgtccgagggtaccaagggcgacttcatcttccgtgagtgcgacgcgagcggcaacgagatcatctcgatcatgttcgagatgaaaaacgagaatgacgaaaccgcgaccaagcacaagaacgaggacttctttaagaagctcgaccacgaccgtcgtcagaaaggctgcgagtacgcggtgctttgcaccctgctcgagcccgagagcgagctctataacgccggcatcgtggacgtgagctaccgctacgagaagatgtacgcgatccgcccgcaattcttcattcccatgatcacgctgctgcgcaacgccgctatgggatcgctgcgctataagcaggagttggcggagtacaagcagcagaatatcgacgtcacgaacttcgaagccaagatggaaaagttcaagaatgattttggccgtaactacgagattgcgagccgcaagttccaaacggcaatcgacgagattgacaagacgattagccatctgcagaaaaccaaggaggcattgctgtcctccgagaacaatctgcgcctagctaacaagaaagccgatgatcttacgattcgcaagctcacttggggcaacaagaccatgaaggcggcgtttgacgaggcgcgcgaggccacagcagatgcgggcgatgagcctgccgaagctgatgcctatgaggtcgaggatgccgagtaggggatagcgcatggcgcaaaaagcggggccgctggcgatgttgccagcggccccgcttcgtttacctggctgattcggctagtcttcgagcagatcctcgataaagccgacgcggtagttcttgaagatgacctcgccgccgtcttgcgtggcatccagatcgacatcgcccatgatgccaaagtcgtggtcgccatcctcgtcggcaaagatctggtgcacgtgccacacgtgatcggttttctcgtcgctctcgtcgatggtaaacatcgccgaactgcgggcgtcgccgtcggtgaggatttcctcgtgctgctcgtggtaggcatcgagcgccttttgccagcggacctcgctcatgccccagtcctcgtcgagctcgcccaggtcgcggacgtgctcgcgggcagcaagggtcacgcggcggaagagcgcgttgcgcaccagcagggtgcagccgcggcgatcggccacgacctcgtcgatgccctgcggcggcgcggcgtcgagcgcagccgggttgccggcgttctcccactcgtccaccaggctcgagtccaccgagcgcaccacaaagcccagccacgaaatgatgtcgcgcaagcgctcgtcgcgcttctcaatgggcacggtgcgatcgagcgagcggtaggcctcggccaggtagcgcagcagaatgccctcggagcgggcgatgccgagcttttggatatagcccttaaagtcgctcgcgctctccagcatatcgcgcaggacgctcttgggcgagagctggtagtcgttggcccagggcacttcctggcagtacttatcaaaggcggcgtcgagcagctcctcgagcggcttttcgtaggtgacatcttggatgcgctccaggcgctcctcgtactcgataccgtcagccttcatctcggccatggcacggtcacgcgcggtacgctcctgcgcgcgcagcacctgtttggggtcctcgagcgtcgcctcaaccatcgagatgaggtccatggtataggtctcgctctcgggatcaagtagctccagcgcggcaagcaaaaacggtgagagcggctggtcgagcgcaaagtcttcgggcaggtcgactgtcagcgcatagtcgatgtcgggcgcggcgtcggctggggcgtcgggtgcgggcggcacctcggtgcgcacgacgacgccggagtcgatgagcgtggcgaagatctcgtcggcgcgaacctcgagcttcgccttttcctcgggcgtttgcaggcttgtctcgatgaggtcgtgtacgcgggcgcgagcgtcaccgccctgctcgaccacgctaatcaccatggagtgcgtgatgcgcaggcgcggcttgagcgtttcgggctgcgtctcgatcatgcgttcaaaggtctgcttgttccaggtgacaaagccctcgggagccttcttctttttaatcttgcggagctttttggggtcgtcgcccgccttggccatgagcttggcgttttcgatctcgtgctccggggcctcggcgatgaccatgccctcggtgtcaaagcccgagcggccggcgcgtccagcaatctgatggaactcgcgggcgcgcaggcgacgcattttgtagccgtcgaacttggtaagcgcggtgaggaccacggtgtggatgggtacgttgatgccgacgccgagcgtgtcggtgccgcagatgacgggcagcaagccctgctgcgccaggcgctcgaccagcaagcgatagcgcggcagcataccggcgtggtgcacgccgacgccgcagctgagcaggcgcttgagaattttgccaaaagccgttgagaagctcgtgcccttggtggcttccttgatggcctcgcgctgctccttgctggcaatgccaaagttggcgagggactgtgccgttgcaagtgcggcatcctggctaaagtgcacgatgtagagcggagcctcgccgcggcgcatggcgagctcgacggtgccctcgagcgaggtcgtcacgtagtcgtagctcagcggcacgggacgcggggcgtcgacgaccaggtcacaggtggcgccggtgtgctcttcgagcgaggcagcaatggcggtgacatcgccaagtgtggcgctcatgagcatgaattgcgtgtggggcagggtgagcagcggcacctgccaggcccagccgcggtcggggtcggcaaagtagtggaactcgtccatggcgacgcagcccacgtcgccatcctcgccctcgcgtagcgcgtcgttggcaaggatctcggccgtgcagcagatgacgggcgccttggtattgatgtgcgtgtcgccggtgatcatgccaacgttatcgcggccgagcacctgcactaggtcgaaaaacttctcgctgaccagggccttgatgggggccgtgtagtagcagcgcttgccctgcgccatgcccataaagagcatgcccagcgcgacgagcgatttgcccgatccggtcggtgtgcccaaaatgacgtgatcgccggcagccaggtccatgagggcctcttcctggtggtcccacagctcgatgccgcgctcgctcgtccattcaaagaagcgctcgaaggcctggtcgggcgtgagccacggttcgggctcactgccgtcctcgggctcccaccaggtgggggagagcgctccgagcgagccgaactcggcctcggtgcctgtgccgcccgagaacgagctggcggcgccggcgccggagacggtgctggcggaagtatctgtcgtggtctgtgccatgtggtttgctttctctcgcatttgtccgccatccattatggcgtagcggcggcgtggggcgccagcgcgcgagaaaatgcaggaaatgggcgtgtgatgcgagcggtcgttagcgttcttgcggcaggcgcttcttacccttgcgggcgcggttcttaaagttctcgacggcctcttccatgccgaggggcacgtaggtgagctcatcgaggtcgtcgggcaggtagcaggcgaggctctgctcctgcgctcggcctgccgcgagctgctcttcggtaggctccgcgccgggtgtggcgcagatgccgtagacaacggcgcccatctcgcgcgtgcggcattcgtactcggtctcgggatgctcaggatggtcgcggcgcacgtcgtcgctcgcccaaagcgtatcgtagccggccgcggcaaactgccccagggcgtagtcgcgcaacggcttgctgtcggtgcgcagcgtgacggtggcgccggcagcaaagagcgggcggtagagcatcagatggtcgacatggacaagtcgctttttggcgtacttggccttgggctgtggcgtcggaaagttgatggtgatggcatcgagctcgcctgcggcgaacagctgcggcagcgatgcggcgcctcggggtagcacgagcgcattgggcagctcctgttcgcagatcttttgggcggcataggcaatgcagatgggctcctggtccatgccgataaagagggtatcgggctcgcggtgggcgcgctcaaccaggtaggttcctttgccgcagcccaggtcgagatgaagtcgggcgaagggcttgtcgccagccggcgtgcatgcctcacaccagtgtccggcatagttctcggggttcgtctcgatggcgtcggcgtagcgctccaggcgctcctcgagcacaaagttcttaggcgtgcgaacgtggacggctcccatgagactccttggtcataagtatggaacgcatggctgaacgctccggcaatgggttggaaaggggcgggcgcaatgtgcccgaaagttgcggtgcgactcagcggcgagtcgcttggtcctacaggcgcttaagaattacatagcgattgagttcgccgctgcgaccatcggcatggaagcgctcaagctcgcgcacggggacctcgccgctcttgtagaacgtgcgcacgccgcgcaccaggtcggtgatctgctgatcgtcaaagtggtggcaatagcggtaagcgtggcggtcgttttgccagccaatgaggtggtcgccggcttcaaactgcgtggagtcgtaaccctcaaacggcggggtgagctcggcgcgggcctcggcgcgaacggccttgcgcgccatgcgctcgtcgttcataaactcccaaaagctgatggcgatgatgccgcccgggcgcgtttggcgcaccagggcgtcgagcacgcgtacgcggtactcacacgacggcacgtggtgcataaatccaaagcagaccgagatgtcggcgagcggggcgtcgaaaagcacgtcgggtgtttcggcggggttgagcttcatgagggcgtcgagcacgtcgagttcctggaagtgcaggttgggaatgcgcagggcgtgaccatgtgcatcgatagccaggtcttggcacgagtcgacgccatagaactcaaacgggcagctggcatctgccgaggggtttgcgccgtcgacgcccttggcggcaagcgtgccgccggcggcaaagttctcgaatcgcatattgccgcaggcaaggtcgaagacgcgtacggggcgctcaattgtggcaacgtcgagctgttcgagcgcgatatccatggtgcgcacccagccgggccacggtgcttgacgggtatcggaaaaggaggcggagtgctcgcgatagaacgtattgttgagctggatgagcgatgaggcgaaatcgcggttcacggcgcgggactccctccgttggcggtgcggaataaacggtacgaccatactaccgttatcgccgcaacggggacaaccgggctgcgggtcattgcttggtttggacacattttcgcagctcatgcgcgcccgcaaccgccggttgtcaaaaatcccactaaaataggtggcatgtttttggcggtggcggatagattttaactgtgcaaggcgccttaagaacaaaagcggtccggcggcacggctggcaaaagcataggaggaaccatgaatgtagaaactgcgcagcggctcgccgaccttcgccgcagcaaaggctttagccaagaagggctggcgcgaaagctggggctgtcgcgccaggcggtcagcaaatgggagcgcgcggagagctcgcccgataccgagaacctgatctcgctcgccaagctttatggcgtgagtctggacgagctgctcaatccgagcgacgagatcgaggacgatatcgagtttgagaacgaggaccgcgcccgccagcgcgaggccgaggcggcagagcgcgctcgcacccatgaggcggcggtgcgcgccaccgaagcggcaacgcaggcgagtgatgccgcggctaaggcggcacaggcggcaagctggagtgcacaggccgccaacgctgctacggcgcaggcgacgagtggccacgcagttggctcgactccggtgaagggccccttccagtcgttcccgtattgggccgtgtgctggctgctgttctttttgctgatgttcctggttggtgccagcccttttcccgcactgatcttctttacgattcccatctatcactgggtggcgcgtgcgctcgatggcgattgggcgcgcggggatatccaggttggtccggcgccggtggcggtcaaggcccaggggaaggatacttctgcggaacctgatgctgacgtggctaccgcagccaccgctgagccgtgtgccaaagagggtgacgaatgatgaagctttcgcatgaatccaggctgcgtctgggcgttggcatcggagcgtttgtgctcatcatcgggcttgtttttggcatttcacggactttgattcattatgatggcccgtgggatctcgacgatgtcgtatccggcttgtctggtatggacgatgcggttgacgaggacaatctcttggacgacggcagctattccgctcggcctcagcaactttcgagcgaaacgtttgatgccgacgcgttcacatcgcttgacctggatgtgacgtcgggcacggtcgaggtcaaacacgtctccggcgggccggtgcgcgtaattgaaagcggtcgcgtggcaacggggaccgttgccttcgatgcggcaacccagaacctggccgaaatcaagggctctacgctcaagattcgccagttcgattgcgatgacgagcgcgccattgaccgcacggttaccgtcgaactgccgcgcgaagttgccgataacctggtcggcattacggcgaaggtgggatcgggtgatctgacggtcgcgggcattgcgtgccatgacctcaacctgactttggactcgggagatgttgagtttactggcaccgtgaccgataccctgaatgccgaggtcggttcgggcgatgtgacgctcgagctttaccaggcccccgcgaagtcgatggacgtgagtgtgggctcgggcgatgtggagatgacggttccgaactcgacgggctttaaggcgagcctcaccttgggcagcggcgacttcgagagcgatttccttccgcttggctacgacggcgagaccattttgaatcttgaattcgataacggtgacaagtctgccacgtatcgttttgaggtcggttcgggcgacatgtcgtttgatccggagtgatggctgcgggctggtccgcaagcatagatgcttagacgcgctgtttgatggaggcgccggagccgtggtcggctccggcgcctttgcctttacaatgggggcatggaacagattattttgaacatactcgaggccctgcgtcgcggtgagaccgtggacgacaaggcgctcgtcaaactgatacatgccgaggcgcgtcgtgagggcgccgacaagcgcgatctggccaagcgtcgcctgctgccgttttaccagcgggtgaagcgcgaggaaccggcgcgttgggctgggtggaatgtcgatgccgagctggagcgtcaactgctgcaggtcctgcgcatgaagccgcgccgcacggcttcgggcgtggcgaccattaccgtcatcaccaagccgtggccgtgctcgggcgattgcctgttttgtcccaacgatttgcgcatgcctaaaagttatctgcatgccgagccggcgtgcgcccgtgcggagcaaaattgcttcgacccgtatctgcaggtgagcgctcgtctgaccgcgctttcgcagatggggcatgcgaccgacaagattgagcttatcgtgctcggcggtacctggagcgactatccgcaagggtatcagacgtggtttatgtcggagctcttccgcgcgctcaatgacgatgccgtcgccggcgtggctgccaaccccatgttggcgcgtccgggcatcagtcgtgtcgaggcagggcgtctgctcgatgacgctcccgccgacgccttgccgccggtggtaacagagcgccgtgagcgctatcgggctgccggtattgcgaccgacgaggccgagcttgcgagcggtgttgccgacgagcaggggcgtgtggatgctgccgtgggcggctataaccgtgcggtgcgtcgtctgtacggccccggcacgccgtggggcgaggtcgccgagtggcagacggccacgatggaggagctcgggcgtcaacagcgcatcaacgagacggcgaagcatcgcgtggtgggcctcgttatcgagacgcgtcccgatgccgtgacgccacaggccctcacactcatccgccgtctgggctgcaccaagattcagatgggcatccagagcctcgaccagcacctgctcgatatcaatgagcgtcgcatcacggtggcgcagattgagcgggcgttttcgctcgcgcgtctgtttggctttaagatccatgcgcattttatgctcaacttgctgggcgccacgcccgagggggataagcgcgactacgagcgttttatgaccgagggcgcctttatgcccgacgaggtcaaggtctacccatgcgcgctcatcgagggttcgcgcctggtgggctgttatgagctcggcgagtggcgtccctataccgaggacgagctgctcgatgtgttggccgacgacatcgtggtgacgccggcattctgccgcatcagccgcatgattcgcgactttagctccgatgacattatggtgggcaataagaagcccaacctgcgccagctggtcgagaatcgcctggccgctcgcggcgacggtgcgacggtgcgtgagattcgctatcgcgagatcagcacggcgggtgccgacctggatgagctgtctcttgacgaggttgcctacgagaccccggtgacgggcgagcgctttttgcagtgggtgacaccacagggcaagatcgcgggcattttgcgcttatcgctgcccgaccgcgcatttgttgccgcacatgcggacgagttgccgacgacgccggacgaggcgatgattcgcgaggtacacgtgtatggcatggcggcgcgagtgggcgatcagggccaggcggcgcagcatcatgggctgggccgttcgctggtggagcgtgcatgtcagattgctcgggatgcgggctatgcgcacattaacgtgattagcgcgatcggtacgcgtgagtactatcgtcacctgggtttttacgaccatggactctatctgcaaaaggagctctagatgaacaagccgggtgtttctgccggggttgttgccggtgttgccttgggagctgctgcgcttggtgcggccgctgtcgctgttcgcgctgcctgcttgcaggtcgcgcggactcgtaatgggctggcacgcgtaaagcgcgtgcacgatgagggcggcgatgagattcgcgtgctcgtgcagggcggcgtctaccaaagcgcaagctatgttggcgatcgttgggcagagccggtctttgcgtactatcgtgcatttgacgatgtgtttgaggccgaggacgcaatgcgtgacgcttatggtcacggtatcgaccgtacgcttatgctgggcggcggtgggtttgcctatcccaagttcgcgctgatgtcgcacgagggcttgcgcatggacgttatcgagtatgacggagagattacgcgcctggcgcgccgctggttctatctggacgaactggagcgcgcggtgggcgaccgcttgcgggtgattaccgctgaggctcgctcgtatctgggtgtgacgagcgtgggtcatcatcgctacgacgtggtcgtgagcgattgctttggcggtgtcgagcccgtgcgcgagctggcgacggttgaggcgttgcgtttggtgcgaggcagcctgaatcccgggggtatctacgttgccaatatcgtgagcgcaaacgaggggagcgacgtgacgttcctgcgcgactgcgctgccacggcactcgaggtattcgcccacgcctgggtggtcccatgcggtgatgcggagttcggcggcgaggagaactacctgctcatcgccagcgacggcgactacgcctttgccgaagccgtgcccttcgacgctgacttcctcggcaccgtccttcacgacaagtaagtctccccgtcccaaaaaagactggtcttaggcgtggtcgcgccagctgaggacgcgctgcttcataccctcgatgtcgagcacgccttcggcgaagcctttgcgcacgagctcctcgggaacgtactcgtcgtagcgatcaaaataaggcacctcgccgggatagacgagctcgatggggtcgaagtccttttcggcctcggctgcgagtaccttaaagaacgtctcctcgtcagccttcatcttaaactgcataaagtatggacgcgacggatcgagcccgcgaaggcccagctccgcggcgcatttaatcttgagcatgcgctcgagcgccaaaaaggcgtagctgcccaaccaggggaagagcacccaagtgtcgccacccaggttgatgagcggcttagttcccgcgcccgaaatctcggcggtatgacgagcctgcgccaagcgagcctgtgcgttacccataaggtacggatatgccgcgtgctcgttgagcgccttgcgcatgcgctcgagcacatgcgtgttaatgtcgccggggcagtcgccaaagtaggccggcacccggcctttgacctgcgtggcaaagacggtatggcgcttccagtccacttcttcgacaatccagcaatgtccggcaatggcgatgcgctcaccgggcggtggcggattgacgatcgtgcccaactcggccgactcgctgcgaacggtgaactcctcgttttcctggaacacagcgtagaacttaaagttgttaatgatgcgctcgcccgcgagacccacgatgagcccaccgccctcggtgacctggatatggtcgattttgatgaggtggcgcagcagtacgcgatagtcatcggccgagacgcggtggaaatagctcagtgtgagcacgcgctgggcaagctctgccggcgtgagctcgccggtgctggcaagcgtcgacatagtctggtggtagagcaggctgtaggggagtcgatcgagctcgggcggctcgacccacttttcctcgcgatagagttgtacgagcgcgatgccctgcaggagcttccacggaatggtctcgggcatcatcgtgcgcggctcaggctcttcctcgcgcatgacaaaccacatctcgggcggaaggtcgcggcgtcccgtgcggcccattcgctgcaaaaaggaactgacggtaaacggcgcatcgatctgaaacgcacgctccagacggccgatatcgataccgagctccagcgtagaggtggtgatggttgtctgtgcctgctcctcatcgcgcatgagttcctcggccgtttcgcgcaacgatgccgaaagattgccgtgatgaatgaggaaacggtcgggctcgtgccggttttcacagtagctgcgcagcatggagcacacggcctctgcctcctcgcgcgagttggcaaagaccaggcacttgcggccgcgcgtatgctcaaagatatagcccataccggggtcggcgttgtcgggcgccgtgtccgtggggttgagaagcgcctgctcggtcgctcgtgggatgtcgacttcgccctcgggggccgaggaagtgcgacggtctttgggagcggccttgccccgtgcccgctcacaacgttgacggcgctcctcttgtgtgagctgtccgctgtgacgcatgtcttgggtgccggcgggcagtgccgcggatgccgccgcctcgatgcgctcgcacgcaagcacttcggcctcttgaggacccgtgctctcgaatccccgctgctgtgcctggggacccgagttgtagaagtgctccatggagatgcgccacacgcgacgcggttcctcaaaacgggggataacgcagtcgcgtcccgttccctgcgagagaaaggcacccgtgcgctcggggtcgccgatggtggccgaaaggccaatgcggcggggctgcacgcctgccatgcgcgagaggcgctcgataagacagagcgtctgcccgccgcggtcgccgcgcatgagagaatgaacctcgtcgatgacgacgtagcgcaggtcgcaaaacatgcgcgggatcgccatgtgcttatggatcaggagcgcctcgagcgactcgggcgtaatctgcaagatgccgctcggttttttgatgagcttagccttgtgcgactgcgagacatcgccatgccagtgccagacagggatatcggcctcttcgcacaggtcgttgaggcggacgaactgatcattgatgagtgccttgagggggccgatgtagagggcgccaacgctcgcgggcgggttctcccaaaactcggtcaggatgggaaagaaggctgcctcggttttgccggaagccgtggatgccgtcaggagcacattgtcctgagtgttgaagatggcatctgccgccgcaacctgaatagagcgcagactctcccaatcgtgggagtagatgaagtcttggataaacggggcgtagcggtcaaaggcgttcacggggcctcctttcaaaaacgaatctctcaacgcggtgggaagtggcttgctgcattactgcttcaacgttcgcccagataaaacctaccaaaataaacctgtcccttttttgcaggttagatggtgaattcggcgaagttgcggtcgccgtctgcggttccggtgtcgcctgttgtggctggcggcgccagcgtgacgccgccaacgctttgtagcagctcggccacgttggcatcggggttttggcacaggatatcgagcaactcgataaagtcgcggatgacctcacggggcgtcaggtgcgtgtcggctcccacgcggccaaactcaatcttgaggaagtccaccaggtcgttctcggtaagcgtaggcgtccagccaaagtagccggcatggatctgcatgagcttttcgatgagcaccagcagctcctcataggtgagcggctgcaggcgaatgatgggtgcgagcatgtctttgaggtcctcgcgtgcaaaacggccctgggcgaggcggctgcgcagagcctcgtaggaaaatacgccgcgtcgacggtcttcgatggaggttggcgtgccgcccatgatcatgcccaggtactgtgccttgccttgcagtgtgtcgttgtacatggtcaggatcttctcgtagttgtactggcgcgtgatggcgttggggatcttgtacaggtttacgagttcgtcgatgagcaccagcatgcccttatagccgctgcagaccaaaaagcgcgcgatgagcttgatgtagtcgtaccagtcgtcgtcgctgatgatggtcgaggagcccagctcggcgcgcgcctcgctcttggtgcgatactcgccgcgaatccatttggtcacgcggctcatgctctcttcgtcgccctcagagacggccgtgcgataacggcggagtatgcggacaaagtcaaagccgtggaccatctcctcgagcggggcaagctgggcattaacggacgactcgtcggcgtcggcacacgaggcgacccagcgatccaggataaggttgagcgcgccgccctcggggcgcgttttggtcgatatgttgcggatgagctcacggtaggtggcaaggccctgaccctggccgccctgcaggcggcgctcaggggataggtcggcatcagcgacgacgaatccctcacccatggcgtgcgtgcggatggtctggagcaaaaagctcttgccggcgccgtaacgaccgaccagaaagcggaagctcgcgccaccgtcggagatgagactcagatcggtgagcagggcgcgaatctcgacttcgcgtcccacggtgatatagggaaggccgatgcgcgggaccacgccgcccttgagcgagttgagaatgacggcggcgacgcgcttgggcacgcggggtgctgcggatgcggtatcactcatggtctaggtatcctctcacgtctgcttcgtagtcctcgataatctgcggccctgccgcgccaaattcaataacggtgtcgcccacgaggtcaaagagggcctcgttgatgctgtcgacgagcatatcttcgctttggcccgaccgcgccaccgccgatactgcctgcgccgcgttctgctcgagcagcgcacgaagatagtcttctgcggcgggggcgagtgcggatgcggtgtcggcgtgcatggccgtcgcgggtgtgggtgctggcgcgaggagcggggctacgacgccaaactgctcggtggagatggtcggctcgtcagcctcgtcctgttgcatggtcgtcgcgactggttcggcaaccatgttggcctcaggttcggcttccagttgcccagagtctgcttccacggcttccgtaagcgtgccgtcctcacgttcctcgtcgattaaaagcgcctcgcgcgtctgtgcggcggcacttcggatatgccccagctggctcaggtcgatatcgatcttaacgggctggtgcgtggcatcccacgaaagccatgccacgatctcgtcatcgataatcttggccagatatttggggatcttttcttccttaaggggatgggcggaatccagcgccaggcgcaagcgctgatcacaagcgcgcattatctcaccgagcttgctacttttttgtctgctgccgtggatgcgcatacattcccaaaagccattttggcagcggtagatgtgaatggggtccaggcgatattcgcagtcctcgtggcgctcgggcgcaaagaagacggccgaggcaaacatggtatagggcatggccgtctcctccccaaacaggctcgccacgataccggtctttcggtgtgtgtcatagtagcgcgccatgcggacatatacggcgcatgccacgtggcgcaggtcgcgatggtgcccgcggtcgagccttgagttattgaggttgtacgtggagagcgcgttgatggcggccatgagccgctcctcgcgcgtctcgtcaggcggaagggggagcgtgggctctgaggttttgcggcgcttagcggtttgaccggacggcgcctgcgcgggcgcaaggtctcgagccgcgcgtcgcagctcgataagggcgttgtcgaacatgacggttttagagtcacgaagcagcttggggtcgagcccgtggaaaacggcgtaatcctgcagccacacgcgtgcaaaccggtcgatgccgggctcaaagacgcgatagacatcccaaaaggccttgatcttgtcaaagccatcgagcggatcatctacgccaatgtcgcagatcagctcatagagatataagaaggcaaaggatgtagacgtttcctcgatattgccgcggcgcacctgggcgcgccaggtaaagtagccgcgcagttgtcgatcgctcatggcgttgtaggtgggaaagtacgacttaaacgtgccgttgtagggacaatcgtcttcgaagtcggccatcagtaagccctgacggtaaaaaagctccgcctctgatagccaacgccccgcgccgcccttgggatcatcctgccagcgcgatatctcgcgcatcttgcggtactggtcggggaggaagttctgcatctgacggccggtcttgagaatcggctcgtcagcatagattttgtttgagaagcgggcggactgatgggtccgagcctcggccataatgcgctcgatgagcatcttgacgtcctggtcggccaccgccctctcctctccctatacggtgtcggtgacctcatatcatagcacagcatcaaacagatgttcgaaataccgcaacgtagatagatttagaacaggagagcgtagatgacggcaatgacgacggctggcagcatgttggccgtgcggaaggtctgaggtcggataaggttgacgccgacgcagaagatgagcatggatcccacgagtgagagactgtcgagggctgcggtggtcatgatgggggagagtgcgccggcaaacagcgtgatcgtcccctggaacacggcgacgggcagggccgagaagatgcagccgcggccgagcgaggccgtcatggtgcagacgatgatgcagtccagtgcgcccttcagggcgagcgtggaccagtcaccgagcaggccgtcctgaatcgatcccacgatggccatggcaccgatgcacacggtgagcgatgccgagacaaaggcgttggtgaactcgttgtctccctcgcttccggttttgcgcttgagccattcgccgaggttttcgatggcagcttccaggttgatggcttcgccgatgagcgatccgagggcaaacgagacgatcagcatggtggtaccggtggtcgacagggcgccgccgtcgataacgagcatcttttgcatggtgccgcccaggccgataaacagaacgcacagccccgacgccttcataagggtatcttggatacggggcgtgataaaacggccgcccgctaatcccaaaagaccgcctgtaatcaaaagtgcgacgttgatgatcgttcccaaacccggcatggaccctcccgtattgatgccaccttggcaatcgtagcagaatggaacgcagggcatattgcgacttgtctaatacgttatatgagtggtattaagtctggcgtacagcgggtaggccctaggttgtcgtcggaacgtagggatagtattcaaagcgtagcgtcatcagccgttgcggggactcgatggccgcggcgatgatatcggcatctcgggcgcggtcaaacccttcaagttcaatctggtacgagacgtcttccataatgtccagacgccgccaagctaggagcgtgtcgccatcgaattccaaggttttgcttccatctggggcaacggcgtataggcacagcttggcagtggttgcagggtcaacaaccgtgatctttttaatttcgtttcgagtattcttagcacccagcaaggtgagcagcgtcggggccacgacctcgcccgatggcaaaaagacgacctcgacggactccggaaatgcgatgatggcagatttgcgaacaggttgattggccgcagcaacttcgatgcttgctgcatcgacggtcgtcgtgtggtcgagtgcggtgagcatacagcagttgccctcatcgacatcttgggacgtcgcaaggcctaggctgtcctcgagttggggatcgtttggctcgataacagtttcatccggttcctctgaaggggcggagatgccgtttgtcggcagtgacgcgctttctgcttttctttctgttacggctgcgttcgtggtgccatcttttgatgggaaggccatttcgttcaatgcaaagggagcaatcccgacggctccagctccattccattccatttcgaggagcgccgggtcggcaagtacgtgctgcctgtcttgcgtttggacatcgatctcgatagggcagggtttcgcccctcgagtaaggctgagcgacccgttttgcttatcgtctttgattttggcgccttcggcattgtcggcgtagaacaacaggggggtctctcccgttgcgacggcgtcggtgctggctttggttatccgcaacgatgccgtgaatgagagcgtgggctgcgcgccgtcggcgtgcgagacaacgcagcccaggcatacacctccttcttcttcgaaaaacgcgctgtcgaaggcgaccttcgcttcgttcgccgagtcatcgaccgaagcgatgtcgatgcgtagctccaaatcgcaagggtcgtcatctgcatcgagcgcaactgagcgccacgtgcagatggcgcatcctgcctgggagccgttcgtcttgtccgaacgcttgatatccacgactatcgagctgtccgtgtcctggcgaaggcatcccgaggtcgagactgttgcctgtgtgagcgaaaaccgcttgcatgcaatgacgctcgacgggtccggtgcggggcttagggctgccggcaaggagtccgccatgacgggggtcgcccaagcggcgataggcgttccggttgcgagtgcgccgcagagcgcgacgacgggcaaaaggttcttcgatgccatggggtctccttgctttatattgtgcgagctggttgtgtcttattgctggttgcgtttgatgcacagtccgaggccggtggctcccgcgcccgccgcagcgacgcttgctgccaagagctgcttttcgtcgtccgtttgcgccaacggttcctggcggtcgccgcgatcgagccccgagaggtcgaccgtcacttgcgtggcggcctgcgcctgctcttgttgggcaaaagccactgccggcgcgagcaccaggatgccgacgatggtggccgatgcgatcgccttatgccgtagcgtgtgcaccgggctcgaccgtccaagtgattgttgcaacctgatcgccttcgccggttatatggaagatgtcgcgcgtgacacgggcgacgtttccgctcgtcttgagcttgatcttgtccgaaccgccggcaataccctgatagcccatgtcaaaggttgcgttcttggagagatcgattcccgttccctgcgttgcggcgctggcatcttggagcgcgccgtcggggccgaccttaaagtcgatggagttctgcgcggatccggtcttggcgtcggcggcaatggtccaggtgttcatggcgtcgatcttcatgttggtgacatggatgccgtaggccgaaaggttgtcgatggtggttgcatcttctgaggggccctgaagcgtgccgtcggccttggcgacgaacggaataaccgtcggaactttgaaattaacgttgtcgatctcggttctgaccattaccttcgtggttccaacgcgcccggctgccatggctggcgtcggcgccgcgcccattgcgagtgcgagcgccagtcctgcgcccacgacgagcgctctggctccgttcatgttcctggtgatgtccatggtcgttcctttctattcgccgcgggccgtccccgcgatgattggacgagtgttggtgaccgcgcgcaatgacgcagcgggcgttaggggctagttctcggcctgttccacccggaccttgacgcgcgtcggattgccgtggttgtcatgggtcttggtgtcgagtgcctggatttcgatatacgcttcgccttcctcgatgtcgccggcgggacacgtctcaaccgtcttgccggtttcgacgatgccggactcataaatggtctcgtcgttttgaatgacgcggaatcgctggggaaacttgttgtcctggacgttttgcacgttgacgcgcaacttgccgccctcctgcaactgggcgaccggcgcgaccgagatcgtcatcatgttgtcgcggacgatggcgtcgagctcatcttggatctcttggcgcgatttgccctcggccgtcgtgaccgaggcacccgcttcgggtacgggctgcgactgccaggcgtacaagcctacggcgacgagggcgcaggcgatagccaagcagacagcgatgagtttcttgcgataccccggactcgcgaatcggggcaacttcttcgcactcatgcggcgtccttggtggtgtagacgcgtgcgaacgtggacgggtccgctccaaagagcatgtgaagcatcaggcggcgcgagtagacaagctcatcgaagtcgggagggagctcgatgtcgtggatgcgtgcgatgtggtgagcgagcgccgagaacgactcggggtcgcagatcacatcggtggtgacgtggtagaccgccgtatcggggaatgcctcttcgtcgaaaggcaggagatagggatcgtcgtcgacttcgatggcgacgccgtactggggccagtaatatgccatgggaacctccctgcttctggggccaaaacttctctcggtttggctgtcgatgccgaccgtatcagccactacttgaccaaaagctgaccaaatgcttgacggatttgcatcaccgcaggtaataggtggtaaaaaatacttcaacattttttgagtgccaatttcgcgatcgttggcggcaaagcgatatgtgtcaaaaacatcgcctgccgagatctagcggccgctcgccgaattgcgcgaacgtaaaaatcctcaattatggagacggtctcgaacacgtcaacgaaacgatgcggtaacatctccctgcaaacactgtagttagctaaaggggagttctgcatgtctgcaaccatcaaacccttcaccgatgagttcgaggaatacggtcgcgacgagtctcgctcgtcgggcgaggcctcgagcatttcgtttccaacatcggaaggcgaggcttgcgccatcctgcggcagctccatgccgagcgtgtctcggttacggttcagggcgcccggaccggtcttgccgccggcgccgtgccccatggcggccacatcctcaatacctcccgtatgaatcgctaccttggccttcgtcgcgatgacgagggccactttctcttgcgtgttgagcccggcgtcgtgctgtccgagctgcgcaagcagctgggcaagaagatgctcccgaccgcaggctgggaccaggcttcacttaaggcttacgaggaatttcaagaagcccccgagcagttctttcccaccgatcccaccgaggcatctgcctgcttgggcggtatggcggcatgcaacgcctctggcgcccgtagctacgcttacggtcccatgcgcccccacatcacgggtcttcatgtcgcgctgaccgatggtgacctggtcgagcttcagcgcggcgaggtttttgcccggggtcgccacctgtcactcgtgacagcggaaggtcgtgcgctcgagttcgatcttcccagctataccatgcccgagaccaagaacgcatcgggctattttgttgcggatgacatggatgccatcgacctctatatcggtgcgtgtggcacgctcggtgtcatcaccgagcttgagatcgtcctgcaggcggcgcctgcggtcgtatggggcgtcagctgcttctttgacagcgaagacaaggccgtgtcctttaccgattccgtgcgtcccgtcctatcccatgcagccgccatcgaatatttcgatgcaggcgccctggatatcctgcgccgccagcgtgagcagtcgacggcgttttcttcgctgccggcgctcgacaaagaggccaaggtctgcgtctacgtggagctcgactgcgacgacgaggcccaagcgaccgaggagctgtatcacttgggttgggtgctggagcttgcaggtggccgcgacgatgcgacgtgggtcgcgcgcaccgaggtcgatcgcgaatgccagcgattcttccgccatgcggtgcccgagagcgtcaatatgcttatcgacgagcgtcgccgcaccgaccccaccatcaccaagctgggttcggacatgtcggtgcccaacgcgcgcctggccgatgtcatcgccctctatcgccgcacattggccgaaagtgggctcgagtctgccgcctggggacacattggtaacaaccatctgcatgtgaacattctgccgcgcgatgcgcaggattaccgccgcggcggcgagctgtttgcccagtgggcctccgaagttacggctatgggcggcgccgtctccgctgagcacggcgtcggcaagatcaaggcgggctttcttgagacgatgtacggccacgaggccatggtcgaatcggcgcggctcaagctccagctcgatcctgccggacagctgggtcgcggcaacctgttttcggagaagctcttggatgaactcgtccagaaagggggcgcgtgaagatgagcgatttccatatggtggtgtgcgtcaaggcggtgccgggaagcaccgaggtcaagatggaccccaagaccaataccattgtgcgcgacggcaagcaggcggtcatcaatccctttgatgcgagtgccctggagtgcgcgctggcgctcaaggacgactttatcggctttggcatggatgtgcgcgtgacggtggtgtcgatgggtattcccgcgaccgaagcgctgctgcgcgactgcatcgcccgtggcgccgacgacgcgctgctgctaaccgatcgcgcctttgcaggtgccgataccttggcgaccacgtatgccctcaaatgcggtatcgaggcgctcgacgaggacttcgacctgcttatctgcggcaagatggcggtggacggcgatacggcccagattggtcccgagcttgccggcgccttcgagattccctgcgtgaccgatgtgagctgcgtgcagagcgcgggctttacgacgtgcggttcgctggcgctcgttcacggatgcgatgccggcgaagagacggtctatcttgagatgccgtgtgcgatgacgaccgctaaggagatcggccagctgcgcatgccgagcatcgccggtattcgtgcggctgaggaggctgacgtgcgcgtggtcaacgctgccgacgtgcatgccgaccctgcgcgctgcggtcttgccggctcgccgacgcaggtcgtgcgctcatttgtgcccgaccgcgatcaaacgtgtgaagccgttgagggcaaaccgaccgagcaggcggcaaagcttgccaagattatcgaggggatggcatagatgagcggactggttatcgatagcgaagcctgcatcggctgcggtcgctgcgttcgtgcctgcgcctcgggcggtattgtggtggagggtgagcggccaaaccgctgcgcccgcgtaaccgacggctgcatcctgtgcggcggctgcgtcgacgcctgtccggtcagcgctatctcgattgaacgcgatgaggccactgacgcagtcgatctcgacgcataccaagacatttgggtatttgtgcagactgacgagcatgacaccgtagcccctgtggcctatgagctcatgggcaagggacgcgagcttgccaatgcccgtggctgccgtctggtggcgctggtcggcatgggtcccgagagctcacttggggagctggagcatctggtctgtgccggtgcagacgaagttatggtctgtcgcgacgagcgcctgcgccaaaacgacgcggaggtctacgcccgcctgatctgcgatttggtggccgagcgcaagcccgaggccattctgtacggcgcgaccgcttttgggcgcgagttggctcccggcgttgccgtgcgcttgcagacgggccttacggccgactgcaccgtgctttcgatggatacggagacgggcctgttgcagcagacgcgcccggcgtttggcggcaacctgatggctaccatcgtttgtcccaatcaccgtccccagatggcaacggtgcgtcccggcatctttaaggcgcccgactttgactacggccgctccggcacgattacccaagtagcgcttgcggaagacgccaaggctcgtgtcgagatctcaatccctgccgaggagtggggacagcaggcctcgatcgccgatgccgagcgtctggttgtggtgggccgcggtatcggctccaagaaaaatcttccgttgatgagaaagcttgccgaagccctcggtgccgagctcggctgcacgcgccccgtggtggaggcgggctggctggagtatcgccaccagatcggccagacgggcgtgtcggtctcgcccaagctcctcgtgagcatcggtgtctcgggtgccatccagcatctcgccggcatcggcggggcggagtgcattatcgccatcaatgaggacccggacgcccccatctttggcgccgcccagtataaggtcgtcggcgacgccgtcgaggtcgtcgaggagctgctggcccagcttgagcgctaggcacgcgccagccagtcgcgcatctcgtcctttaggcgctcccaggccgtctgtgtggtgggatcggcgaaaggccgcgtaatgccaaagggtgcgtcgagcaggcggtagatatcgccctgctcgcacgccagcgcgcgacttgcgggatagacaagttcaaacataaagcagatgagccctaccaggaagtctgcaggttcgttgcgctcatcgcgtgagacgcagcgacgctcgtcaaaggcgtcaagtgtcggcgatgagaaatggctggcgagaaacgtcttctcgtccaccttgaggatagtatcgacggtgctgtcggcgatggtgcgcataatgtcgaccttatcgccgtcgcgcacgatatcgcagaagcgccgcgtgcgctcgtcgagctcctcgggtaggcggaaatcgctgtgataggcaatgctcgcgcgaatgagctcgtcgttctcgtcggcctcaataaaattgcggatgctcgttgcggctggtgcatcggcgggattctcgccaaagaggacctcgacgcccaacgctgcatggctcatgctctcggcatctttaaaggtgtcccagcgtcgcagctgctcaaagcggcccatatcgtgcagcaagccgcaaagccaggccaggtcgatatcattcggcgtccagccctgttcgcgcgccacggcatcgcacgcttccgccacgtgataggtgtgttcgattttgagcgcgatgcgcggattggtggcatcgtaggcatcggtataggtcttgaaggccctggctgcccgcgttcgatcgatagctgtcataatgacttcctaaaaagtttgcgttgttcgatccggtggcaattgtaggtgaactcggttgccgtcggacgataattctgccgcatcgttacatgcggctcggatgccttgtcgggataaggaacgttatggtgttcaaaatcgttaaaactgtctggccggtgatgcttacctatgttgcgattggcgcgccgtgcggaatgattatggcgcagacggggatggagccctggatggtctttgccctgagtggcacgttcgtgacaggcagtgggcagtttatgatctgcaacctgtggctggcgggcgtgccggcagcatcgatcgtcgcaagcgtcgccgcgatctcctcacgcttcgcactttattcagcatcgatcgcaccgcatctgacgggtgcctcgaagcgtcaaacgctggcggttgccgcgacgctcaccgaagaggcgtacggcatctcgctagccaagttggtcgagggggatgactggggcccacgcgagtcctttgcgctcaacgtgatcctcatcgcaacttggggcgtctcatgcacgatgggcgccgttgtcggcgccgtcatcgatgttcccaccgctattgcaggttttgtctgcacatcgctctttatctgcctgctcttttcgcagcgattgtcgcgcggcaatgtcgtggccgccgttttggctgcggtatccgtcgctatatgcaagttttttgggtggacgaatgtcgctgtgccggtgagcgtgctcgtcggtgtcgccgtggcactcgtgtgcgatgcccttacggatggaaggggtgcccgcgatgcccgttaatgagtttttggtcctgtggctgtcgtcgtgggcggccatcgcgttcttccgcatcgccccggcgtttgccttgcgtggacgaacgctgtcgccccgcgttaccgaggccctgggctacattcctcccgctgcctttgccgcgctggttgccaacgacttggtgagccccggggcattcgatgcgggactgttgccgggtgtggttccttggatcgcggccgccggcgtcgtggtggtggcgataaagacaaaatcgatgttgtggtgctgcgtttcgggcatcgtgctctatatcgccttgagtctcgtgtaaggccaaggcgcgcttgccgccttggcctaacgaatcgaatttctcatcgagctggtctgcttcttctggtaccatggtcaaactttactgtagcaaagcatgacgtgggcttttgttccccgtcagcggaaatgggggtttcatggcgcaggaagcaaccgtcaacgagcaaaagaaattcaaggtcccgcgtatcccgggcgacatcatgatctatcccatgatcgtcggccttttgctcaacaccttctgcccgcaggtctttgagatcggcggcttctttacggctgcctgccgtggcggctcaaataccatcgtcgccgcgattctgctcttcgtgggtgccggtatcagctttaagtccacgccgggcgctatcaagaccggcattgtcgtgctgatccccaagctcgtcgtagcggcggctctcggcttgggcgtggcgtatttctttaacgacaacttcctgggcctgagttccgtgtccattatcggcggcatcacgttctgcaacatggcactctatacgggcatcatgggtgagttcggcgacgagtctgagcaaggcgccgtgggcatcctcttctttacggccggccccgccgttacgatgatcatcctcggtgtctcgggtctcgctaacatcccactgggcactatcgtcggttctatcctgccgctcgttatcggcatggtcctgggcaacctgttcccgttcatcaagaacctgctggttcctggcaccaatcccgcaattgccgtcatcggttttcagctcggtgcgtccatgagcctgtcgagcttcatcaccggcggcatctcgggcatcctgctgggcctcatcacgctctttatcgtcggtcctatcacctttgtctttgagcgcctgtgcggcggcaacggcaaggctgccgttgcctgctccaccatcgccggtacggccatgaccaccccggtcgctctcgccgaggtcgctccgcgctatgccgagcttgcgcctacggcgtacgcccagatcgccactgccgttatcatcacggcgatcatggccccgatcctgaccggctgggtcgacaagaagttctgccagggcaaggaggacctgtcggttgccggcgtcgaggctatcgaggaggctgttgcgaccgatatcgacggcgagtagtcgcctgttcgaatcaatgaaatcggcgtgtgcaattcacgccatccgagcgcccgtacggcatctgttattcagtgtcattcgggcgctctgctattattccctttacccctgggagtaaggggtgtttgctgtccgagtgcgtctcgggcgattttggccacttggatatagaggggatggagcctggtggttaaggcactcaagatcgagatatttatgctgtgcatgattattcttatcgggcttgccgcgcgaagtcgccgctccttgttctcgagcacccagcagctattgtttagcatgctcggctacacctctgccgcctacattttcttcgatatgatctggacgctctcggacggcatgagcactcctgtgggcattacagccaactggatttccaacgcggtctcgttttcgctgttcgccatcgcgtgcctcatttggttcttctattccgagacgatgcagggctcgcgattcctggccacgcgctacaggatggcattcgtggcattgcctacggcggtagtggtcgccctggcatttaccagctactggacacacactcttttctatatcgatgcgcaaggcgtgtatcgtcgcggtgcagcttatatgattcagcctatcgttagctactgctacgtcatatatacgtccttgcatgcctttgttcaggctcgaaaagtcgaaagcctgcaaaagaaggccatttatcgcaccctcgcctttttcgcggtccccgctctggtgggcggtacctttcaggtcgtattttcggtgcccggcctttgcgtcggcataatggtcagtattttgctgctctatatcgtctaccaggagcagctgatctcgactgacccgttgactggactcaacaaccgtaaccgttttgagacctatatgctgtcgctgttctcgggtgctgaccaggccgatgatgtgtatctgctgatgatggatgctgacggctttaagcagattaacgaccactatggacatgtcgagggcgaccatgcccttcaggttgtttcgaaggcgctcaaggacgtctgttcgatgtccggcggctttatcgcgcgctatggcggcgatgagttcgtggtgctccaaaaggcagcgacggagcatgatatcatcggcctgtgtacggcaatcaacgatgagttggcgcgtgccgaggtgccgcattcgttgcggatgtccatcggctatgcccgggtcggcgatggtgtcgatacctggcaagacctgcttcgcgccgccgatgcggagctctatcgcgtcaagggcgagaagaagaaggccggcgtccagatacgctagaaaagggggcgcacgaccgttgtgctggtcgtgcgccccttttgcgttggtgggattagtaacggctgtcgaagatacgcctcgtcttgttctcggaacggggtggcctactaggcctttttaggtttgttgacgatgatgatgccgccgcagaccaacaacagggcaacgataacggtaacggggctcgtaccggcgccctcgccgagcagcagcgcgctcagcagtacgccaaagaccggattcataaacccaaagaccgagacgcggctgacggggttgacggcaagcagacgcgaccacagcgagtaggcgaccgcagagataagcgccatatagatgatgagcgcgatggcggggacgatcgccgtgggggagagcatgccgcccatcaaaaagccgatcgcggtgaggacgaggccaccgaccaagaactgccacccggcaagcaaaacgccgtcgtgctcgcgcgagaagatgccgatcaggcaggtcgaaagggcgcctgcgacggtggaggccaggataaagccctcgccgtcgagcgtaaagccaaaggtaccatctgcgcccgaaaggttgacgagtgcgacgccggcaaagcccagcacgcagccgagcaccttggccgcatcgagcttttcggtgcgaaacgccagggcggcaaagaggatggctaggaagttggcgctggcctcgatgatggagctcgacatggcgcttgctcgggagagaccgaggtagaaaaagaagtactggccgatggtctggaagagcgacagcgtgaggataggtttgacgtcgcgagcctgcggaacgagcggacggcgctgtgccgcgctcatcccaacgatgaccaaggcgccggcaagggtgaagcgcaggcccgcgaagagcagctgcgaggcgctatcgtgtgccgggatgccaaagagcgcgtagccgatcttgatgcagggaaaagccgacccccagagtgcgcagcaaacgaggcagcccaggatgagcccgggcagggtggcgagatacggcttgcggctttccatgatgtccttcctacatgcgcgaagcaaaaaagaacccgccaccgggagtgccggtggcgggtgatgttacccgatgggattgtacccgatgggaaaggtttaggcgaagtaggctacgccgctctcaaagatgggcatgaacttatcgccggggacatgctcgggcacgttgcggtacaggttgtcgccgcgacgctcggcgtggcccatcttgcccaggacgcggccgtcggggctcgtgatgccctcgatggccagcgcggagccattggggttgacggagaggtccatgcccggcttgccgtcttcgcccacgtactgcgtggcgacctggccgttggcgatgagctgggcgagcacctcgtcgttggcgacaaagcggccctcgccgtggctgatggcgacggtgtaggggtcgtcgaggctgcactgcgacagccacggggacaggttggacgagatgcgggtgcgcaccagacggctctggtggcggccgatggtgttgaacgtcagcgtgggcgcatcgggcgtggcgtcgacgatgtcaccgtagggcaccagaccgagcttgaccagcgcctggaagccgttgcatatgcccagcatcaggccatcgcgggccttgagcaggtcgcggacggcctcggtgacctcgggggcgcggaagaacgccgtgatgaacttggctgagccgtcgggctcgtcgccgcccgagaaaccgccggggatcatgacgatctggctttggcggatgcggcgggcaagctcatgggtgctctcggcgacggcctcgggcgtgaggttattgatcacgaaggtgtcggcctcggcaccggcagcgcggaaggcacgggcgctgtcgtactcgcagttgttgccggggaaaacggggatgaccacgcgcgggcgggcgatcttggcgccaccgtacacatggatatcctttgcgcggaagtcgatggtctcgacctcggcggtctcgccggcgctgcggtaggcaaagacgccctcgatgccgctctcccaggcctcctggagctcggagagctcgatgacctcggagccggtgtcgatgacataaccctcgacggtggtacccaggggctcgacgacaacgccgtcggcgacctcgggcagctcggcgtcctcagcgagctcgacgataaagctgccgtagagcggggtgaagaggctctccacgtccacatcctcggcaagctcgataccgatctggttgccgacgcacatcttaaagaggctctcggcgccgcagccgtagccgggcgtggagacggccagggcgtcaccggtagcggtgagcgcctcgacggcgtcgaacgctgcgagcagctgctgggcgtcgggtcggtagtcctcgccgtaggtggcgggggcgatgcggacgacgcggtgcgtcaggcccttgaactcgggggagacggcgcgggccgccttgcccacggccacagcgaagctgatcagagtcggcggaacgttgagctcgccggcctcgtcctcaaacgagccgctcatggaatccttgccgccgatggcaccggcgcccaggtcgacctgggccatgagggcgccgagtactgcagccatgggcttgccccagcgctcggcctcggtgcgcaggcgctcgaagtactcctggaaggagaggtaggcgcgcttgtgctcaaagccggcggccacgagcttggcgatggactcgaccacggacaggtaggcgccagcaaactggtcggcttccatcaggtaggggttgaagccccatgccatggcgctcgccgtggtggtctcgccgtccacggggaacttggcgaccatggccgagctcggggtgagctgcgtcttgccgccaaagggcatgagcacggtcgcggcgccgatggtggagtcgaagcgctcggaaaggcccttgttggaagcgacgttgaggtcggtgacgagcgaggtcatgcgctcggcgagcgtggcgccggcccagctgggctgccacacgctacgggcgcagacgtgggcgacctggtgcttgggtgcgccgttggagttgaggaactcgcgggacaggtcgacgatggcgacaccgttccaggccatgcgcatgcgcggctcggcggtaacctcggcgataacggtcgcctcgaggttctcctcggcggcgtagcccatgaactcctcgacgtcaccgtcggcgacggcacaggccatgcgctcctgggactcggagatagcgagctcggtgccgtccaggccgtcgtacttcttggttacggtatcaaggtcgacatacaggccgtcggcaagctcgcccacggcgaccgagacgccgccggcgccaaagtcgttgcagcgcttgatcagacggcaggcatcgccgcggcggaacaggcgctgcagcttgcgctcgaccggggcgttgcccttctggacctcggcacccgaggtctcgatggactcggtgttctgggtcttggaggagccggtggcgccaccgatgccatcacggccggtgcggccgcccagcaggatgatcttgtcggtgggggcggggcactcgcgacgaacgtggtttgccggggtagcgcccacgacggcgccaacctccatgcgcttggccacgtaaccggggtgatagagttcgttgacctgaccggtggcaaggccgatctggttgccgtagctggagtagccggcggcggcagtggtcacgagcttgcgctgcggcagcttgccctcgagcgtctcggaaaccgggacggtggggtcgccggcgccggtgacgcgcatggcctggtacacatagctgcggcccgagagcgggtcgcggatggcgccgcccacgcaggtggcggcaccgccgaagggctcgatctcggtcgggtggttatgggtctcgttcttaaagaggaacagccagtcctggtcctcgccgtcgacatcgaccttcaccttgacggtgcaggcgttgatctcctcggactcgtcgacatcggtcatgacgccggtcttcttaaggtacttagcgccgatggtgcccatgtccatgagacagacgggcttggcgtcacgaccgagttcgtggcgcatctccatgtagcggtcgaaggcctgctgcactacggcgtcgtcgatcgtcacgtcgtccaggacggtgccgaaggtggtgtggcggcagtggtcggaccaataggtgtcgatcacgcggatctcggtgatggtggggtcgcgatcctcatcgcggaagtactgctggcagaaggcgatgtccgcctcgtccatggcaaggccgcgctcggaaataaaggcggcaaggccggcctcgtcgagctcgcggaaaccgtcgagtacctcgacgggctggggctcgggggtctccatgtacagcgtctcgggcaggtcgagcgaggcgatgcgcgcctcgacggggttcaccacgtagtgcttgatggcatcgatggcggcctcgtccagagcgcccgagatcatatagaccttggcggagcgcacggcggggcgctcgccctggctgatgagctgcacgcactcgctggcggagtcggcgcgctggtcaaactggccaggcaggaattcgacggcaaagacggcgccatcgcttgcggggagctcgtcgtaggtcacatcgacctggggctcgctaaagacggtcggcacgcaggagcggaaaagctcctcgtcgatgccctcgacgtcgtagcggttgatgatcctcagggcctcgatgcccttgatgccgagaatttcggtcagctcgcccttgagctgctgagcctcgacgtcgaacccgggtttcttctccacgtagatacgagagaccattggttcctgccttcctgatcggttgggcgtacggtacggtatgcggcagcggtcggtttacggggcaagcctcgcggtcgccttgagccacatgtttgtaaacctcactatgatacgacagctcgcggcgcgttgaggacggcgagggtgctacagtggggctcaaacaagagaaaggcatcacatggcattcgtttcgctcgccatcatcgcactcgtggcctttgcaagccccttcatcgcctcggcgattcccagaaagcccattcccgagacggtctttttgctcgtgctcggcgcggtgctgggaccccatatgctcggcgtcatccatgtagatgccgaggtctcgctggtgtccgagctcggtctggcctttttgttcctgctcgccggctttgagatcgatcccaagagcatcacgggcgtcgagggccgctacggcttggcgacgtgggtcgtcacgtttggtatcgcctggcttgctgtgcgctttaccccgtggttctcggtcagtcatttcgacggtatcgccgtgacgcttgccctcacttccacggcgctcggcacgctcgtacccatcatgcgcgagcgctcgctcactggcacgcgtgtgggcgactccatccttgcctatggcacgtggggagagctcggtcccgtgctcgccatgtcggtgctgctgtctgcccgcactggcatccaaacgctcgtaatccttggcttgtttgcggtggtttgcgtgttgcttgccgtggtcccgagccgctccaagcgcgtcggcagccgtttctttgcgtttgtcgaggagcgcgccgataccacgtcgcagaccttcgtgcgcctgacggtgctcatcctggtcacactcgtggcgttctcggccgtctttgatctcgacatcgtgttgggttcctttgctgctggctttgtcctgcgctatatcatccccgagggcaatcacacgctcgagaccaagctcgatggtctggcctatggctttttgattccggtgttctttaccgtgtcgggcgcaaagatcgacctgacggccgtggcgtcgcgtcccgggctgctcgtgggctttatcgtggcactgctcatcattcgcgccgtgcccattctggtctctatgagcatctgccccgagacgcgtgatgtctcggcgtatggccgcattaccgttgccctgtactgcaccacggcgctgccaatcatcgttgccgtgacgagcgtggccgtcaacgccggcgcactgtcacaggatgttgcgtcggttatggtcgccgccggcgccatcacggtgttcttgatgccgctgctcgcgcagctcttctaccgcgtggtcgatgccgcgccggttgccgccgtggcagaagttgccgagcatccttccgatgcactcgatattctgcgcgcccatcacgacctggcgagcctgctcgcgcgcgagcatgagcttttgacctctcacggtcacggccgcgcgctcgacggcgtgcctacgatcgataccattgccgatcgcctttcggccgaggcggcaagcggtcgtatcgatgcccgtatcgttgacgctgcccatctgctggccgagaagacctatggcgacgagatcgacccgtccaagctcaccccgcgcgagcgccgtcgcctggagcgcgccaagctcgccgtgcgcgaataccgccgccgcatgctggagctctacgcaagagaagaagccgaggacgacgacggcaaatagcaaggaataccgggatacagtttccgcccaaataaaagaaggcgcgctgtctgcatcgattgcaggcagcgcgccttttgcgtagggctctgttgaaggataaggccgaagcctgtgtcccttaggagcgggcggctccgtcgacggggagtacggcgcccgtgacgtaggaggacatgtcgctcgccaggtagacgaaggcgtttgcgacgtcctcgggctcgcccatgcggccgagcgggatggtggcgacgagcggcttgatgacctcgtcgggcagggcggcaaccatgtcggtcctggtcacgccgggcgcgacggcgttgacgcgaatgcccttgggggcgagctcgcgcgagagcgactggaccatgccgttgacggcgaacttggacgtggggtagccgacgccggagggctgaccatacttggcgaccatcgaggtcgtggtggtgatggtaccgccgtgaccggcctcggtcatgatcttggcggcggcgtggtggccgttaaagacggcggtcacgttgaggtccataaccttggcgaactcctcggcggtgtagttgagcagcggggtgctctgggagatgccggcgttgttgacaaccgtgtccaggccgcccatgtcggtggctgcctgggtaaaggcctcggttacggcctcgagcgaggtgaggtcgcaggagcggccccaaaccttggcctcgggataggctgcggtcagtttttcaacggcggcgtcggcggtctcctggcgagagccaaagacggtgacggcagcgccttcctcaataaaacggcaggcgatggcgtaaccgataccgcgcgtgcctccagtgatgattgctttcttaccctcgagcaacatggtgcctccattcttcgggggtgtggacatacgcagcacagcatagtggcggcccaaaacgagcacgttcgcttatcggtgaacggtacccccggttgccaatgagcggtcgagttgttcaaacgtaagccacgccgatgcgccccgagcgcgcaaacaaaagggctcccgtccaagatcggacgggagcccctcaaacaaatatgtcgtataccgaagaccggactagttggccatgacgccttcggtccaggcctcgacgtcctcaatacgcaggacgttggcgacctcggccacgcagtcgacgcctgcaagctcggcggcggcagcctggacgtccttctcgagtgcgcggtgcgtcaggaagatgaccgagcaggtgtcgctgacgcccgatttgccgtcctcgacctggttgatgagcgagatcgagatgttgtgcttggcgaagatatcgaccgtctcggacagggcgcccacgcggtcggcgaccttcaggcgcacatagtacttggtctggagctcgtccatgggcttaaaggcgaggttgtggccgtagggctcaatctcgggcagcggtgccacgccgcggctgatctgctcggacagcgacagaatgtcgcccacgacggcgctcgcggtggggaaggagcctgcgccggcaccgtagaacatggtctcacccacggcgtcgcccaccacgtagacggcgttcatggcgccattgaccttggcgagcatgtgatcggcggggatgagcgtgggatgcacacggacgtcgacgccggcatcggtgttgcgggcgatgcccagcagcttaatggtgtagccgagctcgcgggcctgggcgatgtccgcggcgccgatggtacggatgccctgctggtagacgtcgtcggtggtcacgcgggtgccaaagccgatggaggcgaggatggccgtcttgctggcggcgtcgaaaccgtcgacgtcggcggacggatcggcctcggcgtaacccttggcctgggcgtcggcgagcacgtcggcgtaatcggcgccctcggcgtccatgcgcgacaggatgtagttggtggtgccgttgaggatgccggcgatggtcaggatcttgttgcccaccaggtcgtgctcgagcgtgctgacgatggggataccgccgccgcagcttgcctcgcacttgatctgcacgccgcactcacgcgccttctcggcgagcgtctcgacatgacggccgagcaaagccttgttggcagagacgacgtgcttgccgttctcgaaggccgtggtgaagatctcggtcgcggggtgctcgccgccgatcagctcgacgacgatgtcgacggcggggtcggtgacgacgtcatgccagtcgctcgtaaaggcctcgcgctcaataccggcggcttcggcctgctcccaggcaagcgcgcaggcgcgggtcagcttaaggtcgatgccgtaggcggccaggtactcatcgtggtggctcttgatcagacgggccacgccgccaccgacggttcccagaccgatcaggccgacgttcacggtgcgcaggggttcgctcatagatagctccttcgtgcatctgtatggatgattgaccagttaaggttgagtgcattctagcgtgaaccgagagcgcgtgcttgccaggcaacaggagccgctcaaaacgctacccccgaaacgctgcggaaacattggaaacacgctcgctacaaacgaagttccgtaacaaactgtcaacgtttgaaccataaggtttgccctgtaccgcaagacggccgcaccgcggccagcgaaaagggggacaccatgttcaacatcaacagcacgctcagccgtaggaacttcctcgccggcgccgtcgcgctcggtagtaccgttgcgcttgccggttgttcgtcgggtggctcggatggcggctccgccgatggagacggcgcattcaagatcggtgtcatcggccctttgaccggtgccgcggcaacctatggtgtctcggtcgagaagggcgccaagctcgccgtaaaggatttctcgaccaaggacctcaagctctcgcttaagtccgaagacgacgtcgccgacggcgagaaggccatcaacgccttcaataccctgtgcgactggggtatgcaggcgcttgtcggccccgttaccaccggtgccgccgtcgccgtttcgggcgagattgccgacgacatgcttatggtcacgccttctgcctcgtcgcttgacgtcaccaaggacaagaccacggtcttccaggtctgcttcaccgatcccaccatgggcacgagcgctgcgaagttcttggccgagaagtacgcagacgccaagatcgccctgttctacaactccggcgatacgtatagctcgggcgttgccgatgcctttgccgagcaggccaaggagtccaagctcgatatcgtcgacaccgagacctttaaagacgactcttccacgagctttaccaaccagttgaccaaggccaaggaggccggcgccacgctcatctttgcgcccatctactacacgccggcatccgtcctgctcaagaatgcgagcgacatgggctacgacatgacgctcatgggtaccgacggcatggacggcctgctctccgtcgagggcttcgacacctcgcttgccgagggcgtgctgctcatgacgccgttctccgccgatgacgagaagaacgccgacttcgtcaaggcatacaaggaggagtacgacgagacccccaaccagtttgccgccgacgcctacgactgtgtccacgctatcgccgaggctatcgacaaggccggcatcgacacgacggccgacggtgccgacattgccaccgaccttgccaaagccatgcgtaagatcaagatcgagggcttgacgggcgagctgacgtggaacgacgagggccaggtcgagaagcccgccacggcttatgtgattcagggcggcaaatacatcgccgcctaagtgcgcatgaaacgcgaccggtgaggctgctttattcagaacaagggcgcttgtaacagaatggaaacattactttcacacaataaagtggcatagctgcataaagcgatagaaatacgcagaattatggatataaggacaaaccgaaagaaaagttgaaataatcgccacttttcccaactaaagcgtctactattttgcgaacgccgaacacggcgaaggatggcctgtcgggtaaccgaaacccgacgagaaatgagaggagagccgcatgtcgagcctcaccggtaagtcattgaaccctgttatgaatcgcaggagcgttatcgcgagcgcagcaggtctgggggcgatgtccattctagctggctgctcctccaacggcggcgatagcggttccgcttcgagcgacgcctcgtttaagatcggcaccatcggcccgctgaccggtgcaaatgcctcctatggcaagtccgttactcaggccgtcgagcttggctgcaaggatttctccaccaaggaacttccgcttgccagcaaggccgaggacgatcaggccgacggcgagaaggccgtcaacgcctttaataatcttctggactggggtatgcaggccctcgtcggcccgaccaccacgggcgcatcggttgccgttgccgccgagtgcggcaaggaccccgagacgttcatgatcaccccgtccgcgtcttccgaggacgtcaccaagggcaaggattgcgtcttccaggtttgctttaccgaccccaaccagggcgtcaacgctgccaagttcctggccgagaagtatgcggacgagaagttcgtgctcttctataactccggcgacgcatattcttcgggtattgccgatgcctttaaggcccaggccgctgagtccaagctcgagatcgttgacgaggaaacctttaaggacgactcttccacgagcttcaccaaccagctgaccaaggccaagcaggccggtgccaccatgatcttcgcgccgatctactacacgccggcgtctgtcctgctcaagaacgctaaggacatgggctacgacgtcaagatgatgggctgcgacggcatggacggcatcctgggtgtggagggcttcgacacctcccttgccgagggcctgctgctcatgaccccgttctccgccgacgacgagaagaatgccgacttcgtcaacgcctataaggacgcttatggcgatacccccgaccagtttgccgccgacgcctacgacggcgtgcacgctgtggtcgaggctctcaaggaggccggactgggtgtcgacgccgatcccaccgaggtcgccgagaagctgcccgaggccatgctcaagattaccgttgacggcctgaccggcaagctctcctggaatgacaagggccaggtccagaaggacccgacggcgtacgtcatcaccgacggcaagtacgtacaggcctaataggccgccttacatagagcggttttgatcccaagcaggggaggttttggccttccctgcttgcttggtatctagggacgatgtaacgtccctgtttcatacatcaattggaaacctattcgaaagggggatgtggaacatgacggtctttatccaatacctggtcaacggcctgtccatgggcagcgtctacgccatcatcgcgttgggctacaccatggtctacggtatcgccaagatgctgaacttcgctcacggcgacgtcatcatggtcggtgcctatgtctcgttctgcgccacgtcgtatctcggcctcccgggctgggcttctgtaattctctcttgtgcggtctgcacggttctcggtgttctcatcgagggcctggcctataagccgctgcgtcaggcgggcccgctggccgttctgatcacggccatcggcgtgtcctacttcctgcagaacgccgcccagctcctgtggggcgccacacccaagaactttacttcgctcgtcaccttcccggtgccggagttcttggccaagtacaacgtgagcgccgtctcgctcgtcaccatcgtcgcctgcctggtcattatggccggcctggtgttctttacgggcaagaccaagatgggcaaggccatgcgcgccgtgtccgaggacaaggccgccgctcagctcatgggcatcaacgtcaaccgcaccatctcgatgacgttcgccatcggctctgcccttgccgccatcgccggcgtgctgctgtgctcctactcgccggtcctgcagcccacgacgggcgccatgcccggcatcaaagccttcgacgccgccgtcttcggtggtatcggctccattcccggcgcctttgtcggtggcattctcatcggcatcatcgaggccatggcacaggcctacatttccacgagccttgccaactccattgtctttggcgttctgatcatcgtcctgctcgtcaagcctgccggcctcttgggcaagtacgtccccgagaaggtgtaggtgagcgttatgaagttccttaaagacaagcagacgcgtcacgactttgtcacgtacgccatgtgcatcgtggccttcgccatcgtgttctttatgcagtccaaccacatgatcccgcgcatgatcgccggtcagctggttcccattacggcctacatcgtcatggccatctcgcttaacctcgtcgtcggcatcgcgggcgacctgtcgctgggccacgcgggctttatgagtgtgggtgcctacacgggtatcgtcaccgcggtcgccctcgagagcgccgttccctccgatccggtgcgcctcatcatcagcattgtggtcggcgctatcgccgcagccatcttgggcttcttgattggcatcccggtccttcgcctgagcggcgactacctggccatcgtgacgcttgcctttggcgagatcatcaaagagatcgtcacctgccttatcgtaggcgtcgactcgcgtggtctgcacgtgatcttcaatatcacgggcaactccacgatcgacgacctgcacctgctcgaggacggcaccgccatcatcaagggcgcccagggtgcctcgggcgtgtcgacctattcgaccttccttgccggggccatcttggtcatggtcgcgctcgtgatcgtgctcaacctggtccgcagccgtaccggtcgtgccatcatggccgtgcgcgataacaagatcgctgccgagtccgtgggcatctccgtcacccagtaccgtatgatcgccttcgtggtttccgctgccctcgccggtgccgccggagccctcttcggcggcaacttctcgcagctctccgccaccaagttcgacttcaacacgtcgattctcatcctggtgttcgtggtcctgggtggtctgggcaacatgcgcggctccgtcatcgctgcggcgctgctcacagtgctccccgagctgctccgccagttctcggactaccgcatgctcatctacgccatcgtgctgattctggtcatgatttttaccaacaacccgcagctcaaggcgttcttcggtcgcattaaggaccgcattgctcccaagaaggaggtggcagccgatgcccagtaagtttgagttcaacaagggtaagatggttccgtatccgtctggcgccatcgttcccgaccgcgacctgggcgagcgcccggcactcgagtgcattcacctgggcattgagttcggtggccttaaggctgttgacgactttagcctgaccatcggcaagaccgagatcgccggtctcattggccccaacggtgccggtaagaccacggtcttcaacctgctcaccaaggtgtatcagcccacgcacggcaccatcctgctcgacggcgaggacacctcgggcaagtcggtctatcaggtcaaccgcatgggcatcgcccgtaccttccagaacattcgtctgttcaacaccatgacggtggaggacaacgtcaaagtcggcctgcacaaccaggagcgctactccggttttgagggtgtgctgcgcctgccgacgtattggaagcacgagaaggccgcccacgagcgcgccatggagctgctgtccatctttgacatggagcacctggcaaatgagcaggccggctcgctgccttatggcgcccagcgtcgtctggagattgtccgcgcccttgcgaccaaccccaagttgctgctgctcgacgagcctgccgccggcatgaacccgtccgagaccgcggagctcatggagaacatcgtcaagatccgcgacaccttcggcatcgccatcatgctcatcgagcacgacatgtcgctcgtcatgaacatctgcgagggcatctgcgtgcttaactttggtaaggtcatcgccaagggcacggccgaggaaatccagaacaacgatgccgttatcgaggcgtatctgggcaagcaggataagggggagaactaaatggcagagccgatgctttccgtctacaacatcaacgtctggtacggcgccatccacgccatcaaggacatctcctttaacgtcaacgagggtgagatcgtggccctgatcggcgccaacggtgccggcaagtccacgacgcttaagactgtctcgggcctgctgcgctccaagaccggctccatcaagtttatgggcgaggacattacccatacgcccgccgacaagctggtgggcaagggtctggctcaggttcccgagggacgtcgcgcctttttgcagatgacggtcgaggagaacctggagatgggcgcttacacgcagcccaagtccacggtagccccgggtcttgagcgcgtctacgagcagttcccgcgccttaaggagcgccgtcgtcaggtcgccggcaccctttcgggcggcgagcagcagatgctcgttatgggccgcgcccttatgagcaaccccaagctgctcatgctcgacgagccctccatgggcctggcgccgattctgatcgagcagatcttccagatcgtcgaggacctgcacaaggccggcaccacggtgcttctggtcgagcagaacgcgcagatggcgctttccatcgccacgcgcggctacgtgctcgagaccggcaagatcaccatgaccggcaccggccaggagctcctgcatgacgacaacgtccgcaaggcctatctgggcggttaatccattcaacaaagggggcgctgactatcccggtcagcgccccctttttaagttgcggtgaaatagggactaattgggggttcaagaagccaaaacagtccctattccaccgcaacttcatgggggcgtgcgacaatgcccgtcggaaaacacttgctgcctttgggggtctatctatgctgtacgagttttgtgccgagaactttgagcgggtgccggcggctatcgaggccggtgcggggcgcattgagctgtgcgacaacctcgccgtcggtggcaccacgccttccgccggcgttatcagcgctacggtcaacaatgctcacgagcatgatgcgcaggtgatgtgcatgattcgcccgcgtggtggcgactttcattacagccaggacgagctgcgcatgatggagatggatctgggccttgccgtgagtgccggcgttgacggcctggtctttggatgctgcaagccctgtgccggcggctgggcgctcgacgagctcaccctcggcgccctcgtgatggctgcgggctgtgcggcagaggagtgcaagcgtgagctcatcgacatcaccttccacatggcatttgaccagctctcacccgaggctcagctcgatgcaattgacacgcttgccgactgcggcgttacgcgcatcttgacgcacggcggagcggccggcacgccgattgagggtaatttcgatcatctggctcgcttgatcgagtatgcgggtgatcgcttgaccatccttcccggtggtggcatcaccgcggccaaccgcgatgcggtcgcggcggcgctgggcgtgtccgagctccatggcaccagaatcgtgccgctggaggcgtagcccgtggcgctcgtatttgatgtccagcaggcgagcggcaagcccgacgacaaccgccgcccgggcaccgcgtgccccttctgcgatacggagggacttgccaacatcatccagcgcgatggtgattgcatctggctcgagaataagttcaagaccttgcgggccactcgtcagaccgtgttgatcgagtcggccgatcacgatgccgacctggtgacctatgcggcggacgagctgcatcatgtaatgcggtttgccctgggctgttggcagcagatgatcgaatcccagcagtaccgcagcgtgctcatgtacaagaacaagggcccgctttcgggcggaagcctggtacacccgcacatgcagattgtgggcctggagcaagaggacggctacgcggcgctgacctcggccaactttgcaggcatcaatgtctggcagcaggggagaatctcggtcagcatctcaaccgagccgatcatgggattctttgaggtcaacgtttcagccccgcagggaatcaccgccagcgatgacgcgcgagaccaagccgaagcggacctgtttgtcgatgcgattcaggtggccctgcgctatatcctgcacgagcatcacggcggtcgcgcggagtcgtacaacttgttcttctaccacatggacggccggaccattgccaaggcgctgccacgttgggtggtatcgccctactttgtgggctatcgtctggcccaggtcaatgccgagaccacgctcgatatcgatgctgagcgcctacgcgcacatctggaaacgctcgcatagcaaggcgaacgcctgcgaaaagcgtgctgcctagcgtgccatcgcgtcgcggccggcttcgacccgcttgcgctgtttggcgcgctcctcgccggttaggcgctcaaagagatgcccgataatcgaggcgagtatctgctgaaacagcgttccgcacatgacgggaaacacgacttcgcctggaaagtactgcgtggcgatgacggcacccgaagagatgttgcgcatgccgcaggtaaagcacatggtggtcgtctcgctatacggcaggtgcagggcgcgggcgaccaagataccgatgataaagccgctgatggcgaataccaaaataaagagggcgactcccaagcgctcggcgttcatatgcagcacgtactcgctcatggcggtggagttggatgcgatgacgcccatcatcatgaacttgcaggcgggcgagagcgcgggggagagcttctcgtgaccccaaccgcgcgtgagttcgttgatgacgataccgagcacggcggggatggcgatcataaaggccatgttctgcatcatgctcggcacgtcgatcgagacggtagcgcccagcaggagcttgagcgtaagcggaatcgtcacgggtgagatgactgaggacgtcaggataatggtgagtgcgagcgggccgttgccaccgaacatgctgatccacataaaagcggtgacggctacgggcacgctgtattcgagcacgatgccgcagacaaggttggggttggagccaaagaacagtgagcccatggcatacgccgcgatggggatgatcacagccgagacaaataacgccaaaatcagatgcaggggacggcggaacacctcagctacctggtgaaaggtgttgctgagcgcaccttggaacgtcataaaggcaaatagggcgggaacgatgggcttaagtacgccgatctgctggggaaagagcacaccgagcgccacgcaaatcggaacgatgacctgcatgtgccccgcgagaaacttgcccagtccaacccattgcttcatatgctcttgtgactccctttgctcgtgaatccgttttgaatggatatgctagacgctcgcatgcgtccgtgcgccagaaacgctcgattatttcgaggctattaccggcatcgtttaccgaaaccgcggcgagctgcggcgatttgcgtccgcgctgcacggtataataaatccgttcaacagatctgcctgccgaagcgggcatacacagaggactcatcgctatgaaccgtgagaggtatcgcggcgacctgcccttatcgggggtgggcgcctatgtcatcgcttaagacgacgcatcgctgggcggtcgctcagcaaaaccccgagctcgaaaaggagctttcggctggcctgggcatacccgggctggtggcgcgcattatggttgcgcacggcattacatccatcgaggaaggtcagctgtttttgacgccttcgctcgatcgcgattgggccgacccactcattatcccgggcatgtcggtcgttgccgaccgcgttgagcgtgctattcgcaaccacgagcatatcgcggtctttggcgattttgacgttgacggtattacgtcgacctgcctgttgaccgaggcgctgctcacgtttggcgccgatgtcacaccgtttattccgcatcgatttgacgagggttatggcctatcgcgtgcggcgctcgaccgcgttaacgagctcgctcgcccccagctgatcgtgaccgtcgataacggcattgccgccaaggaagaggtctcctatctggagagcctggggatcgatttggtggtcacggaccatcacgagccctcagatcaggtgccgcagggcgtacccctgaccgaccccaagctcgaggacgagggtccctcgcgcgagctcgccggtgccggcgtggcgctcaagctggtgcaagtcctgggcgagcgtctgggcaagccgtcgtattggcgttcgctgattgaggttgcggcgctgggtaccgtgtccgacatgatgccgttgacgcccgagaaccgcgcgctggtcgccgagggcatccagcagatgcgcgtgacggcccgccccggctatatcgcgctggccgcgctcgccaaggccgacctttctaccattacggccgatggcctgtcattttcgctcattcctcgtttgaatgccgccgggcgcatggccgatcccaagctggcactcgacctgctgcttgcccacgatcctatcgaggcaagcgcgcttgccgccgagctcgaggaaatcaatcgccaacgccgcgagatcgaggcggagctcacacgcgatgccatggcaaaggtcgaggagacctatgatggcggtcgcgcaatcgtcgtgggtggcgagggctggcacgagggcgtcaagggtatcgtggcgagccgcctgaccaaccgttaccacgtgccggcgctgctgttctcgatcgaagacggtatcgcgcgcggttcgggtcgctcggtgggcaaggtcaacctgttcgacgccgtagaacgctgctccgatctgctgattcgtcgcggcgggcatgcgggtgcggtgggcgtgaccatcgaggcgtccaagctcgacgagtttcgtcgtcgtctttccgccgtgctgtccgagcttcccgccgaggactttgaggacaccgacgaggttgctgccaccgtcgacctctccgagctgaatattgagaccatcgagcagatttcccgccttgagccgtttggccagggcaacaaggtgccgctgctggctgccgagggcgtgacgatgtgtgatcgcgccgtggtgggcaaaaccggcgagcacatgcgctttgtggcgacggatggtgccgcgagcgtgccggccatcatgttccgcgtaccgcagatcgataagctcatcaattgcgatagtgcggtcgacttggtgttcgaggccgtggccgagcattggcagggccgagtaaaacccaagctcatgatcaaggatgttctggtccgcgacaccacggcgccgagcgttgacgacccggcatgcgagctccgccgtggcgtacagccggcggattctggcctgcgcctggagtcccgcaagcgccagacgctcgcccagctttcctataccgagctcacgcgctcgcttatccacagctttatcggctcgaaccagccgcatcgcgcgcaggtcgaggcgctcgaagccctagccgatcaccaaagtgttctggccgttatgggaacggggcgcggcaagtccctcatcttccatgtgcatgccgcacgcgaggcggttcttcgcgggcgtgcgagcatctttgtctatccgctgcgtgcgctcgtggccgaccaggcctatcacctctcgtcgacgatggccgcgctcggcattggcgtcggtgtgctgactggcgagaccgtggaggccgcgcgcgatgacgtgtttgccggcttggcttcgggccgcaccggcatcgtgctcacgacgcccgagttcctgtccattcaccgcgaccgctttgcgcgttccgggcgcatcggatttgtcgttatcgatgaagcgcaccatgccggtcttgccaagggcggcgaccgcagtgcctatctcgacatgcccgatatcctcaaggccctgggtgacccggtcgttctggccgcgacggccaccgcgacggctcctgtcgtggccgagctcgcacgcgtgctgccgatcactcgcacggtggtcgacgagacggtgcgcgagaacctgcagctcgaggacgatcgcgatctcgcgagccgcgagaaccgcctggtgtccattgtggcgacgggggagaagaccgtcatctacgtcaactcgcgcgaccaatccgtggcgcttgccaagacgctgcgcaagcgcgtgcccgattgcgcgacccgcatcgcgttctataacgcggggctcgcgcgctccgatcgccgccgtgtggaggaggcgttccgagacggaagcctcagttgcatcgtttcgacttctgcctttggcgagggcgtaaacctgcccgatatccgccatgtcgtgctttaccacatgccgtttggcgccatcgagttcaaccagatgagcgggcgcgccggtcgcgacggacagcccgccgtgatccatctgctctattcgtcgcgcgacgcccgcattaacgagcgcctgctcgattgctacgctcccgagcgcgacgagctcgtcacgctctatcgcgcactgcagactatgtggcgctccaaccgcggcaagaccggggacgactcgtttagcgcgagcgatatcgacatcgcgcagatgtgcctcgccatcgatgcccgcacgccggttgacgagcgctcggttgcaagcggtctgggaatcttcgaagagcttggtttctgtcgcgtttcggggtttgacgacacgcgccgcatcgcgatggccgaaaaccccggccgtgtgcaattgagcaggtcaattcgctatttggagggcctgcgctctcgcatggagttctcggctttccggagctgggcgctcgattcgtgcgcttctgatatgctagccaaagttaaccgcccgatcgtaccgcgggcctaggggaaggggacctcgatggatgccgcagcccgtaccgcccatgattccaccctccagccgttctcggagatggagcactataagcatgccgatgagctgccgcccgagattatggcggacagctacgacaagctggagcgcctgtgcctcaaatatatgaatgaggacgacttctctaaggtagagcaggcatactgctttgccgccgagaagcattgcaaccaaaagcgccgctcgggcgagatgtacatcaaccatcccgtcgaggtggctatcatcctggccgacctcaagatggactgcgacgtggtgtgcgccgcgctgctgcacgataccgtcgaggataccgagacctcgcttgccgatgtctcgggcctgtttggcgatacggtggccgagcttgtcgacggcgtgaccaagctcaccaacatcgaagtcgacagcatggacgagaagcaggcgcttacgctgcgcaagatgttcctcgccatgtccaaggacatccgcgtcatcatcgtcaagcttgccgaccgcctgcacaacatgcgtacgctggcggcgcttcgcgaggaccgtcgcctgtttaaggcacgtgagaccatggacgtgtatgcgcccctggccgaccgcctgggcatgagttccattaagtgggagctcgaggacctgtccttcttctatctggagcccgacgcctaccagcgcatcgcgcgcatggtggcggagtcgcgcgaggttcgcgagcgctatctggccgagaccatcaagacgctcaccgacgagctcaaccgcattggcctggaaggtttccagatcaacggccgttccaagcactattggtccatctatcaaaagatgaagcgcaaaggcaaggagttctccgagatctatgatttggtggcgctgcgcgtcattacccattcggtgcgcgattgctactctacgctcggcgcggtgcacacgctgtggcaccccatgcccggccgctttaaagactatatcgccatgcccaaggtcaataactaccagtcgctccatacgacggttatcggccccacggcccgcccgctcgagattcagattcgaacctacgagatgcatgagcaggcagagtacggcattgccgcccactggctgtataagaagtcgggtggatcgtctgcctccaagaccaacgacgcccagcgcctggacgaccaaatcaactggctcaagcactcgctcgattgggccgcctccgacgagatcaccgatgccaaggagtacctgcattcgctgaaggtcgacctgttcgaccaggagatttttgtctttacgcccaagggcgaagtcatggcgcttcgtgccggctccaccccgctcgactttgcctatgccgtccacaccgaggtcggcaaccactgcgtgggcgccaagatcaacggtgcggtggcgccgctcacgcacgagataaagacgggcgaccgcgtcgagatcctaaccaacaagagctccaagccgtcgcgcgactggctcaagatcgtcaagacgccttcggccaagtccaagatccgtcgctactttgccgccgcgaccaaggatgacgacgctgccgccggtcgcgacatgctggcaaaggacctgcgcaagcgcggatacggcatttccacgccgcgctcgacgcgcgcgctcaatgccgtggcggagcagctgaactttaagcagctcgaggacctgtttgcggccgtcggtgccggtaaggtcgccccacgtgccgtgggcaacaaggtcgagcagattttggaccccaagcccgaggagcagctcaccaaggctgaggctatcgccgaggtcgtgaaacagcccgcccgcggctccaaccgcaagccgcaaaagcgcggcaagagcgcgagcaacggcatcatcgtcaagggcgagagcaacagcggcctgttggtgcgcctagcgcattgctgcaatcccgtgacgggcgacgatatcgtcggcttcatcacgcgcggtcgcggcgtctcggtgcaccgtgccaactgccccaacgtcaagggccttatggagcaccccgagcgcatgattgacgtggagtgggatggcgccgccgacaccctcttccaggtcgagatcgtggtcgagtgcctggaccgtatgggtctgctcaaggatgtcaccatcgccatcggcgatgcgggcggcaacatcctttcggctgccacgtcgaccaaccgcgaaggcatcgcaacgctgcgctttatggtcgagatttcggacgcgagcggcctggatccgcttctggcctctatcagcagcgtcgactcggtctacgacgctcgccgtcttatgcccggcgagggcggcgcgcaactcaagcgccgcgtttagtcgcgacgaacgtgccacattatcgatattcgctacactcgaggcatcgtttgatgcctcgagttctatagagaggagagggacatgagtgctgtgtccttggatttaactcccaagggatcggtcgagatcgagacgcttgtaaacggccccattcagaccaatagctatgctgttatctcggacaatgagtgcatgattatcgatcccgcatgggaaggcgagcgcttggtggagcatattcgagctgagcatcccggcgtacgcgtgcttagctccgtatgcactcatggccatgctgatcacgttggtggtgttgccggcgtgcgaaccaccgttggcgagagctgccagtatgagctgtgtgctaaggacgtggcggtgccgcatgcgaacatcgaggaacagcgaacaatgtggggcattgagacgcccgaccccggggagccgacgcgtctgctcgctgagggcgatacgattggagtgggcgacatctgcctgcaggtgatcgagacgccggggcatacgccgggcggcatcgtcctgttcgccgccaccgagcaggggaacatcgcttttgtgggtgacacacttttcccaggcagccatggccgcaccgatctttccggcggtgacgaggcatcgattatgcgctcgctcgccaaacttgccagggttcttccacccgataccgtttgtctgacgggtcatggcgattcgaccaccgttgcgcgcgagctcatgcagaacccgtttatgcagatgtagcttcggagctgactttcgaatcacgaagaccgctcaatcgtcaagttattttccccaacgggtcgattctgtggggcaaacggtcaaaaaatgtccgatcagacgatattcgtgaacaaacgaacgttaatgctccggtatgccgtggtaaaatcacaggcgttatcggagcaaccttacaggaggtttcttttatgctcgtcaacgcagcagacatgctcaagaaggccgaggccggcaagtacggtctcggtgccttcaacaccaacaacctcgagtggaccctggctattctccaggccgccgaggaggccaagtctccgctgatccttcagtgcaccgccggtgccgctaagtggatgggcggtttcaaggtctgcgccgacatggtcaaggctgccgtcgaggccacgggtgttaccgttcccgtcgcccttcacctcgatcacggttcttacgaggactgcttcaagtgcatcgaggccggcttcacgtccatcatgtatgatggctctcacgaggagaccttccagcttaacctcgaccgcaccaaggagctcgttgagcttgcccactccaagggcatgtccatcgaggccgaggtcggcggcattggcggcaccgaggacggcgtgacctccagcggcgagctcgctgatcctgctgagtgcaagcagatcgctgacctgggcgtcgacttcctcgcctgcggcatcggcaacatccacggcgtgtatcccgccgactgggctggcctttccttcgagcgtctgggcgagatcaaggctcagaccggcgacctgcccctcgttctgcacggtggcaccggcatccccgaggatcagatcaagaaggccatttccctgggcatctccaagatcaacgtcaacaccgacctgcagctcgtcttcgccaagggcgtccgcgagtacatcgaggctggcaaggatcagcagggcaagggctttgacccccgcaagctcctcaagcctggtcgcgacaacatcgttgcccgcaccaaggagctcatggaggagtttggctccgtcaacaaggcgtaagtagcggtttaactttcccgccggaggccccgttcaccctacgcttttcccttgcgctcacctggctttgccagaagtcgcgcaatgggaaaagctccgggggacggggcttccttcgttttccgccgcagggttacggggctgagataatttaattgctaccgtttatcggtgttgggggctccttggttggggctttgtttttatctcggtacaatgggtttggtttgtcgttcggcgtgggagtggttatggctgttgttgatgtgttgccttcggatgggaaggttgttgccaagggtcctgttggttgctctgttgatgtttgttgtgatgattttcgtcatcttgatattggattgccacctgagattcttcgtcttaaggatgctgggtatttgacgcaggctgttgcggcttgcgatcgtcttttggagcagaatcctgagccttcgctggctgcttgtgttcgtgccgagcggtatcgcatgcttgagacaccgctgcacttctccgtttctcgtgatcgggctatcgcaatgattcgcgaggagtggcctgagtttgctgaggaacagtttgacgatctgatcgaccataagcgtattgactggcgctttatcgatggcgagctgtttgttcttgataacttcctcgattcgcttcgcgtgtatcccaaggaggttccgggcttgcgtcccgatcctacggacggcatagcgctgcgcaaccagatgctcaaggagatggagtcgcaaaacgggttgactcgcgtcatcacgcttaaggcgtccgtatctgtccctggggctttggagggggagaccgttcgcgcgtggcttcccgttgccgccgcctgccgtcagcagtctcaggttgagattctcgatatgacgccggagggcgctgttgcccctgaagacgtttcggttcgtactgcctcgtggacatcttcgactgagcgttcgttctcggtgacctatcgctatcgcatcgatgtcgcctattgcgatgtctatggcggtgcgcttccgtcgcatccgtgcatggacacgccgctgcccgaggacacttccgaggaccgtccgcatattgcgtttacaccgtacctccagcagttgacggagcgtgtcattgacgggctcgaggatccgctcgatcgtgtccgtgccatctatgattatctgacgcagcatatcgactatcgctatcagccgccgtacttacttttgggctctattgccgatgactgcgcacattcgctccgcggcgattgcggcgttatggcgcttacgtttatcaccatgtgtcgcattgccggcgtgccttcccgttggcagagtggcctgtatgttgcacccgattcggtgggaccgcacgattgggcggagttctatacgccgcagaccggttggctcaacgccgatgtatcatttggctcctcggcgcgcaggatgggggaggagtggcgtcgtcgtcactactttggcaacctcgatccatggcgcacggtggcaaacaatcggttccaggccgagtttgagccggttttcgacggcatgcgcgaggacccctacgacaatcagatgggcgaggcctcagtcgacggtcgcggatgccgtcagcgtgagatgctccgtacggtcgaactcgtcgaaatgctcgaagttccattttcggactaatcgatagcaagctgtgataaactaactcacgcattacgtgcccgagtggcggaattggcagacgcagtggactcaaaatccaccgttggcaacaacgtgcgagttcgagtctcgcctcgggcaccatacatgcaggtgagcgttcaagggggtctaggccccctttttcgtgccgaactcgcgtgagcgcgcggagcgttaagcaaacaggcctgtggcctgtttgtagcggagcgtggcgagggcgccgtgcgcccgaagcccggggcttcgcgaagcgaaggcccttcgagtctcgcctcgggcaccatacatgcacctgcgcttcaagggggtcaaggccctcttttcgtgtacgtaatgtgataacgcgtcgaacgtgttattatcgccaaggcgttgttcccgcaatgccctaaagaggaacccgagggttcccaccttttggcgccaatgagcagctgactggtcatacaacttagattcccttcctcatatcgaggatatctatgtgtacgacctggttgctgagaagcgccgggttatttttttatgaatggaggtagggaaaatagctaagtctgatgacacccgcatcaacgacgagatcactgcatcttcgtgccgtttgattggcgtcgatggctctcagctcggcctgttcgccatccgcgatgcccagcgcgtcgctgacgatcagggtctcgacctggtcgagatcgctcccaacgcggagccgccggtctgcaaggtcatggactacggtaagttcaagtaccagcaggccatgaaggccaaggctgctcgtaagaaccagtccaaggtcgaggttaaggaaatgaagttccgacccaagatcgacgttggtgactacgagaccaagaagggccacgttctgcgtttcctcaagaagggcgcacgcgttaagatcaccatcatgttccgcggccgtgagatggctcacccggagcagggccttaacgttctcgagcgtctcgccgaggatctcaagccttacgctacggtcgagtccaagcctaagatggaaggccgtaacatgcttatgctgctcgccccgattaagggcgccttcgatgaggataaagcggcaagcgatactaagtaactagtgttctgtaaccgattaaggagtatttcatgcctaagatgaagtcccacagcggcaccaagaagcgtttccgcaagactggtaccggcaagcttatgcgcgccaaggctttcaagagccacatcctgagcaagaagtccaccaagcgtaagcgtggcttccgtcaggagaccgagatcgccgctgccgaccgcaaggtcatcaagtcgcgtctcgcctaagttcgcgttcccgtttttcgttttaccgtctaggagttgatagaacatggcacgtattaagcgcgctgttgccgccaagaagaagcgccgtaccgttatgcaccgtgcgaagggttactacggtgccgcttcgcgtacttacaagcatgctaaagagcaggtccagcactccctgcagtatcagtatcgtgatcgccgcaacaagaagcgcgagatccgttctctctggatcacccgcatcaacgctgctgctcgcctgaacgacatctcttactctcagttcatgcacggcctgaaggttgccggcatcgagctcgaccgtaaggttctggctcagatggcttacgaggacatcgagtccttcaacgagctggccaccatcgccaagaaggctctcgaggcctaatagattctcttgaatcgctaggggagtgtcgcgttgtacgcgacgctccctctttttgtctaaagcgctggtatatatagctaaaagcgcgggtagatagacatttacaggtgaccgatctttatatacctcttaaccgaagggtcatcatctgatacgtgcggtcttgctgcacccgactttctattacctatatagaaagcgatagattgtgtaggacttgtgaagagtggaattgacgtcccgcatggcttcgcggtctggcaatatatctccttgccgcgcggcccggtggaaccggatggaccgcggggcgtgcaccttgagaaccggatactgcgaggatggacactgattcagtgtcgcatccgggcagacatcgaaccatttgaaatggtctaacttggatcctatttggaatccgaatcgtccatggagccgtcgatgccggttttggtgtcgtccgtattggaatcgtcatcctcggggcttataggacacattttgtcctataagccccgatcaattcatactcctcatcctcgccgaattgcgagtatggcagaatcggcactggatggcagcgcgctaggccgtgtccgcggagttagccccttgttttatcgtaacagctgattctagggacgtttcactgtgccccttttggcaatttcctgtgccctttttggaaactcgagcgcctatctgaccgatgggaaagatttagcgaatttaggtgtaccactttgtgttagtttgtattttagacagtatttgtgatacgctttgtttcaatcagtagtggtacgatttcgcttgttcaacgaaggaggtaattgtctatggcagtggccgaggagaagaaaagaatccaggttactctgcctctcgaaatttggcgtgatctcgatgactacgcgaagagccgcggtgtagctaagtcgtctatggcggcgatcgctatcgccgagtttttggagcgtgttaaagagcaaaaatagatatgaaaaaagccccctaccgccaagtaagaagggctttttccatgttcaaatgtggctttctggcctgttacctgcaatcctagcacacgtatgcttcgatttgggtccctatgttgaagtactaccaaaatactatggcatcacttcgactgatggctagatagcctcaatgagaggctagtttatggataccagaaatttaaaaccggacgcgggcggtggctatccgtgggacacggatagccacccgtccggccccgcaagcccgtctggaatgggggcggcgtccgatttcgcgaatcaggccgtcacagatgccgccatgcccaatagtgagagtcaccgcgaagcacttcgccgggcatcggatgaatcgtcccgtgtcgcccacatggtgcaggatatggtcagcgagaaggtcgcgatcatcaagccgccgtggatgctcgagctcggtttgcctagacttgacaccgatatcatggggcggatttggtcgttccagcgcaaggacgtttacaaatccacctgctacatcagccttgccaccatggcggcggacgtcaactcggatcggtcgaacgtcaagaagagaatcgataagctcgtcgaactcggtcttttgattaagtcgccgcgtggtaataacaaatctgttgagtaccggctcgatatgacggcgatcgctaagcgcaggctcgaagtcgaggagggtaggaaaaagcaacgcgccgagaattcggcgaaacgcaaagctcagtgggacgcaaagcattctgcctagtttgaagggctatgggttgtatgaacccatagccctatttctttttcttacaaactatgggttgaaagaacctacagtatagctatgggttgttttaacccatagcctggcgaaaaatcattttattgatagggggttaaataacggttcttcagcaagactattggttaggacaacccatagtcttgctgacagagatcgcggacgcttttccgtgacggtatagctatgggttgaaagaacccatagacaatttaagccacttttctagctatgggttaatccaacccatagaaagcgatcgaaaaatgccaaaaagtaccggaatagttatttcaacccatagtttgagcctgtgttagccggggccaacttatcaactatgggttgtctcacgagactatgggttgaaataacccatgccaactatgggttcagttaacccatgcactatgggttgaaataaccacaactatgggttgaaataaccacaactatgggttcatacaacccaccaagtctgactagagtgaataagattcacttagtctgaactcaagggagaaacggagaaatctaccagaaagcatttaatgatcgaaagatatacaaacaaggagatccttcgtccttgccctccgttcggctacgcctcactccgcgtcgcctgtggctccttggcgctcgctacgctcgcactccggtcgccttcggctccctgcgcgtcggctgtgcctccttgccctccgcgcgcttgcgcacgctccgcgtcgcctgcggctccttggcatggccttcggccaaaagtgtgggggctccgccccaactccccacccacgttctcgccaatccccggcgccggcgtcgccttcggctccccgggcgacctatcgcactcagtcgcagcccgtccaattcggcaatgagtgccgaatccgatttccggtcaatcgggataccggtattcagtcaaccttgcacagaataccgctagaaggtcacagaattgaaaataggacgacttattggtggggtttacccgttttctcattgctatataaaacgaggtcttaaatcggctctcagtggcctaaaaagagacaggagcacctttcgatacccctgtcctgatcctcttgggcttccattttgtcacaacgttaagaacgtcacgccgccctcttcgttaaaacccgttttcggcaaggtactcgtcgaacagctcacgtgcgatgtcggaaacggacttgtcctcctcgagtgcggcctgcttcaagcgcttgcgatggctctcgggaacgtagacagacagctgtacaagcctctcagatgccccttcagcgccttttttggggcgcccggctttccgtacctgcggagccggtttctgggactcagatgcgctctcaacgattttctgctgcctctcctcggccttctccgcggcgacgtcgaagtaggaggtcgatttcttgaactttccggccattacaggacctcctcgatctcgtccaggatgttttcgattgccagggctgccttgccgctcttcgcgatttcgtacacgggcttgcccagggccgcgccctgcttgaaggccgctgcggtcggaacggtgcccagcacgggcaagtcatcggcttcgagtagttcgaggaactggcggtcgaccgtctggtttgccgcgaagttgttgacgatgattgcgaaggacaaatcgggattggcctcggtgatgaccttgatcgtgcgtttcatcggctttaggccgagggtgcctggctggaccgggatgatcgcgatgtcggcgtttttcgcgtacgtggccgtctcgtcactcaggaaacccggcgtgtcgatgacgtttacggcgttctcgtcgtcgagcaggttcttctcgtggttcgcgccgccctgagggtcgagattgccgaatccgactttgtggccgcggcgctcgagaccccaggcgatctcgtcggcgaacgtcgtcttgccgacgccgcccttctgattgactagcaggatgttcgtcgccatgtcctcccctttctgaaatagcatagtcatatattatcacattaacatgtgactacattaagtgattctaagttgcaggtagaaatatatgagcatgttaagtaattagtatagtactacgctaccgtgctcatgactgtgggttggtttaacctatagtcatgctaaagttgccaaaaggggcacaaaggccaatacgtttgcgcagtgccggaacagcgacctagcatcatatgcaccggcggaatcatcgcaggcctgcaaggagagcatatccatgggctcgtagtcgccggaggcctcgtgatgcagcacgcgccgggcggcgactggaagcgcgtcgattgtgatgcacttgctgcctggctcgacagatacggttacaaggtcgctgattgcgagacggagacccttccgaccgccgacgcggcgaggcggttacgcgagtgggaacgcaaaggtaaaaacgcatcgtcgctgaaccagtgagtcagtattctttagtgttagatgatggatattgaaattaattagcgagataatgtgcatatctcataatgtatgcgtttcaccatgagagaggggtctgtcatgagctggaaaccgagaaaatgcgttattgccggtctcgtgacaaccggtcctggcagcggcttgtttgcaaccgcaatgacatcgtaccgacttttcacttacatgttctaaaaggcagttgccatgctgtcgcaaaatcaatcgagatacttggtcacaatcggctttgccctgcttgcattactctttgctagcgaccttttgctgaaacggaaagcacattaagtgctttcctttgcgtgcggaactcgcgacaaacttaacccgcgccagccggccccggagaccctccctgccgtcactttgttcgagctgttgttgttgctcgccgcttcgcggctcggggtccccgttctccgcggcggggttgtctaaggttcttgttggacttcggcctttggctgaaaaagaaacgggggacgcgctgtgcatcccccgtttttgttgcggttactccaagtcaataaatttggtgctcagaatcttgccgtcttttacgagcattctggccatggtgggtcctcggctgcctctggggtagctggcgctgcccgggttgaggactaagcaatggcccacttgggcttctttggttacgtgggtgtggccgttgatggctacgtctacggatcccaccggaaggtcttcgcggtagtgggctacggcgaatttgaggccttcgtaggtaaagagcgcaagacggtctacgtcggggccgtagtcgcggtagtaatcgttgttgcccaatacggcccgcacgggggcgatggtgcacaggtgctcgtagtccatctctgacgtgaggtcgccggcgtggatgatcaggtctgcgcccttaagctcgtccaggagcgcaggcgatagatagccgtgggtgtccgagatgatgtcgatgcgtttggcgcttgcgctgttcatgggatcccttccgcaaaaacgattcggcaggtgcatacaaaaagccccacggctccgcagacgataggtctacagggctgcggggccaatgtgcttagaggctcaaggccttcttgagcgggacgacgcggcggcgcgagaccggcacgcgttcgtcaacgcccgtgatgcccagctggatggcgcccgaaggcaccgtctcgacgtccgtgacgcacgctaggttaacgatatagcggcgatgcacgcggaagaagccaaagtcgcagagcttggcctcaaactgtgcaagcgaggtcgtcgacagaaaacgatcatcgacggtatagatgcaggaatagtcgtccttggccatgataaagcgaatgtcgtccacgggaatgagcaccttgcggccgcccttttccaccgggatgcgctcgatggtcaccttgctgtccgtgacgggcttggcacgctgcatgaccttctcgatggcgcggtccaagcgagcttcctcgacaggcttcatcagatagtcgacggcatccacatcgaacgcctcgaccgcatggtcgctataagcggtcacgaaaacgatcgccggcgggttcttgagtttatgcagtgcctcggcaagctgcaagcccgaagcaccgggcatcgagatgtcgagaaagacgacatcgacgcgactttccataagcatctcgatagcggagcgaacgctcgacgcctccgtgatcgtgccgatcttgcccgtctgctcgagcaagaagcgaagctccgaacgagccggcgcctcatcatccacaatcattgcacgcagcatagggataaaacctttcgtcaacatacttcgctgggcatccgccaaccgacgttaaacccgtaaccaattattttactcttgaatgtcaaagatactctctgacaaatcaagatgcaggagcactttggtgcccttgcccggcgccgattcaacgcgcgtataggagtgcggaccatagaagcgatggatgcgctccgaaatattgtgcatggccacgccggcgccgccgccctggggagagctggcatcgggacgggcagagcgctcgtcaaacagcctggcagcggtaccctggtccatgcccacgccgttatcggccaccgaaatcagaatcgcatcctcgccgtcctggtgcaccgacacatcgatcaccagcgcatcggcgtctcccataccgtggcgcacggcgttctcgacaatcggctgaatcacaaatgccggcaccagcgtgtcctcgacgtcctcggagacatcgaaggtcgccagcacgcggtcctcgccaaagcgcgccttctcaaaggtaaggtagcgcttggtctgtgcaacctcgcgcgaaaccggaatgagcgatcccgagttgtcgagcgtggcgcggtaaaacgacgagaactcgcgcagcagctcgcgggcgcgcagcggatcggtgcgcgtaaacgatgcgatggtgttgagcgtgttgaacaggaagtgcggattgatctgcgcctgcagcgcacgcacctcggcgcgggctgtaagctccttttgcacctcgagctcgtggatggcgagctgcgtggacaggatctcggcaaagcccgaggcaagcgcgtactgggtacggtcgacggcgcgcggggtcttgtagtagaacttgagcgtaccgacggtacggtcgcccaccttgatgggcgcgatgatacccgccgggacttggttgtgtgaaccgtccgagcccacgacgtccacgacgcgattgaacgactgcacgataccgtgctcgatgacgtagcgcgtggcaagcgtatggatgggtgaatcgggcagcagcttttcctcaaactcgcccgcgcatgccagcacgttgtcctcgtcggtaatggcgacggtcatggcgcgcgtctcgggcaagatgcgctggcacaccaaacgcgccgactcctgcgtcaggccgcccttaatgtcctcgagcatagcagaggccaccgagagcgtctcctcggtatattgcgagcgcaccgaatcggggttgagtgtcaaaaagataaagatgcacagcagcgcgcaggcgacaaccgtcgcaatgggctcgataccggtcgccagggcaaagacaaagtacaccagcacgcagatggcgcaggcgacggcgatgatacgaaagattgatattgaactatcgcgctgggcgcggcggtcgatcattcggccccctccaggatactgatcagttgtgcgtctcgccaaagcccgtccatgatcttgggccaaaagctctggaaacgcaggtagcttgcggcgttttgtcgcgcatacgccttggcctcgtcgataccgtggcgccagatgcgcaggtagccctcgtgctcgcgggtaaacacgctgcggaccatggcggtcttgcgcacacggtcgtcgagctcgcgcgagatccacgggcctgggtagggcatgagcgatgccgccgtaacgggaatgagctccttctggtgcgcggcgaacgtcagcttggcccgctcgtagtaccaacggtacacgtcctgcataaagcgcggcgagcgcttttcggactccgggggcaggtgacgcacggtccactcgttatcgaaccacacatcgtagccaaacatgcgcatgttaaacaggtagtcgaggtcctcgccacgggtgataaacgggtcgaaggccacgcgggtaaaggcgcgggcatgcagggccatcaggccgccgcacacgtagttggaacgcgagatgcgggtacccgaaagcgcctttttcatccagcgattgaactcgatacgcttggtccaccagcgatgacagatacccgccttgtccataggggccagcggcgatccatcgcgatcgtagaagtagccgcttttgaccaagatcggcaagccctggcgcgtctgctgccccagtgcatacgtcgcacgcttcataaagtcggcgtcgatgacggtctcgtcgtcatccaaaaagacaaccgcatcgtgccccagcaccgccgcgcaggcaaggcccatgttacggatggcaccgtagcctcgcaggctcacgcactcgcccgaacccttgggtgcaatctgcgccacacgatcggcaatacgcgatgcctgagtattagtgacaacggtgaccttgagcgtaggatgtgcgttgacgatgtcgtgcacgcgcaacgacacgtcggctgtggcagaaaccgggcaaaccaccagcaagataatacgtggaatgtcgcgcacctgctcgagcgaggtcaggcaacggtcgagttcgggattggcggcgttgagtcgcgtcgaatgatcgtaggtgccaggggcgtttgcgcgagcgtcatcgcccgcccaatacgttggaatcacgaccgtggcgttcatgccttaccctccctgcaacacaaaaacggggcgccgccaaacacaggcgacgccccgcgacctagctgactccatcatacccacttgggctaatcattgttcggaagtcagaatgtttattgcggatacttccaaaagagtaccgcggataggcacaatagccgcccggcactcgtttttcctcgctatgccggctgggccatgcgagacaggcgaaccagcaggataaagcccaccaccagcagcacgccgatggacaggacgcccagcgaggggttgccggtcagcgaggtgacaaccgacaccaggaaggtgcccataacgcttgcatagcggccaaagatatcaaagaagccgtagtactcgttggacttttccttggggatgatacggccaaagtagctgcggctgagcgcctgcacaccgccctggaacaggccgacgaggatggcaagcacccagaactcgaaggcggtcttaaggaagaacgcagcgaagagcacgatacccatataggcggcgacggccaccatgatcatgttaagcgtgcccacgcggccggcgagcttgccgtagataatggcggacgggaaagccacgaactgcgtgacgagcagcgccagcaccagctgggtcgaatcgatgcccaaggccgaaccgtagctggtggccatggagatgaccgtgtggacaccgtcgatatagaagaagaaggcgatcatgtagaccagcacggtcttgttgtgggcaatctcacgcatggtgtgtcccacctcggaaaacacgccgcccacgatgtgaccgatagtgtcctcgggaccgcgctcgcgaccgtacttttgcttataggtgcgaatgagcggcagggtaaagatgagccaccaggcaccggtgatgataaaggacaggcgcgtggcgagcatggtgggaatgcccaaggccggaccgcccatgatgagtgccaggcaaatgatgaacggcacggtggagccgatatagccccaggcatagcccgagctggacacggcatccatgcgctcgtcggtggtgatatcgggcagcatggcgtcgtagaacgtcatggacgagttaagaccgatagtgcacagcacatagacggtcaaaaaagccatggccgacatggggatggcctgcgccaggcaaagcaccaggccggtcaggaaaaagcccatgaagaacttaatcttattgcccgcgtagtcggcaagtgcacccagaatgggcatgagcatggcaatgaccagcgaggcaatcgtctgcgcgttgccccaggcgaccaccaggtcggccgaagaagcgccggtgttgatggcgttaaagtagatgggcaccaccgaggtgttgagcagcacgagggccgagttgcccacatcgtacataacccagttacgctcgagcttggtgtatttcatggacagggccccttcgtattcgcccgatatgcagttagttcatcgtaccccaattgtccagaaacgccggtaaggattcggcaaaggggcacgcacggacatgcaagccggaggaacaaacccgcatcccaacgcagtcgcggtgaaatggttcccgtttggaagcctcggaggccaaaacaggaactattccaccgcaacttattggaaagcgtggatgaggcagcttgttattcctcgcggtcgaactcctcgtcggcaccgagcacgcgaccgctgtagttgatatggccggtcacggcctccatgtcaccggtctcgataaagcgtgcaaccgtgcactcgtaatcgaccagcgcgcgatcgaagacctcggggaagctctcgttcgaaacctcgtcggtaaagggattcttccaggtcagatggcccaagttgccggtgcgctcgggcagctcggtcgtcacgcgatgggcaaggccatcgagcagcgagtagtcgtgcaccatgccttcgaccagggcaatcgcacgcgtcttggccgagcccgccggctcaatcgtgcggtagagcagctgcatgtccgaaacggcggcgccgtactcccccgccgggatatcgatgccgtacacgcgtccggcgacatagctcatcagtacgccggcaacgcgattgatgcggtcggtggtgacgatctcgcccgccggcggataatcatcgaccgttgcgccatcgcgcttgagctgcagcatcagcacatccaggtcgctttcgagtacggcatggacctggctgcccgaatcctccagatcgagatcggattccacgatgccaaactgctgctcgtacacaaagggatgcgcattgcggtcgagcacgtagtgcgacagcaggcccagcgcaaaggcgcgacccaggttggcatcgcgcggaagcagatgagacacgccgtcgcgcaggcacgagaactggcgcgacatacgcgagtggtgcataacctgcgccagcagcgtgcagtcggaaacgcggggcgtcaggatgtggaagaaaaacgggtcgggaccctggttgcccagaataaaggcgatacgctcctcgtcggacgtgatgacgccctgcggaagacggtcgatgctttcctcgccaaacaaatgatgggtgataagcgcaggcatgataatcctttcgatttcattcgatgccacccattatgcccaccgcgcggtcatgccaaacctgcggcggtaaacgatggtgtgcaggtcgcttacgcaagccccagatgagccttgacctcggcggcgcggcgacgggacacgggcaccgtcgagctcacgcgatcgagtcgaagctccatgaggcccgtggagccgacctcgacattgtgcacgtcttccaaattgaccagatagctgcgatggacgcggataaagccctcggagcccaagcggcgctcgagcgaggagatcgactcattgatcaggtacgttccctcggcgcagacggcgttgcaaaaatcggcgcgcgcctcaaagtagcagacgtccgcgacgggaatgaacacctttttgcccccgcggtccaccgtcaggcgcaaaggctgacgcggagcatggacaacacgccgggcgcccaaagcagtctcgatcttgtcgagcgcctttgacaggcgcgcgtcctcgaccggcttgacgacgtagtcgacggcatcgaggttataggcatcggccgcatactcggcaaatgccgtcacaaacaccacgaccggcggcgtctttaggttctgcagcgtctcggcaagctcaattcccgagcgaccgggcatggtaatgtctaaaaacagcacgtcgggcttgttcgacagaatcgactccacggcttcggtgacattgcccgcctcggcaatggttcccacacgcgtatccttttccaacagatagcgtaattcagccctaatgggaggctcgtcatcaaccaccaggatgttccagccttcggacatatgcgcttcccctcttttttctcaatccaaccgcgtgctacaccgtcaacggcgccggttcatgcggctcgccgttcagctcaacgatgacctgcgttcccacaccctcctgggacttcacgcgcatgccagaatcttctccgtaaaagaaatggatgcgctgaagcacgttgaagagcgccaggccgcaacctcgcttgatggagccgtcggcggtaatgctctcgggctcctctcggcgatgctgctcaaacagatgcgcgcagacttcttcgctcatcccgatgccgtcatcttcgacgatgatctccaagccgtcatcggtctcaaaagccctaacacgaatagaaagcggctcgatctcgcgctgcgcatgcttgatgcagttttcgagcagcggctgcaagataaacggcggtaccagactgtcgcgcacctcaaagtcgatatcgaccgagacgcgcagacggccgtcgccgtaccgggcctgcataagattgatataacgagtaccctgttccacctcgtgttcgagcgtggtgagcgtatcggagtcagaaagcgtctgacggtaataattggaaaagtcgatgagcagcgacctggccttgtcgggctcggttcgcacaagcgacacgatggtgctgatggtgttgaacagaaaatgcggatcgacctgcgactgcagggcgcgcagctccacgcgggccgtgagctcgtcctggcgctcgagctcaaagctcgcgagctgcgtggagataaggtcggcaaagcccgaggcaagggccgtctggcgcatatcgatgctgctcaggcggggatagtacagctcgagcgtgcccacgcaatgcccgcgcacggtaagcggcgcgacgatgccagcacgcaggcggggaaagtagccgcccgtctcattggaggtgtcacgcgaaaacacgctctgcgcgcccgtttcaatcacactgagcgtggtcttgagcactaccggggttccggcagggcactttgccgaatcctcgccccagcttgccaacacctgcttgccgtcggtaaagcagatggcagaggcgatggtctcggacaggataattttagaggcgcccagggccgcttcgggcgtaaggccgcgcgacgtgtaggcgaatatttttgatgcaatggcgagcgtacggtcggttgcgctcgatgtgaggtcgtcggggaccacaaaaacatacgagaaaaagaagcacagcatgaccaggccggcaataacgacaacgcccggaacgggattgggattatcggttaaatcccagataagcagcaggataagcgccggaacgacaacgccgagcaggatggcctggaccacatgctgggccgtacgaaagaccttggtagagttgtagctcttacccagaatcagcctattgagatccaccgtcatctccttttatccatcgcacccatagcaataaagagggccgcaagcgaccctctccattgcattatgcaatcaaatactgtgttttacatccagccatcgatgaacggtagcttaggcgctgtacttgtttgcctcgccgaaggtgccagcctcgacaatccagccgtccttcatgatgacgtccatgttgtcggtattgagcacgtggatgtcggcggcgacgtcaccgttgacgaccagcaggtcggcgcacttgccggcctcgatggaaccggtctcgtcctcgatgtggcacatcttggcaccgttgagggtggcgcaggtgatggtctcgaccggggtgaagccgatcttgtcgacgaactcgtacatctcctcgatggagcagttgccgtacggggtgacgaaggagaaggagtcggagccgatcgtcatgacgacgccgcgtttcttggcctcgcgcaggcagtcgtagttgcgctgcagctccttctcgaccagggtgccctcgtacttgtcgtgcagctcggggacgtagacgggcggataggtggagtaccaggtgggcaggaatgcgatcgtcggggtgaagaaggtgccctgctcggccatgaggtccatggtgcgctcatcgatatcgaagccgtggatcagctgctcgcaaccaaagcggacggaatcgtaggcagcggcgtggttgttgtagcagtggctccacaccgggatgccgaccatcttggcctcttcgaccacggcccggatctcctcggagcagtagtgctggtcgcgaccggagtcccagcgccagataccgccaccggtagcccagatcttgatggcatcggggttctcgcgcaggcgacgacggacggccttacgcagatcccaaggtccgtcgacctggtcgccccaagggtgggattccttgttgagctcctgggtgcagtggtgggagtcgccgtggccggcaacgcggcagaagccaaggccggtggccagaacgcgcgggcccttgaagacgcccttgtcgatgcagtcgcgaatctggatgccaaagcggccgatctcgcagacggtggtgaggccgtgggtgaggcagtcataggcctgcttgacggcgacggcctgcttctcgaggagcggctgcatgacccagtcggtgtcatcgtcggtcaggttgcccgagaagtgcaggtgggtgtcgatcaggccgggaaggacggtcttgccggcagcgtcgatgacctcaacgccctcgggaaggtcctgcatgacgccggcatactcgatcttgccgttgtcgtcgacgagaacgagggagttctcgactggctcggcaccggtaccgtcgatgagcttaccgccaacgattgcatacttagtggacatggttcctccttatggatccatatagtgggcgaggccgtgttgggttaaggcctcacaaagctacccaagtggtgccgggttcggtgcgcggaagagagggccccgcgcacctgatccgccccggctaggcgttactttttgcgggaattggtgaaggccatgagagccagaccgatgaccagccagccgatcacgatgctccactccaccatgttgagggaggcgggagagaacgggatcacgagcaggccgatgatgatggcgcaggcagcgatagcgagacagatgccaaacttgccgccgggcacctcgtagggacgaggcaggtcgggctcggtgaagcgcatgcgcaggcaagcgagggcgaccataccgcaggagaagatgaaggcgagagccgacacgttggtcagagggatgagcatgttcttgcccaggaacggaccgacgacggtgatgacgcccaggacgacgcaggcgagcttgggagcgccggagttgggatcgacctcggcgaacttctcgggcagctgacccttgcggcccatggcgagcatgatgcggctcgtggcgccgtagaaggagttcatggggcccatgggtccaagcgtggcgatgacgagcatggccaggtacaggagcatgttgatgcccttgaggcaggcgagcgcgggaaccgggctcttaacgaactcatgccagtcgaggatggtgccgaacgagtagatacagaccatgtagaagccgccggcggccagcagggccagggagatgatcttgccgaacttgttccagttgaggccctcggccgcttcctcagcctgctgaggaatggtgtcgaagccggcgtagaagaacggggtcagaaccaggaccgacacgatgccggcgaacaggctggcgccctcggtagcggccttgccgccgccagcaccagtgacctgagagaacacgggcatggcgttgtccggcgaaccagtgaacagcgagacgcccatggcgagcagcatgccgcagagcagggccttggtcaggaaggcctggagcttggcggccgagctggcaccgcggaagttgaggaagatgacgtagactgcaaagccgagcgcgatcagcgtcgggaacaggtagacgtcggcgcccaggatggtgtagagcttgacggcgcgcagccactcaagaccgggcaggctgccgaacatctcggacacgagcgtcgagatggcgatggcctcccacgggcacaggatgccgttgcccagggcaaggagccaaccggtgatgtagctcagcgtacggccaaagctacggtccacgtactcgacgatgccacccgagatggggatagcagccgtgagctcaccgaaaacggctccgacgggcacgaggaagattgcacccaagaggaatgcgatcatagcgggaacgggaccgccgcccacgaccatccagtcgccgacctgcagaacccagccagttccgatgatggcaccgaaaccgatggtaaagaagttccagagcgagagcgttttcttcataccaccgttatcctcgactgcaacttctgcgttcttgtccgccattgttcccctcctttcctttttgacgccccttggcgtcaccccttgcgcagcctgtctagcagcgcgcttttatttcgtggctttacaatacggccttggcaccgcgctgccgctcatggctcgaccgaaggcaaaaccgaaaaacgagcggcgccgtttttgggacgaacggcacggtttgccgctcattgttgtcgcccgtccgacgggcgtacgctcatcggacgcatataaagatgtttttgaggccgtgtgttttgcgcctttcgtaccgtttaccgagcttttgacgcgcagacccatttgttgcacatcttttttgtaggatggacaggttatacatgagacaaggcggtacgaatggcatacggatacaacgacggtgatcaacggcgacaaagcgttcgccttgctggccgtaccacgccgacgcccagaagtgccacgagcagcaatccgcaacgtcctcaagagcaacccaggccttcgtctcggcagcagtcaaacagaacgcggcagagtggccgtctgagcacgggcacaagcgcgcagcaagatagccgcttgggcgcgcgcactcgacagcgtcaggccgaggttccgcaactgcgccgcaacggcgcacgtcagcccggcatccatatcaaccgcttcttttcgcatccccaagacggacgcgacggcaagccctaccgctcgacatcgcacgcgaatgccaccgccctgccggctcgtcgacttcgcctcgcactgtgctctatccttacctgtctggtctttgtgcttatgagctcctgtatgtcccacgggtcggccggtctcgagcccaccgccgaggacaagctgctcaaggcccccgtcgcacccggttattctttcgccttttcgaccccacgctcgcaatggcaagccggcacgatgccccatatctatcagatcgaccctgcgtggtcggagctgccttacgccggcggcaccatccgccaaaatgcctgcgggcctacgtgcctcaccatggtctacatctttaagacgggacgcaccaatatgacccccgtcgatatgtgcgcgctttccgaggcgggcaattacgcccccaccggcgcaaccgaatggtcgtttatgacgagcggcgcgtggcagttgggacttaacggaacggaactccataacgatcgcgactcgatgactcaggcgctgcgttcgggagcgcccgtcatcgccgccgtccggccgggcacctttaccaacgtgggccactacatagtgctttacggtattgacgacgccgaccagattgaagtcttcgatcccaactcggccagccgcagcgcccgccgctggggcgtcgtagaggtcctcaatgaagccgaagccatgtgggcctactactagtcgttggggacagacttaaatgagtggtctctggctgcccggaactgctggcacggaaaatgcatcccgctttgaagttcgatagcgggatgcactttccgcgcacggcctgtttgggaaactacgttccactttccggcaacattccgggatgcattttccggttgaggccctcaagggaaaccatgtcccatgttggacgctcattctgggatgcgctttccgcagttgattgatgcgggctttaaggactgttccaagctgccggcagaaaaggaacgtccccaagtgccgggtttccgcagtcattggggacagacttaaatgactagtcgtttaagaacgtccccaatgactacccacagaatgagggtctcatcggggactaggtaaatagcaaaagcccccgcggccgaaacgggccgcgggggcagcaggcttgcaagggttaactcaagtcctcgccatttgatgcaatgaccttttgataccagcagaagctgtcctttcggtagcgatcgaacgtgcctttgcccgtatcatcggcatcgacataaacaaagccatagcgcttcttcatctgccccgtcgaggccgataccagatcgatacagccccacggcgtgtatcccatcaggtcaacaccgtcctcgacaattgcatcgcgtagcgcaagaatatgcctgcgcaggtaatcaatatgatacgcatcgtggactttgccgtcttccagcgcatcgagtccgcccacaccgttctcagcgataaagagcggaagatggtaacgatcgtggtagccggcaagcgtcacgcgcaaacccagcgcatcgatctgccacttccaggcagtctctttatccttgaggtacggattgcgcaacgtcgggaacacgttgccctccgccttctcggcgatcacctgatcatcggcgcacaccaagcgcgagcaatagtacgagaacgagatgaagtcgaccgtatgctctgccagatactccgtatcgcccggctcaaagggcacgtgaacaccctctttctcgagtgcacgcagcttccaagcaggataggcgcccgcagccatcacgtctgtgtagaagtagcggccgcggtcctcctcatacgcaagccatacgtcctcgggcgcacaacggtacggataggtcgcaccggcagcgaccatgcaacccaccttgtttgcgggatcgatcttgtgcagaatctcgacagcgcgagcgctcgccataaacatatggtgcgagaacgccgcggtcacggctgcacggtcacgctcatcctcgagcgtgacacccgcgttgagataggacagcgccacgctgttgatctcgttgaacgtaagccaataacgcacgaggccctggtacgcgcgtccgacggtctcgacgtagtgcgcataccgctcgatcatctctcggctttgccagccaccatagcgctcgaccagagccaacggatagtcgtagtgcgacagcgtcacaagcggctcgattccatgctcgcgcagcgcctcgaatacctgacggtaaaactccaagcctcgccgttgggctcggtctccatccctgtgggaaaaatacggctccagcaaattgaaagacgcaggcacttaaagcccatctcggcaaagagctcgacatcctcgtgccaatgatggaagaagtcgttgccccagcggcatggatacagcctgtccggatcgtccacgggcttttgcctgccaaacattacatcccagcggtcggaaccctgtgggatcaggtcggagtgcgacatgccgcggccgccctcgttccagcccccttcggcctggttggcggcgagggcaccaccccacaaaaagccctcgggcataccggcggcagacgttctgtcaaagtaactcatgctactcagcatcctcggcagaagctgccgcggcgttctcctgctcctgagccaggagctggttatcgtacaccttaaagaacgggtaccagaccacagccatgaccacgatcaaaacgatcgtaaacacccagatgcgcgggtcgaggcactggacaaagccctgaacgaagatggggaacgtgccgctcaccaagatgtagaagttagagacaagacccagtgagaccgcaccccaatacagcagggccgagatcatgccgcctagcacaaacggaatcatgaggatcgggttgaagatgatgggcgcgccgaagatcgcgggctcggagatacggaagaagctcggcacgatcgatgccctgccaaatgccttgagctgctgcgactttgccctaaacgcgcagagcgccacaaaagagaacgtattacccgtgccgccgatgaggttgatggccaacgacatgagcgccgggtggaactcaagcggctgcccggcagcatagagcgaggcgttggcggcaaaggcggcaagcgtgaccggggcggtgatgggcattacgatcatgttgccgtggacgccaaagcaccaaaacagcagcgtcatgaagcagataagcagtgcgccgggcacagagtcaactgcgacggaaagcggggcagcgagcagcttctcgataaccgaggggattgacagcgcgggatcgatcatctggatcagcaggttgccgccaaagaagatgaggatgttggcgagcataggtacgatggcgccaaaggtttcggacaaaaacggcggcacgccatcgggcatcttgatggtgatgcccttggtctggcagaagcgcgtgacctcgacggagaccaaggcaacgatgatggcggtaaacaggccctgcgcacccagataagtgcaggggaccgcctggagcacggactcgtcagcaagctggtagtaggacgacggcgccgcggcgatcaggaacatcaccagcgaggtcatgccggcgttaagcttgggcatcttgtaggtgcccgccaggttataggcgattgcgaacgtcacgatcaccgacagtatgcccatcgtcatgttgaagggaatgagcagcgtgagcttattggccgtggcaaaatcgagccaagggccaaagacggaccagaacccgccctgcgccaccaggtcggccgtgaccggcgggttggcgaggatcataaagacggcagataccaagatgaagctgatcgcgctcataaagcccttttgcatggaggcaaagtggcgctcggtgccgcagaaattggcgataggggtcagtttttcctgaagcagggtcatgaacttctccatggttgcctcctaacccaacagcgactgggcgagtgccagcacgttggcggcgttgcccatgccgtagtcctgtgcggggatgaccgcggtcggcttaccgctcccctgcttgacggtgttgagctggtaggacacctgcggccccaagagcagcacgtcataattggcgcacgtctcctgatactcgccgatacccaccgcatcgatatcgagctcgatgccgttttgctccgcatatttctcgagtttcttcatcagaatgcttgtagacagaccagctgcgcaaacaagaaggatcttcataagggattcccttcgcattgattggttggatagtcaccgcacgccgctaggcgttcttggttgcagtgcgctcatacaggcagatcagctcctgcacgagctcctgagcaagcatggagcacatgaggtggtcctgagcatggaccagcaacacatccaccgacagatgctcgcccgctgcctcagtcgaaagcagctgcgtttggatgtggtgagccttgattcccgcatcctttgactgcttcatgagtttggcggcggcgtcaaaatcccccgcctttgccttttcaagggcttcgaaggcaaggctgcgtgcctctcccgctgcagcgaccagctgaaacgaaaccatctcggttccctgatcgtccataacggtctcctctcccgtgatgtttggtttgtacttgaatattcgaaacgcctatctcccgcccgcaatcctcgaggtttattgcaggtagactgacagggtcatcgacaaaagaagtcttaagccgtatgcgcttgcacaagcgccatcagctcatgccaggaccggcgctcgcgtaggcgctcgaccccctggcggtccataaagatctcggcgagcagtgagctcaagatccgcgcctcatcgccgcccgaccgggcaaacgacaccataaagacgatatcgacctcatggccgtattcgtcccaaagaatgggatgttcgagcaggcccacggtaacaaaggcctcggcgctcaagggatgcatcccatggggcatggctaccccattgccaaacgaggtggcgctcgcgctctcgcgctcggcgacctcttgggcaaactgggcatcgacacggccgctctcgacggcgcgctcggagagatatcggagaacggcctgcttcgacgacgcctcaacgcggttgaagaacagggcacggctaaagaaagagctcacggagtccgattgcgcagtgtcgtcgctcagcaccttgcggatagcgttgacatcgctcgtctccaagaagaaatcggcctcgcggacgggcacgggcaacttgacgttgagcggcaccgttgtgaacacgtagtcgatatgcgaaaaatcgaacgttcccacgcgggcgacatcgcatgtctcaatcgaatcgatatacatgccaaactgcttgcggtactggtgctcgagcatacgggcgcttcccgctcccgaggcgcacacgatcaggatgcgtttgcgacgcggctggtcggcttgctgctcgagggccagggcaaatgccatggcgatgtagccgagctcttcatcagagggctggctgccaaaatgacgctcgagtacctgcgaggtgccagctgccatcgaataggccaacggaaacctcgtcttgatatcgggcagcatggggttatccatatgcatgtgatattcaaggcgatagcccagagggccgatatgccgagcaaggttcatgcgaagttcaagatcgccgctaaagtcaaacctaaactcatcgttgaccgcacgtaccatctcggaagcaatctcccacatctcgtccgagataacggcagagcccttctcgggcacgcccgtgcccctgccgagcaaatggattgcgataaaggcaacctcttctcggggcatgctcacgcccagggcatccttgatgtttgcggcaatctggaaagccgcggcgtattcgcgcgttccctccagtttttgaacgtccgattctgcagctgggacatagcagccctgctcgatgcggccaagagcaatgtaaagatgcatgatgagattgcgggatgccagcgagctcaccgtgacgggcgaggccgtcagggcatcgtccacacatgcggcgatggcccgcaggcgctcggcgagctttgcatcgtcggtgtcgggcaacacgggcctcaccagcgaggccaggcacaggcgccgttgcgactccccgcccgcaacgcggattccgtagcgtgggcgcttttcgagcgttaagtcaaattgggcgagtttctgctctaccagacgcatgtcattggacagagttcgcgccgaaacgtagagtaaatccgcatactcctcaatcgtcacccactgggaccgcatgaggaggtcgttaagaaggaaggacacacggccgtcgcgcgtatcaggaatgcccggatgggcctgagccgcaccgtctagcaagcgagcaagctcatctgcacgtgcaacatcgatacgatactgccccttgctgccaacgatgcgtgcaaccccctgcaaggttgtcgtttgcgcgatggatatagtttctcacggcgcgctcgcttacctcgagacgcttggcaagtaccgcgacagcgacaggctgagcgtcctcgatcatatttacaagctgcttgacgcgagcatccatgtcctcctcctttccctgcgtctagtctaacgcggtaaagaatgacactccacgtcgcgctcgttccgccaactcggaacaggttgcggggagtccagccgaacttatagggagcacggagaaaggacccgaaagccatgtgccggtgtgagatgcgctttccgcagtcattggggacagacttaaatgagtagtcgttgtggacgttcttgtttgactagtcgtttaagaacgtccattacagtcgaaattgtcagcccgggcccgtctcgggctacgattgaggcgcgcccagaacgggccgccgaccgggcgcccgcgcacggccgaacgtccctgcccccgagagggcctgttgggtgctgccggcgcgggacgcgccgcccccgacggctgataggaaagtgccgggcaggcgccgcggctggtaatgtgagtgccgagggggaggccatccggtcgaacgactaccggaaggatgccaccgtgaaagcgccatcgaccaggcccgcggccgtgctcggcctagacgtcggcaagtcctcccactgggcctgcctgatcgaccgcgacggggaggtgctgtccagcgcccccgtccgcaacagggaggccgagctcgacgcgctgttcgcctccgtgcccgccggcacgctcgtcgtggtcgaccagttccgcaacatagggtccctcgccgtgaggcgcgcccgcgccgcggggctcggggtcgcccacctgcccggcctcgccgccagccgcgccgcagggctgttcgccggcgaggccaagaccgacgagcgcgacgccgcggtgatcgcgcggaccgccctgggcgtgccggactccctgtcgggggtcccgggccgcggcgaggccctcgaggccgcgcgcgccctctcgtcgcagcgcgaccacgtcgtcgcctgcgcgaccagggacaagaaccgcctgcgcgccgtgctgctcgagtcctgcccggccctcgaggccgccgtcgacctgtcggaccgccggtggctggagctgctagccgggttcggcggggcgtgggggatcgcccgctcgggggccgaggggccgcaggccgaggccgccggggaggccgcagccgcctcgactgcgcccccgccggcgctcatcgaggccgagaacaggcaggtcaggttcctggccgcccggatatcggaggccctcgacgaggccggggccctcgaggccgagacggcggcgctgctcgagggcgacgagacctacgcgtgcctgctcaccgtgcccggcatcgggccgaggacggcggcgcagctcgcggtgtcggtcgacatcgggaggttcccagaccacgaccacctggcctcgtactgcggcatcgcaccgagggtgagaagctccggcacgtcggtgaggtcggtcagggcgtccaggcgcggcgacgcgaggctcaagtccctgctgatcttctcgtgcaacagcctggtcaggtcgtcggggcgctacggcgagtactaccgggcctgcagggcgcggggcatgggccacgggcgggcgctcaaggccgtcgcgagaaagcggctcagggcgatatacgccgtgatgcgcgaccgggtgccctaccgggagcagccccgacggttgacaaaactataggaacacccaatgactaggtgaatagcaaaagccccgcagtcggagcggaccgcggggctcatgaagagaggctagtttgtgggcgctttgcctggcgcccacgggagaggcaacggagtaggggctactcgtggatgcgggtaccggagaggccggccatggtctcggcggccttgtccagggcgccgatgatgcaggtgcggcccttgcgggagcgggcgaacttgatggcggcgcggaccttgggctccatggaacccttgccgaactgaccctcgtcggccaggcgctcggcctcgtcggcggtgaggtcctcgagctcctcctggttgggcttgccaaagttgatggcgacgtgctcgacggcggtcagcaggaacaggacgtcggcgtcgcagtcctcggccagcagctcgccgcccaggtccttgtcgatgacggcgggaacgcccttgtagcagcccttgttctcgtagtcgcggacgacggggatgccgccgccaccgcaggcgatgacgatgaactcgttgtcgagcaggttgaggatggagtcggcctcgacgatcttcttgggatcgggggaggcgacgacgcgacgccagccgcggccggaatcctcgacgaagaccttggagggatcctcggccatgaactccttggcctgctcctcggtgtagaaggggccgatcggcttggtcgggttcttgaacgcgggatcgtcgggatcgcactcgatctgggtgacgacggtggcggcgtgccaacgcttgtagcgcttgtgcatctcgcggccgatgccctgctgcaggtgatagccaatgtagccctgggacatggcgccgcactcgggcagcggcatctcgggggtgccgatggcgtcgtgggcggcggcgaaggcgttctggatcatgccgacctgcgggccgttgccgtgggtgatgatgatctcgttgccctgctcgatgaggccgaggagagcgtgggcggtgttgctcacggcctcgatctgctcgacggggttgttgccgagggcgttgccgccgagggcgacgacaatacgatcgggcttgccaagaggcttagacattgctggaatcctttctgtaaaaggcctacaacccattaataacccgcgtccgtgcgatacgcgagtttattagggtttatattctctttatcgctcattttattcattttggaaatacctaagcggcgaacggtcgattttacccgctcagcgtaaagaagcccagttcaggtatatctacgccatttacgtgcaactttatttaaatagagcagggattagaccagattatgcaaactatatctttgctaaacacaaaacggacagcgcaatatcttactcgcactatacgcgattctatacattaatttgacgagtatgcatccctgcaaaaacatggggcttttcatccaacataagggatagccgatcgcgcttcaccccgcggcaagcgactgcgagttcgcagtatggaactttaccgtcggcttctgcatgaacgctgccgacgccctttcgctcctgcgcgcccaagcagccgagaacgctaacggcgccactgccaacctggccaccctcaacaacggcgccgccagccttttcgcaaagtaccgtgctggctcgctggctttgaggcctaagcgagctttgctatttgccaatttttgtatgatttgggtcaaatctatctgccgatttttgtatgattagggtcaaatctatttgccaatttttgtcattgaggggttttaatgctacgccgtaaggtcactgacaggcttttgagctggaagaacaaatccaataaagcgttgcttgttactggcgcgcgtcagattggcaagagctatgcaattcgcgcgtttggaaagagcaactacgcttcgtattatgaggtcaatctgctactcgatgccgaggcaagagacgtacttgttggcgctaagaactccattgacttcatcaaccgtgtggcccttcttgcggatgcaccgcttgttgaaggagacacgcttatcttcgtcgatgagattcaggagtatccgcagatcgttacacttatgaaggcgctggtcgaggacggacgctttagctatgtcttctcggggtctatgcttgggactgagtttaaggggatctcttcttttccggtggggtatgtcgagcacattgttatgcgaccgatggattttgaagagttctgttgggcaaacagcatcagcgagaatgtgcttgcagacattcgcagctgccttgtcgagagacgtcccgtcgaaaactatattcatgaggcgatgctcaaaaactttagagcctatatcgtttgcggcggcatgccagaggtcgttcagaactatatcgattcgggctattcgctcgtgagaacgcgtgagcttcaaattcagctagtcgatcagtacaaaagcgatatctctaaatatgcatcgactcgagcgtttaacgttcgctccattttcgagcaaattcccgttcagcttgaggcggagtcccatcgctttatcgtctcgtctctaggcgagggagctcgtcttcaaaaatacgagcaggatttcctatggctggtgaacgcaggcgttggattgatggtcccccaggtgacggaggcacgaagtcctctcaagaggacggagaaaacgacagcctttaaactatacgagtccgatacaggtatgctcgcatcgcggtatcccggcagcacggcacgcgccgtctaccttgacatgaaaacccccaacctcggcggcctctatgagaacgtggtcgcacaggaactcgttgccctcggagcagatacgtggtactaccaaacgcgtgaggtcggtgaagtcgactttgtaatcgaaggtgccctcgggcatgttgtcccaatcgaagtcaaatcgggcaagaaagttcgagcacatgcagccctcgaccgtttgatgagtgtgggcgagtacaaaattcccgaggccgttgtgctgagccacgaaaacctttgcaaagagggcaagatcctttacgttccaatctatatgacattctgtctcgatgagtttatggaaaaggacgaccccaacaacgatttctcgtttgcacccatatctctctaggtcatctgagtccgcaagccagcccccacgcccaaagtactgcgcctttcgcgccaaaggcgcgaaacagcaaggggatagaaggcagcgacaaccaactcccccactatgcccaaagtgctgcgatgtttcgcgcaaagcgcgaaacagcactggggcagcagaaggccacaatcagctagccctccatgcccaaagtggcgcgtggtttcgcggccacgccgcgaaacagcgaccgggacaaggcacccccacagccacgtccttcattcagccccacaatccgaggacgtagtcgtagcaggatctgagggctaaccttcgcggacactccgcaggacgaaagaacccccgccgcacgtagtgcgcagcgggggttctttcatgtccgaggacgtccgcgaaggtcagccctcagatcctgcggtgggagacctaggcctcgttgtacaccgtcttgagcttcagcaggtgagcgtagcggtccatggcggcctgctcgttctccttgaagagctcctcggcacgctcggggaaggaacgcgtcagcgaagcgtaacgggcctcgttcatcaggaactcctgataaccgcccgcgggctccttggaatcgagcgagaacttcttgccggcagcagcctcggggttgaagcggaagaggttccagtaaccgcactcgacagccttcttcatctcggcctggcagttctgcatgccgcccttcttgatggagtgcatctcgcaggggctgtagccgatgatgagggacgggccgtcgtaggcctcggcctcgtggatagccttgagggtctgagccgggttggcgcccatggcgacctgcgccacgtagacgtagccgtagctcatggcaatctcggccagagacttcttcttggtcaccttaccggcagcggcgaactgagcgacctggcccaggttcgaggccttggaggcctgaccgccggtgttggagtaaacctcggtgtcgaagacgaagacgttgacattgtggccggaagccaggacgtggtccaggccaccgaagccgatgtcgtaggcccaaccgtcgccaccgaagatccagaaggacttcttggtgaggtaagccttgtcggcgaggatcgccttggaagcgtcgcagccgcacttctcgagctcggcaacgtaggcagcggcagcggtcttggaagcctcgacatcgttgacggagtcgatccaagcctggccagcggccttgagctcgtcggacggaccgtcagcggcgataatctcctgggtggcggcgatcagcttgcgctgaacggcctcgtagccaacggccatgcccagaccgtgctcggcattgtcctcgaacagggagttgttccacgccgggccgtgaccgtccttgtccttgcagtaaggagcggtggcagcggggttgccccaaatggaggagcagccggtggcgttggagatgaacatgcggtcgccggcgacctgggtcaccagacgtgcataggcggtctcggcacagccggcgcaggagcccgagaactccaggtagggctgcttaaactggctgcccttgacgttggccgcgatgagctccttcttctcggagacgttctcgaccatgtagtcccaaacgggctgctggtccatctcctgctcggtgggaaccatctcgagggcgcccttggggcaaaccttgacgcagttggtgcagcccatgcagtcgagcggggacacggccatggtgaacttcatgcccttggccttggggcccatggcgtcaagcgtgcgggtagcctcgggcgcggcggcagcctcgtcctcggtcatcgcgaacggacggatggtggcatgcggacacacataggcgcactggttgcactggatgcacttggtctcgtcccagtggggaacgaccacggcgacgccgcgcttctcgtatgcggaggcgcccagctcaaactggccgtcggcgcaatcgacgaaggcggaaacaggcaggctgtcgccgtccatgcgatcgatgggctcgagcaggttcttgacctgctgggcgatagcggacttggtctcctcggagagctcgacgggagcggcatcctcggcggtagcccagtcggccggaacctcaaacttacggaaggcggtagcgccggcatcgatggccttgtggttggcgtcgacgatagcctggcccttcttcatgtaggacttggtagccgcgtccttcatgtactgcagggcgtcctcggcgggcaggaccttggccagcgcgaagaaggcggactggagcaccgtgttggtgcgcttgcccatgccgaccttagcggccaggtcgatagcgtcgatcaggtagacgttgacattgttgttcgcgatgtagcgcttggccacggcgggcatgtgctcggcgaactcctcgtcgctccactggcagttgaccaggaaggtgccgcccggcttgacgtcgcggaccatcttgaagcccttaacgatgtagctggggttgtggcaagcgacaaagtcggccttggtcacgtagtacggcgaacggatcggagaatcgccaaagcgcaggtgcgagacggtgacgccgccggtcttcttggagtcgtactggaagtaggcctggacgtacttgtcggtgtggtcgccgatgatcttgatcgagttcttgttggcgccgacggtaccgtcgccacccagaccccagaacttgcactcgatggtgccgggggctgcggtgttgggcgtatcctcggcctcgggcaggctcaggttggtcacgtcatcgacaatgccgatggtgaactcgcgcttgggctcgtccttcttgagctcctcgaagacagcgaacgcggacgcgggaggcgtgtccttgctgcccaggccatagcggccgccgacgaccttgatgcccgtcttgccggcctcgtagagagcggagacgacgtcctggtagagcggctcgccgatggaacccggctccttggtacggtccatgacggcgatcttctggacggtctcggggagaacgtcgacaaagtgcttgatggagaacggacggaacaggcgaaccttgaccaggccgaccttctcgccgtgagcgttgaggtagtcgatgacttcctcgagcacgtcgcagaaggagcccatgcacacgacgacgcggtcggcatcgggagcgccgtagtagttgaacaggccgtaatcggtgccgagcttctcgttgatcttcttcatgtagccctcgacgacggcgggaagctcgtcgtagaccttgttgcaggcctcgcggttctggaagaagatgtcgccgttctcgtggctaccgcgggtatgcgggtgctcagggttgagcgcgtgatcgcggaaagcctggacggcgtccatgtcgcacatctcggccagatccttgtagtcccacatggcgaccttctggatctcgtggctggtgcggaagccgtcgaagaagttaaggaacggggtcttgccctcgatggcggcaaggtgagccaccggcgagaggtccatgacctcctggacgttgccctcggcgagcatggcgaagccggtctgacgacaagccatgacgtcggagtgatcgccaaaaatgttcagggcgtgggaagcgacgcaacgcgcggagacgtggaagacgcccgggagctgctcgcccgcgatcttgtacatgttcgggatcatcaggagcaaaccctgagaagccgtgtaagtggtggtcagagcaccggcgcccagcgaaccgtgaacggtaccggctgcacctgcctcggactccatctcgacgaccttgaccggggtgccaaagatgttcttgcgaccctgggccgcccactggtcgacatggtcggccatcgggctggacggcgtaatgggatagattcccgctacctcggtgtacgcatacgaaacatatgcggccgcctcgttgccgtccatagacttaaacttacgcgccatatacccctctcctctcatataggtatacaggccccggcgatcgccgggatgttggcgtgatgggatttacgctgttgcttccaatcatctggcaggcaggctcagcagcaggtacgtggcgtggagagaagacatgccgaggcgaggggcagctgatgcgccccacagacccgaccgcccgtcttgcacatgaccgagcgccgcaaaggccgcatgccggatgctcccgggcacgccccggcgatgggaagcgcccgcaacggaaatccgcatgcgggtttattgtaccccgccgttaagtgtaatttcgacaaatataggcgggcggtaaaggtttacctcgggtgaccgccaaaggccagaatggtccctccatccccggacgactggctctgacgcgccaaggagtgtccccaagtaccggcaggaaaggaacgtccctaactgccggctagagggcgccgagcaggatggcgtaggtggtggattcgccgagtttgagctcgtcgccggggttgagctgggcggagcggccgggctctacttgaatacacacactcgtggccccgtttaccaccacggtgccgttagtggacgacaggtcctcgacaaaccatgcgccagactcgtcgcaccagatatgggcatggcgggccgagacgtcgtcggtgatgccgccctcccccgttgccagcgcgccgatctcaacgccttcctcactcggctgaatccagcgcgggacgctcaccacgtagccgttttgcacgcacagcagtcccagcggatgcgccggcgcgacctcgtgctcgcccgcgaccgaagatgtgctcagcgagcgcggcgtcgacgtgtcgccgccacgggtcgcatgagcgcggcggctcgcccgacttggaactaaggcgggcgtgagagcaaacggcatagggaacgaatcttgcggatgtactcctcgacgtcaggcaggtaagccccacgaagtcaccggggaggcccaagcggcccggcaccacttccagattctgaccagggcgagtcgttcgccggtggctgaaggctcgctcccacccaaaaggggagattcgcgttgttccccaatcgctctcgcatctttcattttgctcgaggtgggctataaaaactttcctggtgaaaggcggcgattggtttcctttctttctagaggagcgcgcctgtaatctgttttcatcctaaatcaagttaagatcggaccttccagaggcaagtcgactcaaactgcgaggctccatgttggaataaagagcgctgtcgaagtgccaacaacacaaagcttgccagtctcaaatagaaccttttgggagtccgattgggccgcacaccgaatccccgctggtggttttttatagctgcgcaacaataaacaaggttagtgccagtccagcatgaaattgaggaacgtatgcattttttctcagtaagtgatcgtcgttactgcttcgatgaggtcactcgcaattgctttcaggttgaccaagcatcagaagatgcgcttcgcatatttgaagcatcgggaagaacggtcaactcgaagttgctaacaaagtcacttgctgcgaaaggctacgaccaaacgaccatagcagaacttgaagacgacattgatgagtatcaacgattgtctgagcggactttcttaacaaaagacacgcctcgaaaacttagatccatcgaactccacgtttcacatgcatgcaaccttggttgtagttactgttttgccggtaaaggagattatggaacgtctcctctgctgatgacagacgagatagccttcaaggcggtcgactacctcgtcgcaagttcatcggaaaacgaaacgcttgcgatcgtcttttttggtggggaacccatgattaacgagccgctgatatggaaaacggtcgactattcaaaaagaatataccccaatagaaactttacctattctattacgaccaacggaacgcttttgaatgacactgctgtgaattctttcaaggagcacgggttttctgttctgattagtctcgatggtacaggatgcaagcacgatgcatcgcgcccgtataagacgggaggcggctctttctccgatatcgacaaaaacgttcgtcgtttttccgagtcgttccccttcggcgcaagagcgaccttaacaaataataactgtaaccttgttgaagactatcttcagtttaaagagatgggcttcagaaggatttacttctcgcccgtgagctcattcgatgagaatatcaaactcgacgaacactcattacacaaaatcagggcgggcctaatagatttggcggatcaatatctcaaacagattgatcaaggggaaaagcccttgtttagaacattgaaaactgcagttgatttgattatgagcaacaggatcgcctttgtcggatgcggggctggcaggcgttttatttccgtgactcccgaaggggacgtatacccctgtcacaggtttgtcgggatgatgcgattcaaaatgggcaacatcgtcaccggaattgacgaaactaggtatattgaaaactggagtcagggtgtcgaaaaaagaattgactgtacggactgttgggctcggtctttctgtggtgggggctgtagctgggaggctgcagacgagcacggctacttgcccaagagtctacaccctgcatcatgtgaatatagaaaaatgtgctacgagatggcttttgaccttatttcccgccactcatcttcgcaggagaaaaatcaacgagaagctactgtatcggaataagcggttcagcgcattgctgtcaccattgtggaggtgttcgttcttctgattaccgtctgcgaagcttattgctacattcgccgaaaccattctagaaatatggtgaactagacatcttggtttgttatacacaatattgaggtttttctgcactcaaagggaggtagtcgtgaagcatattcatccgattaatccaggaagtggcggcgaggcaggcgtgaagccgatgtcttttgactgcctcttgggcattactgacatctgtactgtttatgataaagcagatggctgtggtgcatacgattactgcgactatgacatggatggcggcagcatctgcgttgtagatcactgtggcattgatcaaacgtagtctctaattggattaaggtgaggagctgttatgaagcatatccatcctgttggttcaaatgaacatcctcccgttgagccttgttgtcttggagttgatatatgcaatttttacgacatcgccgagtgccctgttgcggattggtgctatgtcgataaagaatcaagctgtgttttgccagcagattggtgcgatccagttgacgagtagttttgtggctaggaactatttggtccaattcagaataagatgggaacaaataccaaaatctcgtgtctgggaggagttatgccattattgcaaggtctcgttggattagcctttatacttgcgttatatctggcaccttttttaattctattcttcattatccgactctttcttcggagaaaataggagtgtcacgcaaacattagcgtagctttcttccaatatgagccgagcattggcaagtggaataagaagcccgaccgttcgccacatgaaagtgatcggacgggcttctctatttaacccgggccgccacccatagcggctttccaagcgtattctcagtgcaaagcaatcgtcagtttaatcctatgcgctgataccgcatttcatttgttcggctcgaattctacggcctggcaaccctcgcactctccggcaaatggattgaacgcgaaggcagagatgatgtgtgcgtggacatcgaggctgctgtaggcaacatactgggacatggacccccgctgcgcgtggtatgcggcccggcatattcattgccgtccaaccccgtgtagttgcagcaaagggtggaacctcaatgctcagcccatgttgtccgtgggacacgagaatcgtaagtacactttggtgcgattctcacgctgatactgagccacctggaataagatacgtcgcgacaacacttcgcttcacctctgtctcgacaagatgacgtagactaaagtctcctttagtaagagaacgagaaccatatctgaaagcgttgcgatggcgtgaaggcaccgagtccgaaccgcctgaatgctacgtgcatctgcatcgcctttttgttatctctgccagttgggtagcactacacttgtcatcatttaccctggtacatgctgcctaaatccactaccccttctaccgcgccgaccatctcgtcatcgtgagagacaacgatgatcagctggctttgcttgttgcgcttaacataggccgcaagctcggcgcggcttacagcgtctaacccagtcgtgggctcgtcgagtaccaaaactgacgacttgcgtgaaatcgccgaccataagtacactcggcgcagctcaccgcccgaaagcgcggagcaacgtttcccgagcaactccttcacgctgttttccagcgaaagtaggccatctacaccccggtgataggaagaaaagggcgtgtcgaaatactctaacagctctttcaccgtttcgtccggcgcgaagcacgactgtgggcagcacgatatctctctcgcacgtatgtaatccaagtcgcattcttcgattggcacgccgttgtattttactttgcctttcgatgagtatagcccgagcatcaagtaaagaagtgacgtcttgcctcttccgttttccccaactatgcaatatgtaccaggaccggaaaacttgaaagaaaacccgccgaggacctctcggacagatccgtctggaagggcaaccgagaattccaaatcagataccgaaatgtcatttatttcatcgagtttagctaaatcggtccgattccaccccgatctctccttttctctcgtcgcgatagccgtcctatcccatgatgctttggcatcttgataggatttgaacaatgacatcatacttttcaaagtcttaaagagaaccgcgaagtatgtaccgatgatagtgtactcgcctattgacatagttccgttaatgattcgtactccggaaacaacaagtatcaccgcttgaaacaacgctgcgaaaagaccatcgagcgatgtcagagaatatgatagctttccggagcgcaaaactttgggaaaatagctcttaaacccagcgtcgagcgcttgttcgctcttgccgtacgaagatgtcagttgaatgttgagaatctgattaagctgcgatgcaattgcggcgtaaaaggcgctgtccgcctctttcttctcatacgtgaccctatacaaaagtttcctcaacccagtaattacacagaaatacacgatgaggagaatgatggaaaacaccgcgagagttgaatcaattgaccatatgataagcaatacgatgggaatggctacaatggacagcggcgcactgataaaattcgccaaaacgaaggatgagaccacgctggagtcggaaataatccgttgcgttgtataggctggatcgatggtccgactcaccaagtaatcgtctctttcaaaacgcaagacggcctccctgagaagatcaaaggaaagtctcgtggttatgcgaatggaaagtgttcctgcaaaataagtaaagagggtggagaaaactcctattgacgcaaccaggagcgcgaagagtacggcgtctctttcgctgcggttaccgagaagaaaatctaagaatttcccgttcacgtatggcatggcataggagagagcggttccaatcaccgtgatagcaatgaagacgaaagccccttttgctctgatgaacctcgagagaacgcatcgaatcaaggaaggccccaatctacccgccacaaaacatcaatcactgataccttacacctcaacacaacaggagcgaagatttgccaatgagactgctttaagattgccttgggccaatacgatctcaagctcttcctacaagagagtcggaatcggacatctcctccgacgaacctggcaatcgggcggttgaaatatctttttcaaccgcccgattgccacaatagatttgagcatccgcccacaaacgtccgcgttttatacccatcaaatcctttgccttttgtcgtctagactagaaaaatcgctcgaaataacgcaaccggcctgctcgcttgaagaaacctaagcccgtaacgtagatgtgcaaacttccgaaacgccttgcgcggcatagtgcgtataaacttcgtcaaccgcctcagaaatatctgagtatcgcgccgggtcaaaagcatacgatgtcgcagctataccctgcacccattcggaacgcggattaattgaatagccacatagcatcatcatacatgcatctagacctgatttcccaagtatccgacgtattgatgagagcatcgcgggtcgcccctgcaccatcgtcgtcacccctattagcagtatttaccgtttttctctaaatgcgtatcgccacccttaagaatacgaagtgttttatccagacccgattgtcctccatctcaaacgaagggataaggaatctcatccggaatcggcagtaacggaggattcacaacgacaagcgaaaaacatgagtcatctctcagaggggagtaaaggctcccctcaagcaccctagtttcgtcatccaaagagttgatggcagtgtttttcttacaaaggtcgacaacaaaagggttgatttctacagatgttacatccatgccacagttggtaagtatcaggccctgtattctggggccagaacacaaatcgagagccttccgtgcgctctgcggtgtaaggcgccaatctcagcaaatctgtcccacaatactgcgctgaagaacaagacggaacccctgagccaaactcccctataccttattaaggctaagacaggcaagttcacgcacccggcatattccagaataacatcctattgttttagatgctctacaagcatgaacagccgcgaatcggaaagatcttctagtttcgccccgactgaccgccaagggccaaaatggcccctccatccccgggcgactggctctggcgcgccgaggagtgtccccaagtgccggcagaaaagaaacgtccctatctgccggctagagggcaccgaagagaatggcgtaggtagtggattcgccgagcttgagctcgtcgccgggattgagttgggcggaacggccgggctcgacctgaatgcagacgcgcgtggccccgtttaccaccacggttccgttggtggacgacaagtcctcgacgtgccagatattttgagcatcgcaccagatatgggcatggcgggccgagacatcgtcgccgacgtcggtaatatcgccctcaccagtggccagtgcgccaatctcaacaccctgctcactcggctgaatccagcgcggggcgctcacgacaaaactgttttgcacgcgcagcaagcccaaggggtgcgccggggcgggttcgcgttcgcccgcggtcatcgacatgccaagcgaacgcggcgtggatgttcctccgtcacaggtcgcgtgcgcgtagtcgatggcatagttcaccgaggaccgcacatccgccgaacagccgacagcgacaaacagcaccagcacggcctcggcgcgctcggcgggcatgagttccgccgcctgggacaggcgatcgagcgcgttgcgatagagattcgtgtcctggtggcactcttcgagcgcgcgtaccatcggttcacctgcaggaccgcacaccatattgatcacagccgtggagtccatgggattgcgctggcgcagggccagttgcgacataatacgcgcagccgaggtaccgtattcggcaaagtagcgctgctgaagcgtgccgaccggcgcgcgaacgataaagcgggaaacccaagagcgatcggcggctcggctctgcgggctgcggccgtcggcgagcggacgggacgaaagcaccaagccgcacagctcgatatggctcagatgcgctgcgcgcttaaagatgtcaaacatggccccgcatggggcgagctcaacttgagatgccatgacctaggcctccttggtcgtagaaatagaatcggacgatacttcgacaggtccgccaaaagtacggacagctgcggctccaccggcaagcggagtcgccatctgggcttttgtgcgtcgcggtgccgaaacgggaagttcaaaggcaaagcccatcgcaagcaaaaaccacgtaagcgtataggttgcaaccagagcggcaacaaggccgcccatcacggcgcgttgggaaaatacgctacatgcagccacaaccagcaccggaacctcgcaggcagaaagcgcaagcacaccctgcaggaagcccgagcgccgatcgcgcgcaagtgcccccgcggcaacgccggctatgcctggcagcgccaacgccagtgcggcaataatacccggtagcgacccagaccacacgagcgatcccaaagtcgccgtcacgcgagcgcccgacgccagcagcgcggccgaaaccacgaccacagcccaaaccacgccacagacgaccgtcgcgccgaccatcagcgcgcgacgaaccgcgcggccagacgcatccatggggcacggcgtgagcggctcgccgcgaagcgaacgaccgacattttgcgcatagtggtcacaaaacgccgagagcgccgcctcgaccgccgccggctcgggacgatctttttgatggctggacagacaggccatcaccacgtcgaacagctgggcatcgacaaacgccagcgcatcgcgtagctcttcggaatccggctcaagccctagctgctgggcctgctcggccgcggcgagcgccacatcgggctcacgacgaagcagctgagtcaaatcacaaccgggcgcatgggcaccaatgggatagtcgggccgcgtgtccatcttgagacggtaggggctcgcgatgtcgcgcgtctttttgcgcgaacccgaggtgcccgaagtgctcggcgcggcttcgtatggcgcgacgccggcaatgagctcgtaaaccgtgcttgccgcggcatagacgccaatcgccggcgacatacgcaaagcgcgcagatcgggaatatcgtcggtgagcatctcgggtggggcataggcaaccgtcgcgcgacgcagcgtggcatagcgctccgtaaacgacgccttgccgccggtaccggccacggccgacgcaggatcgagcgccagcgacgagccaaagtcgatcaggcacaggtcaaaggtgccctcggcaagctgccggtcaagcggtaaacgcgccgtacgcaccataatattagcgggcgagatatcgcgatggacaaagccctcccccaccaggctcatgcggcagagcaagtcgaacaggtcgcgccccaagcgcgccgccacaagcggcgataggcggccggcatcgtccacggcaaagcgcgagcgcaagcgggcgagcgtctcgccctcgacccattccatgacaattgcaggcacaccgtcaacctcgccccagccatagaggcggggaaagcccttaaggcccgaaagggcgcgatggcattcatattcctcgcgaaatgccgctttgaacttggcgaccagcgcctcatgggcggcatcgtcgtcaaactcatcgcgcgtcggcaagatgagctgtttgagtgctacggcctcgccttgggcgttgacggcacgcgtcacgcggccgataccgccacggcgcatggtggcatcgtcggcaaacagtatcgtaaaacgacgcagataggcaggcagttcgtcctgaccgagcgcaatggccggctcaaacccgtcgacacgcgccaggcgcaggccgaccatgggatcgcgaccgagcgattgtggtgtggtggatgcaagatcggtcatcatagggcaagcgccgccacgttattgttgaagttaccgagcgcgacgtcatcatcgccgtaatggccgacccattgacataggttggtgtaacagccccacagattggcatactgctgataccactttgaccggggcgagaatgtctgacgaccgaactcggctcgaatgacaaacatctccccgaccaagctgtcgcacggcctgggatctcccgtagagttataggtcgagaccacgtcattggcacgagaaacatagccgtcgagcatgttgtacttggtcacaagccaactgtgaatgctctcttcctcagcagcggaaaggccaccggagtttgcatcgttgtcagcgttgccgcccgtcgagccgccgtttccagaccctccggcagaggaacccgacccagagccgccgcccgaactcgacgaatccgagccggagccagaagtatccgagctaccgggctttccggactgctgggcgtcctgctccttctgccgctcgaccttattcaccgttgccgccacgctattgttggacaaccgatcgatgatcttggtgttggtgagcacgatggttttgccattggcaagcgtgacttcgttgtccggggcctcggcgccgtccgcgtcgtcggcgccaaacacaatatgcgcgaccacacttgcccaagcatatccagtcgtggtgcccagatcacttttgacctcatgccctacgcgcggttcgcatgcggcatgtgcctgtatcatggacggcacggtcatgccataggcagaaacgccagctatgaccagcaccagcgagcacgacagcagcgcgtacgcccgaggcgccaagcccagtcggcgtcgcatgcgcaccgcggcgccgcgctttgtctgagtgccaccgggccgcatgcgttctcctccaacaaaaacacgccgctcgggagcggcgcattcattcgaatccatatttgagtgtatcagcgaacccaaaaggttgcgcaacgaatgggcaaattaaggatgcgagtggaagcatccatgcgataagcggatacaaagcatctttgttgcacaacaaacttacagtcgcacggggaaattatgactaccccgtgcgtcgcgaggaaaacatacggcaggagcaggctcgccacctaaatcgtgcgacgggcctcgatggcgcgcccaagcgtaagctcgtcggcatactccaggtcgccgcccacgggcaggccgctcgccagacgcgacacctcaacgcccagcggcttgatagtgcgagccaggtagctcgccgtggtctcgccctcaatattggggttggtggcgatgatgacctcgtggatgtcctcgtggcccaagcgtgccagcagctcgcgaatgtgcagctgctcggggccaatcttgtccatgggactgatcacgccgcccagcacatggtacaggccatggtagctgcccgtgcgctcgattgcctggacgtcgcgcggctcgcccaccacgcaaatgcgagtggtgtcgcgcatcgaatcctggcagatggagcactcgtcggccgtggcgtagttaaagcagcggctgcaaaagtgaacctcctgcttaacctccaggatggcctcggccaggcggcgcgcctcctcggcgtcagcctccaacaggtaataggcgatgcgctgagccgacttagggccaatgcccggcaggcgacccagctcatcgagcaatttttgcaggctatggttggcactcatatatatgcgcgtcttagaacggcatgcccgggatgttgaggccgccggtgatggcgcccatctgcttgttggcgagctcgttgacgccgcgaacggcctcgttgacggcagccataatcatgtcctgcagcatatcgacgtcctcgggatcgagggcatcgggatcgatggtgaggttgacgagttccatctcgccgttaacggtcaccttgaccataccgccgccggcagaggcatcgacggtctgggacttgaggttctcctgcgcggcggcaagctgctcctgcatcttgcgggcctgcttcatcatctgctgcatgttcataccggccatgacggctcctttacgtgcggccgcacgccgagctgcaagggcagccggagcacggcgggactttcaaactcaaaaatcgtaccacggcgcggggcaagcaagcggggcggacacgctacctcagtcgatatacatgtcctggagtgcaaaccgcacccaaagattatgcgaagttgaataattcgcatctgcataatattgaaagctaaatcttgtagagccggaatccgacattttctgcatccagctagataacaaaatgccgaaccgctgctcgaggcggcgctcatgatggcagggtataatttgattgtcacagacagcaatttggaggtgcccccatgaatgcccccgacgcgctccaaaacatccgctcaaaacaccccgttgcatatgtggttctctatctctttgtcggctgggcattactggttgtcatcacccatgctatagcctttggagcagaactgctgataaccagctcggaccagcccaccgtcaaatgggaagcgaccgatgagtgcaccgacggaacccgaaccatttactacaacagcccgtccctctaccaggagttcaaggtcaagatagaggacgccaagattgtcgatgccgagccaggcgcttatttggcaatcggagcaaccgtcaacgccgaacaagtcgagtacacggacagccatgcgacgtatcgcatcgacctcagcatcctaggccgaccgtcacgtacctgtctgctcgaatgcgaaatacgcggcaccacactacacatgtccgaaatacaaatgcgcccggataaaaagcccctaaagagctaggggtcctaagcccagcaagcgattctcaacagtaaaacgacagcccaccggttgtttctttccagcgtttgcaaatcagcgcatggttagatgaaacaaactgcatgatatcgcgtaaatcccgagcaggaatatcgcccttgttatgggccagcttgcatccgccggagcgggtaagccatatcctggttgcctcggcagtggggtgcttgaccgcaacgtaaacatggacaggttcgccgttctcccccgtccagaagaagatgatgtacggcccgagtcgaaacagactaggcatagactcgtccgccttcgtaggcaaaacgcaggatgagcggggcattgttgcgcacgaaatcatcgagttctttgaggttcgcttcgctaaagccctcgtgtgacacccaattgaatgccggcaagatacactccgccgtgtcaaaaccccaatcgcgcgggcgctccacaacgaccttcaccgtgttgtcctcacggacttcggaatacgaaacttgcgtatcgtcctcaaggcggacatattcccacatcataagctcgctccgttcaaagacgtctcttcttgagcagtatacccgcctgtacagctactccaccggtttgaagatggtggactgaccgaagacgctgcggatgagggctttggcctcgtcctcggtctgcgggatgcttggggctgcgccctgatggccgaagggactgcccgcgccggggttggactcccagggagctgcaggagcgtcctcctctttgggggcagttgcggcgggcttgggcgcggacgccgtggccggcgcgtcgaacggaggcagatcgtccccgcccgcatcggcggcaaaaccggcgaccatggcatcgtcgtagggcacctgctcggattcccacggcgcagactgcgcggacggctgagccttgggaccggacgcgcgctcgggcgcgcggggcgcaggctcagtcgggagcttgcccgtggcgggagcgccggcagggttgtccgagcgcagccagggggccttgcccaggtcggatgacttgggcgcaggcgcagcggcaggcttgggcgcggggaccgaagcagccgatttggccgcggctggcttaggcgccgacggggtcgatgccgctaccggtgccgcttgctgctgcggcgcgctggcgctcgaggatacaggggccgccgaggacacgggctgcgggtccgcagatgccgcagcccgtgcagatggagaatgctcctcatgttgaggagccggcgtgccacctccatccaggacgtagtcgacggtgcgacgaccgaagaccgcgcagaccgtcggcaggaccaccgattgcgtgtcagcgcggccgagcatcttgatggcaaaggtcgagcccgcggggaacgagaccgtgagcttggagccgtcgtcggccgtggcgcgggcgttgagcaaaagccctgcgtaggaagcctgacgcgccttaacacgctcgacaacctcggcccatttgcgctgcagctctccggcatcctcgaccgcgggcgtctcggcagcaccggcggcagcaacctgggcggcggtgttgggctggggcttaggtgccggagcggtggcaggcgcgggggccgcaacgggctgaggcgtcggagccggcgcagactgaggtgcagacgctgcaggcttggaagccgacacggacgcagaacggggcgcaggctgagccgccggagcggcagcaccacggtcccaaggcataccgccctggcgcgcggacgtatcagcgggggtagcagatgccgccggagcggcagctcgggcacccgagataagcgtcggctgctgggcggcagcgggtacggatgctgcaggcgcggcggcctgagcagcagccacgctcgccggcaccgcggcattggcaaccatggcctccaggcgtgccacgcgctcggccaatgcctcaatcgttatatcagcctcgggacgtgccaggcgcgtgcaggcgatctcgagcaccaggcgcacatcgctcgcgcccctcatctccagtgcggcatcgtcgagcactgtcagcacacgggccaggcggtcggcaggatgctcgccaaaggcagcggcctcggcagcaagcgcctcggcctgctcggagccgccctcaaacagctcggcgcgggcaccggcaacgcaggcaacgtacacgtcacgcacatgcgccaccaggtcgcgcgtcagctccagcaggtcgtttccttcctcgacctgcacgcgaatcagtccatagagctcggcaacatcgcgatcggcaatggcgcgggaaaactcgcccagaatctggtccgaaacctcgcctaaaagcgagcgggcgtcgtccgcatgcacagaaccgttgccaaagacgctcagctgctccagcgtggacaacgcgtcgcgcatgccgccctttgcatggcgcgccacgatagccagcgcctcgtcgtcgtaatcgaagccctcctgctcgcacacgtatgccaggcgatgctcaatatcctcgttgccgatgcgatggaaatcgaaacgctggcagcgcgagaggatggtctccagaatcttttgcgggtcggtggtgcacagcacaaagatcacgtgtgccggcggctcctcgagcgtcttgagcagcgcgttgaacgccgccgtcgtgagcatgtggacctcgtcgatgatatagatcttgtacttgccgcgcaccggggcaaagttgacggagttgatgatctcctcgcgcacgttgtccacgccggtacggcttgcggcatcgagctcgtagacatccgggtggttgccctcggcaatgagctcgcactcctcacaggtaccgtcgggcatgcagccgcttgcaccctcggcgcgcgccacctcggcattgcggcacagcagcgccttggccagaatgcgcgccatggtggtcttgcccgtgccgcgcggtccgcagaacaggtaggcgtgggacaggcgcccctcggtgatggcgtgctcgagcgtcgagacgatatgctgctggcccaccacggagtcgaaggtgagcgggcgatactttcggtacaacgattccatgggtgctcccccgggtatactgagtcttgttgccgcgacggccatgcggtcgcacggcatactgcattccataataacccgtacggcgagcccgccgcgataggagtccaaagagcatggcagacgcagagagcaacctcgttccctccgaagcagccgaccaggtcgaggtcgcgctcgaggcgcaggcagcagccgacgacggcatcctgtacctcaacgagtaccagtacgaaaacgacctcgtcaccgacttcgcccgcctggttgcctcgcccaggcgtcgcggctcgctgtatgtcgccgcggcaattgccgcgctcatcggcatcggcatgctggtggccggcggcaactggatcaagttcggcgtcgtgctgatcgtgttcggcgcctttttggcctggtggagcaagaacctccaccacacgcttgcccgcgactttatcgatgccgtcgaggccgacaagtccatgggcggccgctaccgccgcgtcgccgccaacgagaacggtctgatggtctggggcaagagcggcaagtcgcagttcttcccgtttgagaagctcgaccacgtactcgacggcgagcgcatctttgtggccatgttcgccgaccagggcgtgacgatccccaaggacacctttgttcgcggcgatgccgagcagtttggcaccttcctcaaggcgcgcatcaacaaaaaactccgcattgagaccaaacgcaagaagatgaaagccgagaaggccaccgccgaggccaagcagggcgacaagccccaggagaccaaaggcaagcagcgcaagcagaagaagaacaagaagaagcgctaaggccaaaccagacaggcagcctcgcatcccgctatcctccccatgcacccgagcgtgctacactagcagcatctatgccaccgcgaacggctcggctccgcgcccgccactcgcaaacgaactttaaacgcacgagggttggccatgccgcttttctcgcaacataccgcccggttctcgccggacgttcctttggagggcaccagctctcgcgagctgctcaagcggtaccagccgctcgagacacttgcgaccggcggttttggctccatcgagatctgccgcgacacgcacctgcgccgccgcgtcgccattaagcgcatcccccttatcaacggcgccggcatgcccgccagcgacatcatggatgtcctgcgcgaggcgcacactgccgccatgcttcaacatcctaatatcgtgcaggtcatcgactttacgcacgacaccgcctatgcctacttggtcatggagtatgtcgacggtatgtcgctggccgagtttttgcatcgcgtggacggccactcgctcacctttgacgaggccgcggccattaccgatgccctgggtcaggcgctcaccttcgcccatagcaatggcgtactccacctggacattaagcccgccaacgtgctcatcgaccactcgggcaatgtaaagctcaccgactttggcatggcgcgactgtcgtccgccggtggctttggcggctcgcgcggcggcaccatcggctacatgccgcccgagcagctcgatatcgagaccggcacggtcgacgaacgcgccgatgtctttgcccttgcctgcgttatctatgagggcttgtgcggcagcgccccccttatagcggccacgcccgccgactcgctcgaccgcatcatcggcggcgccacctatcccagcgagctgataccacactttcccccgggagccgaggccgcgctcatgagcgcgctctcccccatgccgcaggaccgccccaacagcatcgaggcattttgcgaccaactccttgccggtctgggcagcgtgcgcgagggccgtcgcagtctggagcaaatggttggcgagctttcggatgacgagcaggagctcgacgatatcgagccgtcgtactacgaggacgacgccatcgaggtcgaccccgcgctcggctgggcgggcacgcgctggagccatgcgcgcgactacaccatgcacgctatctcggcgctaacgtgcggcacctttagctttttgctgatgcaaacggccggggtcgcggcgcttcccggcctggtcattgcggctatcgcgatcggagcggcggctggcctggccccccagatcggctcggccatctcggctgtgggctttttggtgctcatggccaacgccaccatgcaggcgcagggcatcctgtcgatgttgcccgtcgcggtgatctttgccgctgccatgtccggttggtggatcgcctggggtcgcaccgaggctgccgcgagcgccgcgctcacctgtgcactcgcgcttggctgtctgactggcaataccttcctggcagctggggtcgccgccggcgtcgcgtcattttggctcggcccggcaagcgccgccgcggcaacgggcatgggcgcgctttttgcccgtctggccacggtcgcgctttcagccggaggcgtgctggggctcggtaacgttgccgcagcgctgggagacccgctcctttgggctgcctttgtgctggtcgcggcaactgccgcagcgtcatccgcgctgctcaatgcccatgccaagcgtgccgatcagggctcaaaccttgccgcaatcgccgccatcgccgtcaccggcatcggctgcgcagcgtcgtcctgtcttgcacaccatatggaaattgccagccttgcagccgcggtcgccgccaaggcggcggttgcgggaatcctatcctctataatcgttgggatatgcctatatttgctcggataccaaagaacctatacggagagtgatctttcgtgaacttcctgaacatcttcgaggaccacgtggccggcatcttcggtgccacccgtgccccgttctcctttaagaagcttgccaagcaggccgctcgcgacatggaggatcagactctggtgattaacggcgtcaacacggcgccggcactctataccatcctgatcgccgccgacgacgatcccatgctcgccccgttctaccccgagctttcgcgcgaggtccgcgagtttgtgaaggcgcaggccgaaaagcgccgctatgtctttgtcggcgagcccctcgtgcgctttatgatcgatccgcagctgcgcgccggcaagttctcggtctttgccgagaacgtcgatgcccccacgctcggccgcctgtacgaagaagagcgcgcctatcaaaacggcctgggccagaacaactccgcggcaagccgtgccgccagcgccccgcgcgccggccagcagcagtttgctgccccgcagcagcagcgccccgccgccatgccccagcagcagccgacgcctcgcgccgccgctcccgacccgcttgccgtggcagaccccttcgcgcctagcgtccccgaccccgccgccgcacccatcccggtgccgcagaccgtctcgcgcgacgcgcttgccggcatgggcggagccgccgcgaccggtgccgccgtgggcctaggcgccgcagccggcatcgcctccaacatggcgagcactcgcgccccgcagcgcccgctcgcccagctcgtcgacgtcgtgagcggcgagagccatagcatcacctccgcacaggtgaccatcggtcgcgagcgctcagtttccgacattgccctgcgcgaccccaacgtgtcgcgccgccacgcccagctcacctttacgggctcggattggtcgatcgaggacctcaattccaccaacggcacactcgtcaacaaccgccgcattacgcgctgcccgctgcgcaacggcgatctgctgacgtttggcctgagcacctttgaatttaggggatagtcgcttatgaacatcgatatcgtcctttttgcaggccgcatcgtcctggtcgccctgctctatatcttcctgttcgccgtcatgaagaccggcgtgggacttgtgcgcggacagcgccgcgactcggctatctggacgatcgatgtggacaagggtccgcgcggcatccgcggcatccacgtagatatgctcggccccgtcatcgtcggtcgctcgccatcttcggacatctgcatcaacgaaccattcgtctcggcctcacatgcgcgtttttcgctgcagggcccggcgctcatcatcgaggacctcaactcgcttaacggcacgctcgtcaacggccgccagcttgtggagcccgcaacactgcgcgagggcgacgaagtccagattggcgatgtggtcatgaaggtgaaccgtcgatgatcgacgaggagaacaagtccgcgactatgaccgaggcaccggccgccgccacagctgcgccggcccacgccgctccggcggactccacacccgtggagcccgaggacaccgtgttctccctgcctctttcgcatgtaacgcatgatatttcggatctcgccgataacgaggacgaagaggatgccgtagcggcgcccatcggcgcacatgctgcggaacagcccacagcgcccgaagcaaccccggcgccggctcactttgcagagcccgtcgccgcggcaatcaacgagagcgctgcggtgtttgcggcacccgagcccgccgcgccggcgtttcccatagccccggcatccgaggttgcgcccgcgtctgcgccggcgcccgaggcagggccatcccccgaggacggccctgcacccaagatcccgcagcctgcgcccgcaagcgagtccgataccgtggccgagcccgccgcccagtcgcaaagcacgcccgcgccgtcgcactttgcgacgcccgagcctatagacgtcagcccgcaagacgacgagtcgaccgcccgcgcgtccgaggagcccggctccccggacaccggcgattccgaatcaagcgccgagaccgacaccgtctctcccggtgacacagccgagatcgacgttgccgccgttgaggccaagctcaaagaccccggctcgaccatgagctttgagcccctgaccgaggagcgcatcgagaccgactcgacctatgatgccggcaccaccacgcaactcatgtggggcgcccgctccgacgttggctgtgtgcgcccgcacaatgaggattcctacctggtgcagtcgccgctcttttgcgtatgcgacggcatgggcggtcacgccgccggcgaggtagcctcttccatcgccgtcgagactattgccaagacggccccgcagtccgccgacgcagcacgcctggccgcagccgtcgaggcagccaacgccgccgtaatcgaggcggccctgaacggcctgggcaagcccggcatgggttgcacggccacctgcgcctatatcgaaaacgacacgctcgccatcgcccacgtgggcgactcgcgcgcctacctgctccacgagggcacgctgattcgtgtgacccgcgaccactcctatgtggaagagctcgtggatgccggcgaaattacggccgacgaggcccgcgtccaccccaaccgctcggtcatcacccgcgcgctcggttcggaccccgccatgtacgccgaccactttactctgcatatcgaggaaggcgaccgcctgatcctgtgctcggacggcctttcgagcatgattcccgatagcgatatcgagaacattgccacacagtcctcgaccgcgcagatctgcgtcgacaacctggtggatgctgcgcttgccgccggcggtcacgacaacgtgaccgtagtggtcgtcgacctggtcgacgacggcgttatgcgcgaggcgcaacgcgtgcgtcgccgcaatgtcatcatcgctgccgtcctggcccttgtctttgtgctggcagccggcatctgggcctacacgggcatcaccggctcgtactacctggggacctaccagggcaatgtcgcagtttggcgcggcgtgcccggcaagccgctcggccttaagctccactggctcgagagcgaaacgagcatcaagctgtccgacctgcccgaagacacgcagaaccgccttaaggcgggcattccgcaaacgagtgtcgacgatgcgcaggacaccatttccaaataccgtcatcagattgacgaggagcagacccgccaggtgattgacgcgcaaacgattcgcgacaacaccgaccagggatcgacctccgagtcagattccgagaaaaccgccgaacagtccgccgaggccgaagcctccgacaagaactagaaagggagtgccgcttatgagtcgccgcaacaccgaaatgctcttactcatcgcctcggcgttccccgtcatcctgctgtatgcgatgtacgtgctcaccgcgggcgccgctatctcatttgagacgctcgccgtgccgatcggactctttgccgccttcgctgcggcgcacatcgccgtgcgcatcttggcgcccggtgccgacccggcaattctgcccatcgtctttgttctgtcgggcatcggcatcacgtttgtgacgcgcctggcgcccgacctcgccatctcacagctcgtcatcctgtttatctcggtggcgttgatggtgggaacgctcgcgttggtcaaaaacctcgacgtggtcatgcgctacaaatacacctttggcatcatcggcatcatcttgctgatgctgccgatctttatcggcaccacgatctcgggctccaagctgtggattcgcatcgccggctttaccatccagcccggcgagttcgccaaggtctttatcgtgctgttcctggccggctacctggccgagaaccgcgagctgctctctatttccaaccgaaagatcctgggctttaaagttccgcgcctgcgcctgctgcttccgctctttgcggtgtggggcgtatgcctgctcgtcgtcgtcttcgagcgcgatttgggctcggccgtgctgttctataccatcttcttgctgatgctctacgttgccacgggacgcttctcgtacgtcatcatcggcctcgcgcttttggccgtgggagccgtgggcgcctacaagttcctgtcgcacgttcaggtgcgtttccaggtttgggtcgatccgttcaaggacgcccagggacagggataccagatcgtccagtcgctcttctcgctcgccgatggcggtctggtcggcgttggtatcggcaacggcatggccaacaacatccccgtcgtcgagtccgactttatcttctcggccatcggcgaggaaatgggccttttgggcggcggtgccgtactcatcctgtttatgctctttgccgttcgcggcctgaccacggccgcccgcgccaagtccgaccttgccgcctttagcgcgaccggccttacggccgccatcagcttccaggctttcttgatcgttggcggcgttacccgcctgatcccgctgaccggcgttaccctgccctttatgagccagggcggctcctcgctgctggcgagctttatcatcgttgcgctgctgctgcgcgccggtgacgaggcaaccggacgcgaggccgaactcaccggcaccggcaccatggcagccatcaccgacgaccaggtcgcatccgccgcggccccgaccggcacgcgttttgccgcctcgtcctcgtatggtcgcggcaaccactccgccggctcgcgcatgcgccgtcgcctgctcgacacgcccgaatccggcgtgctcggccgcgtggcactcgccaaccgcctgacccgcgcggtactcgcctttacggcgctgttcgccattcttatcggcaacctcacctatgtccaggtcatcaaggccaaggactaccaggacatgccgaccaacaaccacaccatcgcccgctccaagtacatccagcgcggctccatcatcacatctgatggcgtgacgcttgccgagtcgctgcagcaggaggacggtacctacgcccgctcctaccccaacggcaacatggccgcgcacgtggtgggctacgtaagccagcagtacggcaccgccggcatcgaggccgtcatgaacgacacgctcaccggctccaaggattactccagctggaacaacgccatcgcgtcgctcgcaggccagacccagccgggcaacaccgccaagctcaccatcgactcgcgcatccagacggctgccgagcaggcgctcaagggctttaagggtgccgtggtggtcttggatccgcgcaccggcgcggtcctcgcatgcgccagctcgcccacctacgacaacaccaacatcgacgcgctgctgcagacgggcggcggcgaggacggctccatgtacgaccgcgccatggacgcgctgtacaccccgggttccacctttaaggtcgtcacgctttccgccgcgctcgagaccggcaccgccagccttacgagcacctaccaggcgcccggctccatggacatcggcaacgcgccggtcaccaactacgccaacgagagctatggcaccatcagcctccagcaggcgtttgccgtttcctccaacgtcgtctttggccaggtggccaacgaagtgggcgcaaacacgctcgtgcagtttgccaacgcctttggctacggccagaagctcggccaggacctgacctccgcggcctccatcatggccgacccgtcgctcatgaccgagtgggagaccgcctgggccggcgccggccagcctgtcggcatggaccacacgcccggcccgcagaccaccgtcatgcaaaacgccgtgattgccgccgccatcgctaacagcggcgtggtcatggacccgtactttgtagcccaggtactcgccccggacggaaccgtggtcaagaccacgcagtcccgctcgctgggtcaggccgtcagctccgccacggccgaccaggtcaagcaggccatgcttgccgtcgtccagtccggcaccggcaccgatgcccaaatccccggcgtcaaggtcgccggcaagaccggctcggccgagaccggcggcaccaacgtcaactcgatgttcgttggctttgcaccttacgattcacccacggtcgccatctcggtggccttggaggattacgacaagcatgacgtcgaggccgccaagatcgccggcatcgtcctgaccgcggcgcttgccgcacagggagcgtgatgcccatgaccgaatcggacacccgaggcacgccgcggccgaagagttagcggcaacgcgccacacggccccagcggccacatcgaaggtactacacacatcgttgagcgaatagttatgttaggagcaggaatggaacagagggtcctcgggggaagatacctcctcaaggataaggtgggaacaggcggcatggcgaccgtctaccgtgcgcaggaccaggtcctcgaccgcacggtagccgtcaagatcatgctgccacagtatgccggcgacgcaaccttcgccgcacgctttaagcaggaggcccaggcagcagccggtctctcctccccctatatcgtgggcgtctacgattggggcaaggacggcgacacctattacatcgtcatggagtacctgcgcggcaccgacctcaagagcggcatcaagagccatggagccctcgaccccaaaaaggtcgcgcagatcggctcgcagatcagctctgcgctttcggtcgcacacaagcacgagatcatccaccgcgacatcaagccgcaaaacatcatggtgctgcccgacggcaatatcaaggtcatggactttggcatcgcacgcgccaagaacagccacctcacgcaggacaacaacgtgctgggcaccgctcactacgtaagccccgagcagacacgcggtcaggacctgggccccacctcggatatctactcgctgggcgtcgttatgtacgagtgcgccaccggccgcgtgccctttgacggcgatgatgcgatctcggtcgcgctcaagcaggtcaacgagctgcccatcccgccgagccagatcaactccggcgtcgacgccgatcttgagcgcatcatcctcaagtgcatggaaaaggacccggcgaatcgcttccagacggccgacgagctgcgtcaggtgctcaacagctacctgtccgggcgcgccgtcaacatttccgagcccacgcgcatcatcggtgcccccggcgagctcggcgccaccaagacccgcgagctttccgaccagacgcgcgccatggttcgtcccgtctcgggcgtgagcggccagaacaccacccgtagcgctgtttcgggctccacgggttcctacgaggtcgagaagcccaagtccaaacagaacaagatcatcgccgccgtggtcgctgctgttgccgtcatcggcattgtggtggcctttgccacggggctctttggaggcgagcaggtcacggtgcccgacgtactgggcaaggaccagcagactgccgtggagctgatcaaggaggccggcctcgaggttggcaccgtcgatcagagctacaacgacgacgtcgacgagggcaaggtcgccgagcagacgcccaacggtaacaccaagaaggccaagggcacaaaggtgagcttggtgatctccaagggccccaagccttccgagaaggttgaggttccgcggctcgtcggtctgaccaaggaccaggcagaggcggcgctggcgagcgttggcctgaagggcaacgcttccgaggaggccaacgaggccgatgagggccaggtctttgagcagggcaccgaagccggcaaggaagtcgagaagggcacgaccatctcgtacaaggtctcgagcggcccggacaccacgtccgtccccgacctgaccgatatgaccgagtcccaggcgcgcaacgccctcgatatggcgggctttggcgtcgatgtgagttatcaggagaacgactcggttaccgagggtaccgtgatcagctggaaccccagcggcaagcaaaagcccggcgccacgatcaccgtcgtcattgccaagaagtccggcaaggccaccgtcccgagcaacctgtacggcaagagcatctccgccgccgtcaccgcgctcaacaacgccggcttctacaacattggcttctgcgaccagaacggcaaccccgtgagcggcaacgagagcgctaccgtaacgggtgtctcccccaccggcaagcagtctaccgacagcacgatcacgttgacggtcgcactttctggctcgggttcgggctctggctcgggcacgggtgacgattccggtacgaccaactagtcgccaccccaccgctcatcacggctctcgccgcaaacatattcgctcacaggcgcccgcttgctcccccagcaagcgggcgcttcgtttttgacatggcatgaaccagaagagcccggcaccgtggtggtaccgggctcgacaaatctcaggtgcccccgggcggattcgaaaactccccccgcggggaaatgagtgacgcgggtgtcgacggtccgaatccggtccttagaccagaagagcccggcaccattgcggtaccgggctcgataaatctctggtgcccccgggcggattcgaaccgtcgacacccgctttaggagagcggtgctctatcccctgagctacggaggcatgttgtactagtgtagcagatttgcgccgctgccatgcagcgcatagccactcttcgaagttgcggtggaatagccttcgggaaagcgcgtcccactatccaggcgaattctgggaccgactttcccaatggagtctctcaggggtagcgcgcagagatgtggtgtaagaggcggggcatgccccgcctcttctcggaaagcacattaagtgctttcctttgcgtgcggaactcgcgacaaacttaaccgccccgcccgacaggcgagctgcggagactagatcggtccagagcaatatcgtgcgaaaagaattctggctggtgatctgttcgcgctaaagactcaatagatagtcccctctatgcccatctctgtaagttgcggtgaaatagggactgaattatgggttgaaacgtttaaacagtccctatttcaccgcaacttatttggagatgaaaaaaggcgggggctcctggtggagtcctcgccttttgtacagggggcgatgttaatcgctagccgtggggttagaccagacgggcgttgatcgtcttggcgatctcggcggcgttggtggaacccttgacggtggcacggaagtcctcgtccatgagcgcctcggcgaccttggacaggatcttgaggtgcgtggtgccagcctgagcgcccgggatgagcagggcgatggctacgttgacgggagcaccgtccatggtgtcccagccggtcacgccggactcgtccttgacgacgatgacggcagcctcggtaatggcgtcggacttggcatgcgggatggcgaagccctccatcatgcccgtggtgccctcggcctcgcgggccaggaaggcgttcatcacggcgtcggcgtcgctggcgataccggccttgacggcctggttggaaacgaagctcagagcctcgtcacgagaagcgaagtcctcggcgacaaagacattctcgaccttcacgaagtcggcagcctcggccttgggggcctcgacggcagcagccttgggggcctcaacgggcttggttgcaggagcggccttctggttcttctcgaagtcgtacttcttgaagaccacgaacaggatgccaccgacaacagcgccgatgaggatagcgaggacccacagcggaccattctcgacaacgggcaggaccaggaagccaccatgaggcgccggatcgtgaacgttgaacataatggtcaggatcgaggcgatagaggaaccgagcatcatgatgggcatgacgggccagatgttcttggtcatgaacggaatggcgccctcggtgatgtgggtgcaaccaaggatgaggttgacgataccggcgtcatgatcctcctggctgaagtacttcttgccgacgacgacggcgaaggtggtgatcagcggcggaacgatgcaggcggcggagacggcagccatgaagttggtgccgaagttgtaggtgtcggtgccgacaccggcggccaaggcctcggtaagcatagcggtaccggtgacgtaggcagccttgttgaccgggccgcccatgtcaacggcgcacatgcagccgatggcaagacccaggacgatggcgccagaagcggacagacccttgaggaagtccatcatggcggtgttgatggcagccatggggccggagatgccgagcatcacgaggccgacgatggcagtcgagaacagcgggtacaggaagatggccttgaggccgtccaggttcttgggcagaccggcaaagaccttctcgagcagcaggatgacataaccagcgaggaagccgccgacgatgccgcccaggaagccgaagcccacgccagcgccgccagcgtcgatcataccggtctcggcgttaacgggcaggccctggatggcgatcataccggcgacgaagccggggacgagcgctgggcgcttgccgatggactcggcgatgtaggcggaaagcacgggaaccatgaggttcatggcaatgccgccgatgatcttgagcatagcggcgaaggtgttgtagtcagacgccgtcgaatcgaaggacgtgatgccccacaggaacgaaagagcggtcagaacaccaccggcgacgacgaagaccagcatgtggctgacgccgttcatgaggtgcttgtagataatgtggccgacggactccttctcctcgacctcgtcctcgacatcggcagcggcggcaaccgagtcgtcgcccttggcgcggagcgcgcggtcaatcagcttgccggcggcctcgacggacagggccttggaaacaccaacggaaaccatgggcttaccggcgaaacgctccgcctggacatccttatcggctgcgacgacgacggccttggcaccggcgatctcacccttcgtgagctcgttctcgacaccgacctggccatgggtttcgaccttaatggtcagaccgcgctcggcagctgccttctccagcgcctccttcgccatgaaggtgtgcgcgataccggtcgggcaaccggtggcggcgatgatgtcaaacttagccatgtgtccctccttcttgagttctgcgcccgcgggcgctcccctacacgcgcctcgtagcgcgcttttccacaactgaaagataccaacctaccgtctgcgtgagaagagacaaggcgcaattctccggtgaaaggttctttcataaccgtaaacggtaggtgaaagtttatcatcattgcttgaatcggcaaggtgtatcttgtaattgaaaatgcccgtatactatggcgtgcataccacgtctatttttcatgccaaccaggagccatccatgaccgatagcagcaagagcgcgctctccctcattagcacccataagggatacagcgaatccgagcagcgcattgtcgactatattctggagaaccagtccgaggctccgcgcctgacagccgcccagctctcacgagctgccgccacgtccgaggcgacggtttcgcgcttttgccgcaaactaggctttggcagcttccgcagctttcagttttcgttggcgcgtgacttggaaagccagcgcaacgagggcctgaccgacgaggtctcgctcgacaacatggagcagagcctcaagaatatcctagctgccaaggtgagcgagctgaatgcgacgatcgacggcatcgaccacgaaacgctggcagccgttgtgcatgcgcttaagaatgccggagttattgagttcgccgccgtgggtaatacgaacgccgtcgcgctcgatgcgacgtttaagttttcacagttgggcttacgctgcatggcgagcaccatcagtgaaaccgcaatcggctttgcgctgaccctgaagtctggcgacgtcatcgttctgatctcgaactccggtaagtcgcgccgccttaaccgcatggcaagggccgcacgcgaggcgggtgccacggtagtcgttatcagcggcgacagcaaatccccgctcgcgcgcctggccgactacacctttaatacggttaatcacgaggcgctcctcaccacgggcgacttcgcgttctctaaaatcagcgcaacgatgatcatcgaggttatctataacttcctgctgcccgaaatcgaagacgcgcgcgagcatatcagctactacgaggagctcatccagccggataaggtcgtggagtagccaacttggggaatagacagacgcctctcgtcacaaaacctgcccatctactacgttttagccgcaagcgccaaccatacacccaaaaaagagaaaaccgcaggcgttctacctgcggttttctttttgccaatattggcatggttggtggtacctcactaaacgtagtagatagccgcatttcgtggcgaacggccccgaacaagcacgtgacgggacttaattacccccgcgcctcttcgagcatctgcttcgcgtgggccaggctggcctccgattgatcgccgctgagcatgcgggcgatctcggcggtacgggcctcgccagtcacctcgtccagatgtgtctggggtacgtcgcccggttccttgctgaccacgtaatgtttgtcggccataacagcgacttgtgccaagtgcgtaacgacaatcacctggtgcgtggcagcaagatcggccagcacagcggcgagggcgcgcgccgtggaaccgccgacgccggcatcgacctcgtcgaataccagtgtatcgacaccatcggcgttacctaggacaaccttgctcgccagcatgacgcggctgagctcgccacccgacgcaatgcgacgcaaaggacgcggcgtcagcccggcgccgctacggtacagcagctcatagctcgaagggcctgccggagtccattcagcgcggggcaaatcgcgcgactcccacacgagctcagcgcttcccatctccaagcgtgccatctgacggccgacctcgtgacaaaaacatggggcggccgtgttgcgcgcacgcttgagcgccttggcagcagcaaatagctcgcgctcagcggcaccaagtgcttcacgcgacttcttgatttgttcatcaccatcgtcaacgagcgacagcagttcttgcgagcgatcgcgcatggcaaaaacatcgtccatagtgggaccccactgacgcagcagccccttaaggtcggaataacgctcacgcatacgggcgagctcacgagggtcaaacgcaacgccatcgcggtaaacacgcagctcattggcacaatcctcgagtgaaatgcaggcgtcagaaagtgcgtcggcgatatcgcccagcttgcgatcgacggtcgccatgcgcgaaagctcggctacggcgctgttcacggcatcgagcgctcccccttcggcagccaacgatgcatgggcctcgctggcagtggccaccaagacctcggcgtgttccgagcgcggcagcagttcctcaagctcctcgtactcacctggctgggggtcgacctcggcgatgcgctcgagggcaaagcgtgcctcctcggcgcgactcccctgcgcgcgtgaggcttcctcaacacggcgaagttccttggcagctgcacgagaggccttaaagcaagcgcgatatttgtcgagcgcctcgagtgccgagcgccccgcccaggcatcgaccatggcgacatggtgcgccggatcgagcaggcgctggtgctcgtgctgaccgcacagatccaccatcacgcccacacgctccgaaagctcacgcacgctggcgatgcggccatcgatcttcacacggctgcggccctcggcagaaaggctgcgctgcacggtgaagccctcggcatcgtgcggtccatcaaacagccgagcctcgacgcttgcaagcgcctcgccctcgcgcaccgtcgacgaatccgcgcgctcccccaaaatgagcttgagcgccgagagcagcgcggtcttgccggcaccggtctcgccggtcagaacggtcaagccggcactcggcaccagcgtcgcctcgcgaatgagtgcaatgttggaaacctgcagctcatcgatcatgacgaactccgtagaatacgcggctcaccgagttgtagaagctctcggggccgtagtcgagcagcagcacatcgccaggaccgcggcgcacagccacgctctcgacggtgccgtcgcaggtaatgaattggccgtcgatagcgattgccggcacgctcgggcggtcatcagacataaaaatttcgacgacgtcgctcggtgaagtcaagaaagcacgagcctgaatggtgtgcggcgcaatgggcacgcaaaccatgcccgcgtaatcgggactcacgatggggccgccggcactgagcgcataacccgtagagccggtcgccgtggacacgaccacgccgtcgccacgcagacgatcgatatggtgacccgacacggtaatgtcgaactcgaccatatcggacagcggcccgcgcgtcagcgccatatcgttgagggcaaaggcacgaacgacatcctttgtgccgtcgtcgcgtacggacacgatatcggcggcgattgtggcgcgacgactcacatggagctcgccggacagagcatcgctcacaacctgcaaaatatcgcgctcctcgggactggccgccgtcaaaaagcctaagtgaccataggaaagacccaggatggggatctcgcggtagttgaggatacgtgcggcgcgcagcagcgtgccatcgccaccgagtgtgatgaccaggtcggcgccatcaatatcgggcgtgctctgaatcttggagcgttgatcggccgcccatgcgacctcgtaaccctggcgcgtcagccaaagctcgagcatcaggccgctctcgacagcctcttgcttgtaataattgggaaccagaaagaccttcatagcgttgcagctttctcgctcaaaaccgatacctgggatcgcagttcatcatcggagcgttcgccggcggcaaacctcgtgctgtacaggaaaaactcgacattgcccttggctccatgaataggcgacacgcacacgtcgaccgggaacaggcccttagtggcaaagagctcgatcgccgccacgagcgtatcgacgcgcacggcagggtccgtcacgatgccgccctcgcccaccaacgccgccggagcttcaaactggggcttcacgagcgtgcagaacgagccgtcaggcgtcaggcacgccagcaccgcatcgataatattcgcgatgctcgtaaacgaaacatcgcatacggccaggtcaattgcactcgcatagccaagctcgggcagctgcgtcacgtttgtgcgctcgtggagcgtcacgcgttcgtcctggcgcagcgaccaatcgaactgggcacggcccacatcgaccgaaacaacggtcgcggcgccgcgcttgagcaggcaatcggtaaaaccgccggtagagcaccccacgtccaggcaggcaaggcccgtagggtcgatgcaaaacgcatcgagcgcgccctcgagcttaagaccgccgcggccaacgtaggggatgcgtcccttcacatgcagcggcaggcccggcgtcactttgagccccggagaagtcaggcgctcgccaccgctcgagaccaagccagccataagagtgcgaagggcatccgcgcgatcggcgcagatgccctgtgaaatcagttcgtcatcaagacgcacacgtttcatgaatgccatcaaccattcgtatccggagatgcagcctgaccatcctgggattcatttgccgcatcctcatcatattcctgttcgagcttatcggcctcacgcggcgtcaactcaaacttgtcgaccatatcgaccgcacgggagcccagctcaatcgcctcgtcaaacagatcgagggaacgctccagggacgtatccttggagcgcacggtagcgataatctggtccaagcggtccgaaatctcgtcgaagttgcgaacggaaccctctggcatgactactcctcgacagagtcgatgtcggcctcgacggcctcagcagcgtccatatcctcggcaagcacgccggtagcagcctgagcggcagcgaccttggcggcagcctcggcagcctgggcctcctcgcgagcgcgatcctctgccagcagctcctggtacaggtcctcgcccggcagttcctcgctgcgagcgatcttgcccagcacgccgttgacaaacgatgcggactggtcggtaccgtaagccttggcaatctcgacggcctcgttgatcacgatagcgtccgagacctcctcgtcggtgagaaagcgcatctcatagacggcgatacgcagcaggttgcggtcggcgccgggcatgcgcataagatcccagttcttggcgacggcgcgcagggcgcagtcaatgcgatcgatatgctcgtaggcaccgcggcaaagctcaagcgcataggggtcgaggggacccttcgagatcaggaaatcgccctcgaggacgcgctcgagcgggctgtccgtggcctcggcctggaacagcagctgcagcgcctgactgcgggcaagcgtacgcccgcgataaaccttaaggctcaaaggttactccttggggaaaacgaggccgtcgaagcaaacgtcaacgcgctcaacctcgacgcccacctgggcatcgatggcagcgaccacggcggcgcgaacggcttcggcgagtttcttgaacggatagccaaagaacaccacgacgcgcacggtgagtgcgagcttgtcgccgatgacctcggcctcgaccgccggctcggaagccggggccttggacgagagcatcatggagacaaggttggtggcaaggtccttgacgcccacggaggcgatgccctcgacatccgtgacggcgcgcgagacgatggcggtcagaacatcgggcgaaatgccgatgccgtcaatcttgatttcctggggcatgagtcctcctagaaaaattggttgctagacgcgggagacgaacttgccgtcgcgggtgtcaaccttgatgacctcaccctcgttgagatacatggggacctggatgacagcgccggtgtcgatggtggccggcttggtggaaccctggacggtgtcgcccttaaagcccgggtcggtctggacgatagtggtctcgatgaacatcggcggggtcacgcccatgagctcatcgtcggcgaagagcagctggcagatgtcgttctcgcgcagccacttggagttatcgcccaccatgtcctcgggaacgggaacctgctcgtaggactcattgtccatgaagatgtaatcggtgccgtcgttgtagaggtactggaactcacgggtggtgagcatgacgctctcgaacttagtgccggcgttgcaggtgttctcgacgacgcggccgctcttgatgtcgcgggtcttgtagcgcacgaacgcgccgcccttgcccggcttgacatgctggaactcgacgatggtgtagaccttgtccttaatgcggagaccgaggccgttcttgaagtcggcggtagaaatggtaggcatagcgacctttcttgttatgggcagaacgcacaagcgtccaaattacatacgaccgaaattatacacttgcagacggcgcctgcagcgagcgcataaaaagagaacgcgggacgcccgaaacattccggacgccccgccccaaactatctaccaaagtagattagcaatcgatgacgtggaggtcatgcggggtcttggtgaagggctcgtaaccgttctcggtgacgacgccgtagtcttccaagcgcacgccgcccacgcccggcaggtagacgccgggctccatggtgacaactgagccgacctcgatgatgttcttgctgcggttgaagttgggcagctcgtggatgtcgataccgacgccgtggcccaggccatggttgtagtaatcgccatagccggcatcgccgatgatcttcttggaaagcttgtagatgtcgttgccctcgacgcccggatggatggcggcaacgcactcctcgtgcgtgcggcgcacgagcgcatacaggtcgagctgctcgggcgtaggctcgcccatcacgacggtacgcgtcatatcggaacgatagtcgcagtaacccgcgccgtaatccatgaggacaaaatcgcccttctcgatcacacggtcgctcggcacggcgtgcgggttggcggtattggggccgctcgccacgatggagccgaaggccagactgtcggcgccgttggcgaacataaagttctcgagctcgttgcggacctgcttctcggtcataccgggcttaataaagccgagcatgtgctggaaggcggcgtcggtgatcgactgcgcatggcgcatgagctcgatctcctcggcatccttgatggcacgcatcttgcggatgtcatcatgcatcagcggaagcatacaggcgacggagcgatcctccaggccacgctggatgccctgatagaagttgatctgcatgtcgtcttcgacggcgcagacgcggcacttgttggccgcgatcttgccggcgacccacccggggatggtgccctcgtccatgtcgtaaacccaggggctgccggcgggcttgttctcctcaaagctgttgagatagcgcgagtcggtatggaacaggcactggtcggccgtaataaacgcagcgtgcgggaactcgaaggtatagtcgaagacgcccttcacgcccgtaagccaacgaaggttggcctcgtcgcgtaccacgatagcgtcgtagccgcgctcgaccatcagggcgcggacacgctcgatacgaccgacaggaccggcagcaaactcagacatgcagattcctttcttgttgtctcaataaagacgggacgggcctcaaccgggccacggaatcacgcgcgatccgtaaccgattggaaacccgcccctcaacatgatacgaaagacgatggatgtcaataaatcttagagaagttctttgcgagaagccaagtaggcctgggcgtgacgctcaaggacctcgtcctcgacgttcgtcagacggatggcgccaagcgccgcgggcagcggcaacatgctacggttcgagcgcgcaaactgctgtttgcggaactccgcaataaaggcggcgggctcaaggtcgaaggcgagctcctcgataccaaagtcctccaggcaatcatcgacctcaaagacgtaatcgatatcgaagtcgcaggcatcgtgggcgacacgcgcctcaaatcgcatgccctcggaaaggagctgataggcgggaacgtccgcagtggcttcgcccaggcaggcacgcagggtgcgctcccctgtcttgccaaaatcgagtgcatggcgcgcactcggattcgtggccatgagcacgtccttgcgcgcggtctgcgaccactgcacggcattgacgagcgcgacctcctcgcccgcgaggatctcggggacagtctcggtaaactgattccaacgcgacttgctgctcgaaagcatggtgcccacgagtacggcatagccgcgcttgaggtcctcggggtcggcctcgcgagcgaggtcgagatcacatacgaccaagcccggctcgggacggaacgcaatggcgggaagcgcattcgcggcggaagccacgagcggctccatagtcgtcgcgaccgtgagcatggcatcgaatgtcgtcggcagcaaggcgcactcggtgcgaccgcaccactggttggcacaccagcaaacgaccgagcaggtcgccgcgtcaccgaccgcgacaataagatcatcgctggtaatgccgttagccgacagggcaccaaagacggcatcggcttcggcaagcgtagcaccggcaggcgaaacctcgaggatgagctgcgacacagcaaacccggcatcgaccagtgcatgctcaacgacttcgtcaaaacgctcggatgcgagatcgctccaaaccaccatcgcgcgcttaggcttgcccacggccgaggcaaacatgcgcgacagctcctcgaacgcgcccaatccgacgcggacatcgacgctgcggttttggaaattgataagttgacggcgaatcatagcagtccacgctccaaaagcatctcggcacaaacgtaggaaacgtcctcgaaggacttattgcgaatatcaagggtaatgtcagcggcctgacgatacagcggacgacggtgctcaaacaggcgcgccgcatgctcgggcgaacggaaatcgggccgggtatcggagcggcgaatctggcgcatcgaatcctcaaagtcgccttcgaggtacacgcacgtacccatctcgtgcatcagctcaatattcaccggcgtctcgacgatgccgcccccgcacgaaaccagcaggctgcgctcactttggagcgaacgaagcgctgaggtttcgagctcacgaaagcgatcctcgccctcgatctcaaaaatctcggtcaccgacttgccacaccggcgcacaaccaagcggtcggtatcgatgaatcggcgcttgaacatagtgccgacgttgcgcgcgagcgtcgacttgcccgcgcccaaaaagccgataaagaagatgtggtcgcagccgtgtttggtgtgctgggacatggcgagacctattcctcgcagggaaggtcgcgcagggcccggcgctcaaagatacggaagatctgtgtataccacaggtcctgcgtggcctgcggcttaaccaggatggtgtcgacaccggcaaaattgccgctccacacgtccgtgtagagctggtcgccgatcagcacggcctcatcggccgtcgcgcccaggcgcttaagaccggccttgagagcaaacggcgccggcttcatggcgtggctgatggcctcgagccccagctcgcgcgcagacgccaagacctggtcgcgatgccagttattggacaccatgcacagcttaaagcccttggcatgggcggctttgagccaagcggaaaccgcggcgggaacctgctcggtatcgcgcggaaccagggtgttatcacggtcgagcaaaatggcgcgcttgccgtcggcccacagggtatcgaggtcgatgcggtcaaccgaggcaacgtatcgtttggggctaaaaatcctcatgatcaattccaagactgttggtgctcttcgtaggtctgcgagaaatactcctcgtcctgcgtaatgtagaaatacaggtcatcggagtcggtcggctcaagggtagccttgagcgcctcgagcgacggagagcagatgggcgtgggcggcaggccctcgtgcttgtaggtgttgtaggggctatcgctttgcaggtcgtcggcggtaacctcaccgccagtgacatacatcatggtcgcatcgctgttgagataacgcaggccatcgagcttgccggccaagcggttgtagaacaccgatgccacatgcgcacgctggtcggcgttgagaccctcgcgctcgacgatggaggcaaggttgacgatgtcgtagtccgacatctccacaccgtagcgttccttgatcttggcctcgcaaccggcaaaatcgagcgacttgtactcggccttaaactgatcgagcatggcgcggatcacatcatctgccgtgggcgaatcgcccaacgaatacgtcttagggaacaggaagccctcaagcgaatcgttcgcagcatccttcaggaagccatagtcatttacgtagtaggatgccttggcctggttaaggaagtcttccttagaaatgctgtcataagcctgtgccacacgatcggctacctggtcaacggtcaagccctctgggatcgtaagcgtattggatccggcgttggggccttccatcagctgctggacgaccttcgtcgcatccataagcgtggtaaacgagtaggtgccaggcttgagtgacatatcggcgttgagctttttgaccgccgcgtaataatccttgggattctcgacgatatgattctccgagagaatcgaggcgatcgtatcacccgaagcaccgtcgggaatcgtaatggtgacctgctgaccagccgtgacgttcgcatccccaccagtaaagaagcctttgacggcaggtacgacaaagaagacgatcgcaacaagggcgagcaccgccaccacgacgccgataaccatgggcaccggagagctcttcttttgatcaccacggcgagcgtgcgtgttgtagctcgaacgtgtcgcgggagccacaccgtgcgagccatgggcgcgatgcgcatgagattgcgattgagggacctgcgctcgttgcgtaggagcctgctgcttaaagcgagtgccgccagtgggctgcgtcgtacgagcagttggctgctgagtcgttcgctgggcggggcgggctgcgtgcgaggagggctgtgccggacgcgcaacaggctgagccgcacgttgcgtcggctgcgccgggcgctggcctgcctggacagagcgcggtgcgggctgtccctggcgattctgctggcgcggatcggaagcgctaggcatgctgaacctcctcgttattacgatcgagccacgtctgcaaaaacaggctggcggcgatcatatcaatcttgcccctcatctgcttttcgttgagtccctgctcgcgcaggattcgcttggcctctagcgaggataggcgctcatcctcaaactccagcggaagatcgagctcgtcggcaatcttttgcgccacggcggcgacgcgctcggcctggggaccgggctcaccggccatggtcaggggacgtccgcttaccaggatgtcgggctcatagtcctcaaccaggtaacggaacgtctttgccatgccagtgacctcggcagctgggagcaccttgacaggcatcgccatcttgccatcacggctcgagacggcgatgccaatcctggtctcccctatgtccagtgcgagcgcgaccacagcgacttcttaggttcttaggcgccgagcgcggtcttggcggccgcgagggcatcggcgataccggcagcgttcttgccaccggcctgggccatgttgggacgaccgccaccgcgaccgtcgaccaggcccgcgatctgcttgatcacgttaccggcgtggaaaccggccttgacggcatcgtcggagccggcggcgagcagggccggggtgcccttctcggtcacgctggcgacgacgcaggcgacgggaccggcgaccttctgatgcacggtatcccaaacattgcgcaggtcagcggcctcaaggccctgaagctcggcgacaacgagcttgtaaccgttaacctcaacggcaccctcgatggcgctggagatcgcatcggaggaaccaccggtgagcgccttcttgagcttgttggacgtctcgcgcagctcggcctgcaggttctcaacgcgggcgggaacctcgtcgacgcggcacttgagcgcagcggcggcggcgtcaacgagcgccaggcggtcggccatgtagtcgagcgcacccttggaggtcacggcctcgatacgacggacgttcgagcccgtggaggactcggaaatgatcttgaacaggccgatctcggcagtgtttgcggcatgcgtaccaccgcagagctcgcgagagaacggctgatcctctgcgcccacagagacgacgcggacgacatcgccgtacttctcgccaaacagggcgacagcgccggcggccttggcctcatcgatgcccatgacgcgggtcacgaccggcttggaagcgaagatctgctggttaaccaggtcctcgacagccttgagctgctcggaggacagggcctcgaagtgcgtgaagtcaaagcgcaggtgctcgggcgtcaccagcgagccggcctgggagacgtgctcgcccagaacctgcttaagggcggcgtcgagcaggtgcgtggcggtgtggttgcggcgcaggaagccacggcgttcggcgtcgagcgcggcggtcacggtagcaccgacggtcagcgtgccctcggtaacgtgtgcgacgtgggcatacaggccgttgtggttcttggtgtcggcaacggtcagcacgacgccctcggcggaaagctcgccggcgtcgccctgctggccacccatctcggcataaaacggggtgcggtcaagcacgacctcaacgtcctcgccggcggcagcggactcgacggactcgccgttgcgcacgatggcgacaaccttggcgccttcgacaacgtcgttgtcatagccgtcgaactcggtcgcggcaaccttgtccgaaagctcgacccacacgtcgttgaagctaccccaggcatcgcccttggcgttggcgcgggcgcgggccttctggtcctccatgcaggcggtaaagccttccatgtcgacgtcgtgaccggcggtgccggcgatctcaacggtcaggtcaatggggaaaccgaaggtgtcgtgcagcttaaaggcaacatcgcccggaagaacggcgccctcggcgagtgccgccagggcctcgtccaggtagacgcggccgttgtcgagcgtcgtggagaaacgctcctcctcggaggcaacgatgcccttgacgagcgcgacgttcttgagcagctcgggataggcctcgcccatctgagcgttgacctcgtcgatgaacttggtcaggaaggcgccctcgatacccagcagacgaccgtggaacacggcgcggcgaagcaggcggcgaaggacgtactcgcgaccctcgttaccaggcaggatgccgtcagagatcataaagtcgacagcacgggagtggtcggcaatgatgcgcagggagcggctggcgccggagtaatcgtcggcgtcataggtcttgccgctgatctcctcgcccagcttaatgaggtgctgcatcagatcgccgtcgtagttggcggtcttgtgctgcatgatggcggccatgcgctccaggcccatgcccgtatcgaggttgcggtgcggcagctccggcatagagccgtcctcctggcggtcgtactgggtaaacacgaggttccagaactccaggaagcggtcgcagtcgcagccgggcttgcagtcgggactgccgcagccgacctcctcgcccatgtcaaagtagatctcggagcacggaccgcaggggccggtggggccagcggcccagaagttgtcgtcctcgcccaggcgggagatgtgatcctcggcaacgcccagggagcgccacacgtcatgggtctcgtcgtcctcggtaaagacggtgaagtacaggcgatcgagcggcagcttgaactccttggtgatgagctcaaaggcccaagcgcaggcctgctgcttggagacgccaccaaaggagaagtcgccgagcatctcaaagaaggacaggtgacggccatcctcgccgatgcaatcgatgtcgttggtgcggacgcacttctggcaggagattgcgccgatctccttcatggtcttcttgccctggtaatactccttaaactggttcatgccggcgttggcaagcagcagcgaagggtcgtcggggacgagggacgaagaaggatagagcttaagaccgcgctcctcaaagaagttgaggaacttggagcggatctcggccgtagtcattgacgggtagtcagcactcatagagggaatctcctcggtttcacatcgaaacagttcaaacgtaacgatattaccatcccaccgcgcctgtgcaaaaaagagggccggcacaatgccggcccttcagcgaaattgcatgttagcgcgtatgaatgttagcccgaattaccccgctacttgtcgtcatcgtccatggagccgtcgatgccggttttggtatcgtcgtccgtgttggagtcatcgtccttggcaaaggggttcttgaagaagcccgtggcatcgggctgcagaccagagagcttaatccagggattatcgagctcaggcttgggcatggccttggcctcgggcgcagtctcgttaccgatgagctcggactcatagatgaacgtatcgtccccaagcgcgtcgtaggcggcgaccgggttgccctcggcatcgcgatacggcgtgcccttaaacacggcgccgtcataggccacaagttggcggccggtctcattctcgaagtagtacacgaagatacctttgagggccgcacacagcgggatagcaataatcatgccgatgggccccatgagtgccgagccaataacgagcgccgtgaggctcatgatgggatgcacctgcaccgagctctgcatgaccttaggcgaaatcacgttatcggtgacgttttgcgcgagcatcgtcacgatgagcgtccacaacgccaacatggggctgaacatgaaaccgagcactgtggcgattgccgcgctcacccaggggccgacgaccggaaccaaatgcatgatgccggtgaagatagccatgagcgccgcatacggatggccgatgatcataaaaccgataaaggcgaggaaaccgccgcagatggacgtcacgaccatgccacgcatgtagccgcccaccgagcgcgacagaatggcgaccataaagcggtacgaggtctctttttcctgaccgataatggtgcaaacctcgtggtgcatgcggggatagtcgcaggccatccagtaggcaagcaccagccccaggaagatcacgaacagctgcgaagccgtgttggtgataagcgggaacacaccgcggccgagctcggcagctatctgagacacatatttcgacgccacggtaacgagcgaggacaggttgttgtccagatactccttgagcggcgtgttattgagcgtcttagcgttcgaaatcatttcgttgaggtcgccgcccgcaacacgaagctgcccaggcagacggctcaagacctccatgatctggccaaacaagatcggcgacaggatgcagacgacaccgacgagcacggccacaaccacgatgagcgcgatgagcgaaccaatgccgcgattcacaccatggtgctcgagccagttggtgatcggcgacatcacaaaggcgatgatagagccaacggccaaaaactcgataaccggcgccaggatgcccatgaggttgaagatgacggcagcaatcgcaatgcagcctacaacagcccagatgcgcagggtcagaatacgggtatcacgcagtgtacggtcggtttgttgggggtgctcactcatgaacgaatcatcactccgtcgggatcgatcttgtcctggatctttttaagcgtgcggcgcagcagacgcgaaacctgcacctgggagatgcccagctttttggcaatctcgatctgggtcatgcccttcacaaagcgcagctcgatcacctcgcgctcacgcggcgagaaatcgcggatggcttcctcgatcaccagacggtcgtcggtaaagtcgagctcattgtcctcgtcggcataacggtcgagaatcgagggtgcgtcgtcggagtcggatgcccctggggcctcgatgggcaccgaagtgtaagccgaggacgattccatggcctccaagacctcgtcgacggtaacgtccaggtattcagcgatttcctcaaccttaggcgaacgctgtagctcgttagtgagtttgtcggtggcctggttgaccttagccgagagctcctgcagacgacgcggtacgcgcacgctccagcccttatcgcggaagtggcgcttgatctcgcccagaatagtaggcgtggcaaacgtcgtaaactcgagcccgcgctcgggatcaaagcgatcgatagccttgagcaagcccaggtagccgacctgcatgaggtcgtcgagcggctcgccgcgattcttaaatttgttggcaagaaaccttaccaggttcatatgggacatgacgagctgctcgcgggcgtccggatcaccggtctccttgtaacgacgaaacagctcgcgggttttctccttgtcccaagcggtcttaccgctccgggaacgttcggtcatattaaatatccgccttgaggtcgagggaaagcgttaggggcgccgaggtcttatcgtaggaatcgcacacgctcgcgagaataagctcggcatacaccgcagcttggtcatcttcatcgaccgtagcctggtcgccaaaggtaaaggtcatgccaacgtgagtttcgtcgacatcgaatgtaatggtgatatcgtcgcagtcgaccgcggtacaaccaaagatgaaggcctcctcggcagccatgcggatgtcctcgatgcgatcgacggacatagagcacagagcaccgacgttggcggccgtcatgcgcaccaggcgagcgagacgcgggtcgccggcaacggtcagcgtaatggggcaggttgcttcgctactcatcgcaggactcctcggaggtctcggagggcgtataggtgtaatactgagccggcttggctgcaggcttttgatctgcttccgcaccatcggcggcctcgtcctcggcctcgccaatcaggacgcgctcggtaggctgctcggcccccgcggcggcagcggcgagcttgcgctcggcgtcggctgcaggagccttcaccttattgaagagcttctgcacggcacctgcggcagaatcagtcacgctcgacacggcgttgctggcctcggccatgctaccggtgacctcagaaatgtcgcgaaccacggcttcgacctctacgagattggaggtaagggcatcaactgccgtcttactcgacttaagcagcggctccatctgggcaagtgccggcgtaagctcgtcgacagcgccgtcaagttttgccaccaccggctgcgcctcggcgatggtgttattgaggtcgttcacggtcttatcgagcgagtcgacaacgttgcgggtcttgcgcagggtaagcgcgagctcaacaatagcccacacgccggcaatggcaagcaccagcagggcgatttgaatgggactcatacaagcctcccgaaggaatcgaaatacagacgcctttcatggtaccccaaagaagggggaagatacccaaagggaatgtgcgaggtgccaaggacctacttgggcgcgttaccgctacggtcgcgttcgctttgctctacgcgccactcttcccagccgcggcccgcaggctgccagaacgcgccacgctccagcccctcgggcaaatagcgctgatcgacccagccttcgggataatcatgcggatacttgtatacaccgtattcgtcgctacctgggcgatgacgatcgcgcaaataactcggcacctcacgtaaaccgctgctatgaatatcggccaacgccgcgtcaatcgaggcctcacatgcgtttgacttaggcgccaagcacacatagagtgcagcctgagcaaggttaatgcggcactcgggatagccaatgacctcggcagacttaaacgcggcatgcgccaccaaaagcgcctgcgggtcggcgttgccaacatcctcagaagcgtgaatcataatacggcgagcgataaacttaggatcctccccagcatcgatcatgcgcgcgagccaatagatcgtggcatcggggtcactaccgcgcatagacttaataaacgcactgatgatgtcgtagtgcatgtcgccgtttttgtcatacgtaaagccgcgacgcgggttggcgatcttcacgtcatccacggtaatgggatagcgctcccccgccgcgggcgctggcgttccctcggtatcgggacgcgtgacggcaatctcgctcgcaagctcgagcgtcgtgagcgccgagcgagcgtcacccgctgccagcgtgcagatggtcttgaccgtatcctcatcggccgagaacttaccgttcaagccctgcggtgcctcgagcgcacgctcgataagcatggcgatatcctcgtcctttaaatgctcaagctccacgactcgaccacgtgagagcagcgccgagtttacctcgaagtacggattctccgtcgtagcgccaatcataatgacggtacggttctcaactgcatgcagcagggcatcctgctgcgacttagagaagcggtgaatctcatcgatgaatagaatggttcgacggtcgtacgtattcagacgcgtctttgcctcgtcaatcacgcgacgcaagtccttcacggtacctgtgacggcactgacctcgacaaactcgcttttggtatggttggcgataatatgtgccagcgtcgtcttgcccgtaccggcaggcccatacaagatcacgctcgacagcacatcgtgctcgatcgcagctcgcagccacgagcccttgcccacggccttttgctgacccacgtactcgtcaagcgaattggggcgcatacgcaccgcgagcggcgcattcttaaaggaacgctcacgcgtcgaggcagaaaaaaggtcgtccatagccatcccgtacatccatcaaaatcgttgttccccaacagtataccgaaaagatacgaactaccgttcgttaatataggtgcgatgcggaaactttagacccgggaacaacttgcttgtcagctcacagaagtagccgtccgtcatgctcgcgatgtaatccaccacggtttgatccttgtcatcccgccaggcataggtgcgatcgtagtaggaaagctgctgctcaatgcgcgaaatgtggtgtttaaagatgtaagaggactcatcgccttcgtttatatcctgcaggcaacggtcatagagcttttcgaacgcctcgcgcagctctgcctcggaatcgccctcgatgccgcccttgctgtagatcttctcgtagttctcgcgcttggcacggcggatctcctcaaacaggtcttcactcatctcgatacgcggtttgccgtagctatgttccacgatatcgatggatgcgtgcgtgaggatccagctgttataggcgccgccccggccatcgtcaaaagcgtcgggcgaaagcaggcctgccgcgatagcatcctggcgatcacgaccgacgtaggcaaggatatccgagatgcgcacgacgcagccctcgagcgtcatggggcgcagatgctcaatcgcgctataacccgtggcgatgcaatcctcgaccgtccgatcgagctggtcaaaggatgccatgctcgacagctcaaacacgcgctgctcgtactcgccgttatggcacagcacgccgtcgagcgtctggagcgatacgttgcgaccatacaacgcatcgagcacgcgcaccgactgcacgttatggaaaaagaagcgtccggtgcgctcgtgatagatatcgttgaggaagcgctcgccggcatggccgaagggcgtgtggcccaagtcgtgacccaggccgatcgcctcgatcagatcacagttgagccccaaagcacggccgatatcgcgtgcgatacgcgagacaagctgcacatgcagaccacggcgcgatagatcatcgttgctacgaaagctaaagacctgcgttttacctgcatatcgagtgtatgccggcagatggagaatcttttcggtatcgcgcataaagctggggcgcataagcgtgcctttgtccgcatcacgattgacacgacgaatgacctggtcatcgttgcaacgatacggattgaccgcgcccaaagcacgttcggcggcaatgcgctcgatgagctcggacgacaacgccgagggaatacggtccatgcgcgccttgatggcggccgtttcttgattagttgccatggcatgctccttaagaaggatgcgcaatcggttacagcgtgcagcccacgacctcgattatggcaaaaatcggcaccaaaaacggcagcaatggcagggagcgcgattttgtgatgaggcaggagagggctaggaccaggagagcagcggcaaatgccacgataccgcccatggggtcgagcgtgcaaagcgcgaagagcgccttggcgtctcccataccgatacccggggcctggcggaggcgccgccagagggactcagtcagcacgagcacaagatacacgatgacggcaaggcccgcgtggtcaagcgccacgtccgagccacgatccagcaatacgcccgcaaacgcagctacggcacaagccccggcgagcacattcgggaaccgacgctcacgcgcgtcgatgacggcgccagcgatggcgcacagccaaaacgggatatagaccatcgagcacctcctcgagccgcatctcaaaagcaaaacccccacaaaggtgtccgttccctttgcggtggttttggtgctggttatttggcgccctgcatgacctcgtcgagggtgacgctgacagcgtgctgcgtcggaacccagtcgaccttcaggaacagcgcggcaaccgtgatggggatatagctgaacataaagatcgggaaggtgaacaggttagtcaccaagcgccacttttgcgcgcagtgaatgtgcttgtactcaaagatggtcgtgagcagcgccaggataaagaaggtctgatacatcatcgcgaaggtcataatgagcgaggcggcacaagcctgcatctcgacctcggtagccaagaagccgtgcgagagcccgcccacgataaggaaggtcgcgttggcgagcatggagatcaaggacagcagcatgcccggcgcgatggtcataaacatatcgtaggcggcaaagcggcgatagcggaaggtcgacttgaccaggtgcttaccatacgtaaagaatacctggtagaaacccttggtccagcgcatacgctgcttccaagaggccttaaacgtcaccggctgctcgtcaaagaactccgccggcgcatagccgatgcgaatgccgtgaatggcacagaacgtggtgaactggatatcctcggtcagcgtgtggaattgccaaccgtgcatgccctcgatcacgctcgccgagatgaggtagcccgaacccgaaacggcacacgacgtcttgcagatattacgcgcgttgttgaggaagcgcgcctcgcgcagataccaggtagcgttggcggccgaaatccacgagctgccgaagttcttagagttacggtagctcgtgaccacatggaaaccctggtcaaaggcatcattcatcttggagacgtaatcgcgggagatgacgttgtcggcgtcgaagataaagtagccctcaaacgtgtcgggaaactcgttaaggatacggtcgaaaccaaagtccatgacccagctcttacccttgcgggccaggtcattacgctcgtagacgatagcgccggcctcgcgcgcgagctgcgcggtgctgtcggtgcaagcgtcggcgacgacaaagacttcgataagctcggacggataatcctggtccttaatggagcgcacgaggttggcgattaccgcctcctcgttatgcgccgcaatgaagaaggcgtagcgatggagctttttggccttgggcggcgcgacctcaccgcggagagcgccaatgacaaagaagaccacctgatacaggaagcaaaacgtgagcagcgtaaccacaatctggttaaagatcacgatgggcgtgttggtttgcaaaaaggcgagcatgcaggctcccgagaacgcgttacgtaaacaaccgtatatcttaccgcaggctaatcgagttcaagaaaccacctaatactggctaggcttcgagcagaccgagctgcggaacgatatcgtcgccggcttcagtgcggccaagcgagcgtggggccaaatcgtccaagacggcggcgagatcccacggcagctcgtcgcggcactcgatgcgctcgcccgtcacgggatgatcgaacgccacgcgccacgaatgcaggaattgcctggtcaggccctgatcggcgcgcgcatcgcacttgccgtagagcggatcgcccacgcaggcgtgattgatatggcgcatatgcacgcgaatctggtgcgtgcgcccggtaaacagatggcactcgacgagcgtatagccatcgtcaaagcgggtggaatcaaaacgctcgagaaccttaaaggttgtgatggcctggcgcgcaaaaggatcgtcagacaccgccatcttaacgcggtcgcgcgtggagcgggcaataccggtgttgatggtgccctcatccatggcgatgtgcccatgcacgagtgtgatatagcggcggtcgagcgtgcgcgtacggataaggttctgcagtgagcgctgggtgtcatcgtccttagcggcgagcatgaggccagaggtatcgcggtccaggcgatgcacgatgccggggcggtcctcgccctgcacggtgcccagatggtcgataccgcagtggtaaaccagggcgttggcaagcgtaccgctctcatgaccatgtgcaggatggcacaccaggccgcgctgcttggagagcacaatgagatagtcgtcctcatagcgaatatcgagcgggatggcctcgggaatcacatcggtgggatcgtgtggctcgggcagatcgaccgaaatacggtcgccgactcgcacggcgtactttttggacaggcaggtctcgccattgacacatacggcaccgccctcaatcagatgcgcgcaggcagagcgcgtgggacagccatcgttggcgcccagataggcgtcaagacgctgaccagcggcatcgtcggcaacaaggatatggatgtcggccattagcgctcattcctttcgcgaatcttgcgggcacgctccccacgttgtttagccttgcgcttggcgcgggcctcgtcacgggcgttaagctcggcggtcgcatcgacctcacgggccgcggggctcaagaacatgtaaccgaagagggcgagcgcgacgcccaaggtaattccgatatcggccacattgaagacggggaagtcgatgaaggtggtggcaataaaatcggtcacgaagccaaaggccaaacgatcgatagcgttgccgatagcaccgcccgcaaccatcgccatgcccacaacctcaagatgggcgagctggggcgcacgaacgaggtacacggcaatagcgataatgaccgccaacgccagcacggcaaacgcgatgccatgcccctcgcccatgctaaaggcagcaccgatattgcggacaaacataaagtcgatgacaccggggataacggtcacatgcaaagcgtcgcccacggcacgaaccgcaagcttggtcagctggtcaacaagcagcacaaccagcgccaccccaccagcaacacccagccgccaacgcaaaggcggcgtcatatccccagtacgacccaaagaaatcccctaccctcaaaacaatcgaattccgtttaacgcactaaataatcatacattgacgcaagcaagaagcgacaaatctcccaagaacggaaacaccgcaggtagagcataaatgagcgagcgggtcgcatttgagacaaggtgacgtgaaatgaaagggcgctgacctttcggtcgcgcccttgaaattgaacgtcagattgtccaaatgcggcccgcgcagcgtcggcaggtccgccgttcggtagaacggcggaacctaaagggcttcagcgcagcgcttgcaaatgtgcgcgtggccgttgtactcgccgacggtggtgcggtagttccagcaacggtcgcagcactcgccctcggcagcctcgatagcaacggaaagctcctcgccctgggtcagctcaacatcggagacgatgtagaactcggccaggtcgacagccttgtcaccggtcagcagcgcgtacatctcggcgggaacgaccgccttgacgcgaacctgctggctcttagtgaaggtgccggcggagcgagcatcctcaagggccttggtcacggcgctacggagctcgagcgaagcctcgagcacgccctcaaactcattggcctcgtcgaccgtgatgggcgacttgtaccaatcgagcagcgcggcgtacttctggtgatcgacgcagccggcgggcgcataggccatggcctcgtcgaccgtgtaggacaggatcggctgaaggtcgcgcatgagcatcgagaagagctcggcgagcacggtctgggcgctgcggcgctcgagcgagccgtgcttctcgcagtacagacggtccttcagggcgtcgaggtacacgttggagagctcggtaaccacgaagtcgtagagcgcgcggtaggcacgcgggaactcgtagctggcgtaggcatcgtcgacctcggcctgaacctgggtcaggcgggcaaccatgagcttgtcgagcggcagcaggtcggcaaaggcgacgccgtcggtctcgggctcaaactgaccctcgagctcggagagcaggaagcgcagcgtgttgcggaaacgacggtaggcatcggacgtacgagcaaggatctcgtggtcgatggacacgtcggagctggtatcgacggatgcaacccacagacggatgatgtcggcgcccatctcgtcgcagaccttgttggggtcgatgacgttgccgagcgacttggacatcttgcggccttggccgtcgagggtgaagccctgcgagacgaccgccttgtacggagcgtggccgtttgcacccaccgaggtgagcagcgagctctggaaccaaccgcggtgctggtcggagccctcgaggtacacatccgccgggtactcaagctcggggcgatactcacagacggccttccaagagacgccggagtcccaccacacgtcgaggatgtccttatcggccttgaggtgatggccgccgcacttggggcagacgcaggcctcgcccaggtagctctcgggagcgtcggtgaaccaggcgtcggagcccttctcgtggaagagcttgatgacggcgtcgagcgtagcgtcgttcatgaccttctcgccgcagtcggcgcaggtgtagctcgggatgggcacaccccagttgcgctgacggctaatgcaccagtcgggacgctgctcgaccatggcgccgatgcggttggcggcgtgagccggataccacttgacgttctcgcggacctctttgccagcctgctcgcgcaaaccggtcttgtccatcgagacaaaccactggtcggtagcacggaagagcaccgggtgcttgcagcgccagcagtgcggatagctgtgcgtgatcttcttctcgaggaccagggtgccgcgctcgcgcaggaactcgatgatgtgcgggttggcctcgtcggtatccataccgctgaaggggccaccggtgccaaactcctcgccggtatagaacttgccgtcgtcatcgaccggcatgcagatgtcggtgatgccctccttaaggcaggcaaagtagtcgtcgacgccgtggccgggcgagttgtggacgataccggtaccgtcatcgacaccgacgtaatcggccagcagtgccacgccctcgacaccgtcaaagatcggctgcttgtagtgaatgtggtggaaggtctcggcgggaaccacatagggcttgccgtcgaccataaccggggtgtactcccagccaaactcctcgcagcacttgggagccaggtcctcgagcatgacctcggcgcggccgtcgtgctcaacggcgacgtaggcggcaccgggcttgagggaaacggcctggtcggaggggatggtccacggcgtggtcgtccagatgataaagtcgaccgggccgtcgaagttctcgaggccggcgggcttggaggtcatctcgaagcgcacgaagatggaggggctcgtctcgtcggagtactcaatctcggcctcggcgagcgcggtgtggcagtgcttgcaccagtgaacgggcttgtgaccacgatagatcatgcccttgtcgaacatggccttgaagacctcgatgtcggcggcgtcatgctggtgatagagcgtcagatacgggttgtcccagtcgccaagcacgccaaggcgacggaagccggccttctgcaactcgatgttctcgacagcgaactcgttgcagagctcacgaatcttggccgtgggggtctggttgaacttctcggtgccgagcttctcctcgaccttgtgctcaatcggctgaccgtggcagtcccaaccggggacataaggaacctcatagccctgcatcatccagtagcggttgatcatgtccttggagatcttgttcatggcatggccgatgtggatcgggccgttggcgtacggagggccgtcgtgcagcacgaacttcttatgcccctcgttcttctttagaacttgctcgtagaccttgttgtcctgccagtccttgagtcgcttgggctcggacttggaaagaccggcacgcatgggaaatccggttttgggcagattcatcgtctgcttgtactcgtttgccacggtacccctttcatgtcgtgggcgcgcacgccctctgggcaccaaaaaagcgcccgtccctacaagctgggacgaagcgccacaaaacaggcagtctgcccgtaaaagctcttcgcttaaccacccagcttagatgccctcgcccgcgtattcgcgcgctcgcatccgttactcggctggcctgtatcgacggccatctcggcgatgtctactaagacgaacctgcgcggcacgtccgttgggatcgcagctccggggtgattttcatcggtcgcatgcacgggttctcagcgctccccgctctctgtggcatgcggacggccgactactcgtccccatcaacgcttatgcggagtatgctagcacgttccgcgccgacgaaaaaccctcaacactggttttatacgttcgaaatttctcgcggctgtggaccttctcttggagcaaaatacctgaaagcactttatcgaacgaaagaaggttgctatgcgcacgattggaatgagcgactacaccgttggcgaggattgctttgacgagctgcccaccgcactggcggagtacggagcgaccaaggtcgcgatcatcggtggcaagcgagcactggccgcagcacttcccggtatcgaagctgcgctggcgggtaccgacgtcgaaattctggagacgcgcgtctacggcaccaacagtacgcgcgcaaatatcgccaaggtcgtaaactcccccgcctgccaggaagctgacgtgcttatcgcatgcggcggcggcaaggcgctcgacaccgtgaagaccgcagctatcgagctcaagaagatcgtctttacggtcccgacgatctgttccaactgctccgccgcaaccgccattgccgtcgtgtacaacgacgacggctcgctcgagggctattcgtaccccaaccgaccggcgcacatcttcatcaaccccaagatcatcgccgaggcaccggcagagtatttctgggccggcgtaggcgatgccctgtctaagcagcccgaggtcgagtacgccacgagcgccggcaatttggagcacacggcaggccttggcttggcactcgcccacacctgttccgagccgctgtttacctatggcgtccagggtcttgaggacgtgcgccaggacctgtcgagcgaggctgtcaagcagatcgcgctcgacatcgtggtcaacacgggctatgtctcgaacctgaccaaccagaacgattactactacaactcgagcgtggcgcacgcgttctacaacgccacttgcagcattccgcgtgagggcacctacctgcacggcgaggtcgtgagcctgggcgtgctcgtgttgttcgcctacacgggcgacaccgagaaccttaagcgctacgctgcctttaacaagcagatggggctgcccgtgacgcttgagcaggtcgggctttccgagtccgatatcccggccctgtgcgagtacgcgcacgccaccaacgagtggaagcaaggcaacccggagcccttcaccgacgagaagttcgccgccgccatcaaggccgccaacgcctacggacacgcgctctagctctaacccaaaaccaccacaaaggggacaggcacctttgtggtggtttttattgctccaccattcagttcgtactcgaacccggttctttacgagaaagggttcgcgtacgttttttgtttatcggaaattctgcggaagcactactcggaacggtaaacaggaacgaacaaaaggcaggatatcatcgtggtgatggtatcctgccttttgttttgcgggatcaaggtcgctttgtgcgaacttgatcgccactaatatggcgcattgatggcaattgctgcgtacgtgcgcaccgggagcctgtacacctctggcaaggcgtaacacactagactttgttccagagtccgtgtgctaagggggcagggcccttagaattcctgtggagtgtgtacgcacgtacgcaggaaaacagcaaattacgctatatcagggcgttctttcattggagagtatggtatacacggcttagttcaacaaataagaatttatatataaaggagaatattgatgaaactgtttttatgttcgcacttttcaagtgtaggaagtctgataaaggaagaaattgaaaataaaaaagtcgcatttattccaacagcttcgctgcgtgaaggctacaccggttatgtcggctcggctcgaaaattattcaaaaagttgggagcaatcgtaactgaaattgatatttcaacggaggcttattcaacgatacagtctctttttgaagatgcggatgtgatctattttaccggcggaaattcttttttccttatagaccagctccgtaaaacgggaacggatgagctgttgaagaaagaattggcaaagggaaaactgatgattggtgaatcggcaggtgcgattgtatgcgctccaagcatccagtatatcgagcaaatggatgaaaagccggaggactactcacaagaagatgatgcagggcttaatttgattgatttctatgttcttccgcattttcttacagcgccatttaagaaagttaccgagaaaataatgactgagttttcagatttgaatctatgcccaattaacaatcgtcagggaattgtaattgatggtgaaggttcaaaggttatttgcaaagactaatttaaaagtccagtttgctgcactcgttcctagcagggtttggggcaggagggccttgtacgcgttcctgcgcgagggccgcggggagggactgcctgggtacggcgcctgtcaactcggtctacgtctttgatgaccgggtcgtactcaatatcaacttcacggatgatgccaaaacggtcacccgtgaggaagtgttgggttcgagtgctgtggataatgttccaacatgctgggatcgaactcgctagccggaatcacgcggtacccgtgacgcagcagcaggtcgacgaaaacaccgttgcccggagtgagcgtgccgctgaaggttccgtcgtagatacggccgacgccgcacgaggggctacggtcctgcaagacgcacgcagcgatctcggacgggccgcccgcctgctcgcacatgtcgagcgcgcgctcggcacccaggcgaaactcgcgatcgactgaggtaccctcgcaggtacggacctcgccgtccacaatctcggaaggatcgcgcggtgtgggcaggccgccaaaaacctcagggcataccaacaggacctcggtccccgtgcgctcgcaagcctcgaccagctcgcgatgatagttgtcgagtccgttatacttgcagctctcgcccatcaaacaggcgctcaccacgatcttcatatttaactctccccacgcaaaacgccccatttgagatagaagctcaaatggggcgttcgatgctgtgtaaccagccttactgctgcttcggcatcagaggattctcgcgcgtgaggagattcatgaactcctcgcccgtgatcgtctccttcttgtacagataacgagccagctcgtggagcttaaacttgttctccttcagaatctgcagagcgcggtcgtgcgcatcctcgatcagcttggcgacaatcgcgtccacgcgctcggccgtaccgggggcgcaggtgagcgacgtgtcctggttgaggtacgcattctgaacggtaccgagcgccatcatgccaaactcatcggacataccaaaacgcgtcaccatgttacgggcgagcttggtggcctgctcgatatcgttggctgcgccggtcgtcatctcgccaaagatgagctcctcggctgcacggccaccgcaatagacggcgagcttgtccaggacctcctggcgtgtggtcaggaagcgctcatcctcctcgacctgcatggtgtagcccagagcaccgctcgtgcgcggcacgatggtaattttcgtgaccggcgcagaacccttttggcgggcagcaacgatggcatgaccgatctcgtggtaagaaacgacctgcttctcgtgatcggacagcaccgtggacttgcgctgctgaccggcgatgacgacctccaccgactcctcgaagtcgtcctgggttgcacgcttgcgaccctcgcgaacggcgcgcagggcgccctcgttgatgatattggccaggtcggcacccgaggcgccgggcgtggcacgggcgatcgcagtcaggtcgatcgggggctgcgtcttcacgctcttggcatggagctcaaggatgttcttgcggccggtcaggtcgggcagctcaacggggatgcgacgatcaaaacggccggggcgcaacagggccgggtcaaggctgtcgggtcggttggtagcagcgagaacgacaatacccttgtggttatcgaagccgtccatctcggtcagcagctggttgagcgtctgctcgcgctcgtcgttgccgctaaagccgccgccgtcacgctttttgccgatggtatcgatctcatcgataaagacgatgcacggggccttttccttggcctgcttaaacaggtcacgcaccttagcagcgccgcgaccgacaaacatctcaacaaactccgagcccgaaatgctaaagaacggaacaccggcctcgccggccacagccttggcaagcagggtcttaccggtacccggagggccgacaagaagagcaccgcgcggcagcttggcgccgatctcctcgtagcgctgcggcttctccagaaagtcgacgacctccttaagggattccttggcctcttcctggccagcaacgtccttaaaggtcacgcccacatccttggaagcgataacgcgagcaccggacttgcccagtccgccgccgccaaaaccaccgccgccaaagttcatcgacgggccgtcatcgcccatggccttcttcatgcggcggttgagccaccagccaatcaggaagaaaatcaccatgggaagaatgagggtgagcaggtagtaagtcatcagacccgagttcttatcggggacaacagattccagcgaggcgccggattcaagcacgcgatcggtaaagcccgcatcgtttggcacaccgatcgtcttgtaggcgatgttctcgtcctcgcccttcttggtgtaataaatcgtgtaatcgtccgtattgtattcgaccttgtcgacactcttcttatcgagcgctttgacaaaggtcgagtaatcggtcttcgtaatctgctgcgtgtgaccgatgttggggaacagaacggtcgagagcacgaggtagacgacgaaggcgatgagcacgtagaggatcatattccgtctacgtttgttgtcatccatctccatctgcttgaactccatctactggggttgataatggtttctagaatacccaacccgagcgacgataaaccgacgccgggcacgaaaggacagagatggcatcactggaagtcggcaaggttcagatctacacgggcgacggcaagggcaagacgacggctgcgctggggcttgcactgcgcgccacgggctatggacttaacgtgcttatgctgcagtttgccaagaagctgcactgcgccgagcatgatgcggcgccccgtttaggtctgcgcatcgtacaagccgaccgcgacacgcccgaagcctgtgccgcacagatcatggagctggcgcgcgagcagattagccaagtcgacgttctgattctggacgaacttggcgaggccatgcgccgtggatttgtgacgcgcgtggatgtcgaagcgctgatcgcgacaaagcccgccaccacggagctcgtgctcaccggccgcggtctgctgcccctcgccgatctggcagacctggtcaccgaaatgcgccccgtcaaacattacttcgacgaaggcctcctagcccgccaaggcatcgaatactaaatgatccgtaggggacggaggaaaacggatcattaggcggtggcgcggccgagccagttgccgctgtggtggtagatggtaaacatcgtggccgtgatgagccaggttacggggtaaaccagcagcaggtgctcaagcgacggatcgaacggcataatcgcaaacacccagatcaccctgagcacgacggtgccaaaaatcgtgagcatcataggctggaagctcacgccagcgccgcggatggagccggacgcgttttcgataatcgagaagatcgcgtagaacggcgcgatgaaatgaagaatcgtcgtggtgtaggccgaaatcaaagcatcgtcgacaaacagacgcgacaacggacccgagaacaccagtagcacggcagacaggccaccaatgagcataaacgacagcacaagcgacgtatggtagcccttgcgcatgcgctcgtagttgcgcgcgccaaagttctgtgccgagaacgtggtgatcgaaacgccaagcgcctcggtaaccatccagacaatgccatccaaacggcccgaaagaccccacgccgtggtgacatcggcaccaaacgagttaaccgacacctgaatcaaaacgttggaaatcgaatacgcagcagactgaaagccaagcggcagaccacacgagatcatgctcttacaaatgccaggatcaatgcagagtttggacagtgaaagccgccacgcacccggagcgtgcatcatacgaatcacgatcatcgtggcgttggagcaaatggtcagcgccaccgcgatgccgcagcccagagcctccatatgaagcacggcaacgaagatgacatccagcaccgcattaacaaggcagccggaagcaatgatcacagcaggaccgcgtgtgtcgcccacggcgcgcagcagcgccgttcccatattgagcagcagcgccgcaaccatggcggcaaaatagcaacgagcataggccacgccctcggccaatagttcatgcggcgtgttcataagtaccagcatgggctcaacgaacactatgccaagaatcgagaaaacgataccgcccaccagcgcgagcgtcatggccgtatggaccgaacgactcaatcgctcatcatcgtgctgaccaaaatactgaccggtaatgaccgcgcagccagcgccaacgccaacgcaaaagccaatgcagagctcggtgagcaccatcgtggcttgaatgccacccagcgcgagcttgccgccaaactggccgacgatatacgtaccaataagcgtgtaagcctgctgaaaaaacgagctaaagaagatagggacgcacagcgacagcagctgttgccaaatgacaccctgcgttacatcgatagccgtagatttcttagccacacgccctccccaccagcgtacgtcaaacaacaaaacggcaatttaagaccaaagccaataccagcttagcaccgaccgacgtcggccgaaacgccccgaaccagagcccggtgctaactatctgcctagtgatacagccccggctggtagtggtactcgttgctcacatgcgggcacagctgccaaaaggcaacagcgcttgccgcagccacgttgagtgaatcgaccccatgcgccatcggaatacgcacggcgcggtcgcagcctgcaatggtcttggcgcccaagccagcaccctcggtgcccataaagattgccaggcggtcaatctcctggagcgcgggatcgtccagcgacaccgaatcatccgtcaacgccatagcggcacacgaaaagccggcatcgtgtagcgccgccagcccatcatgcggccatacgcgcgcttcgctgccaatgcgtgtccagggcacctggaacaccgtgcccatgctcacgcgggccgagcgacggtacagcggatcgcagcacgtagggctcaccaaaatgccatcgacgttcagcgcagccgccgagcggaaaatcgcgccgacgttggtgtggtcgacaatgccctcgagcacgcacacgcgcaccgggcgctcccccgccgcatcgacgacgccacccaagaactcggctaccggaatctgacgtggacgacggaatgccgcgagcgcaccgcgcgtcacattgaagcccgtcagccgctccataagctccatcgaggcaacgaacacgggaaccggacccgcgccctcgcgtaccgccaggcgctcaaacagcggcatcatctggtcgagccagcgctcgcccaaaagaaagctcgccggctcgtatccggcgcgaaccgcacgttcgatgaccttggcactctcggcgataaaaatgcccttctgcggctccagcacgcagcgcagctcacgctcggtcagtcgcacgtaggcatcaagccgctcgtcctcgagcgaatcgattcgcagcacctcaacggcatcagtcatagcagccagcccgcacctttctttacagcgcatctataccaaacgaggcgacgctaagcgccgccccatgcattcaaacaatccgatgataccgttcacgccggacgatttacgcctcaacgcgacgatacgttacgaactcataatcgacaccctcgtcgccctcgcccgaggcaatcgtggcaacaccgccacgccgcgcaatctcccacgcgggatcggcatccagatcgggaaaatacgtatccacgtcatgcacgcaatggttatgcgtaacctcggcctcggcgcaatacggcaaaaactgccgatacacctcgccgccaccgatcacccacgcaacgggctcatcggctaccgcggtgagcgcttcgtcgacgctatgcaccacgtcgacgccctcggcagcaaagtcctcatcgcgcgtgagcacgatattacgacggttcttgagcggacgcccgccgggaaaactcagcagcgtcttgcgtcccataatgaccgggcagcctttggtgcgcgccacaaaatgacgcatgtcggcgcgattagacacgaccatgtcaccctcgcacccaatgccccaatcgtcacacacggcgacaatggcggaaagcttacacgtcatgcgcgtcacctacaccgcaatggggatgttcttgacctgcgggccgtgctcatagccctcgacgatcagatcatcggtcgtaaacgcatagaagtcatgtacatcggggttgagcgttaccttaggcgcggcaaactgcggacgctcgataagctcgcggacgatatcgacatgacggtcgtaaatgtgggcatcggcgatcacatgcagcagctcgccgggaatcatatcgaccgattgcgcgaccatcatcagcaagatggcgtactggcacacattccagttgttcgcggccaaaatgtcctggctgcgctggttgagaatcatgttgagcgtcggtttgtcatcctgcgggcgctgcgtcacgttatacgtcacgctgtaggcgcacggatacaggtgcatctcggacaggtcgctaaacacataggtattcgtcataatgcggcggctgtacggcgtgttcttaaggtcgtacagaacgcggtccatctggtcgaaatcgccctcggcataatggctcttctgcccaatctgatacccgtaggccttgccgatggaaccggtctcgtcggcccactcatcccaaatatggctgttgaggtcatgcacgttattggacttcttttgatagatccataggatctcatccatggcagatttgagggccgtacgacgcagggtaagcgccggaaactcctcgcgcaggtcgtagcgtgccgtgacaccaaagtttttaatggtataggcaggggtgccgtcctcccacaccggacggaccttttggccctcggtggtggtgccatggtccagaatatcgcggcacatggttacaaactgttgatcagccttgctcattgaccctcctgtcagtcgcctacaagcgagattcattgtatcccaggcacatgcggccccacagcccaaacatatgccttcattttctggcatatgccagaaattccttgcgtaaatctgcgcgttcgctattctattgttgacatatgtcagataaggagcacgtatggcaggaagacgcgaaaaattacgccgtgttgggatcatccccgaatatcgcggctttacccccgacggccttgccagcggagacgccatcgagatgacggtcgatgagctcgaagtactgcgcctgtgcgacctggaaggccttaaccaagaggcagccgcacagcagatgggcatcgcacgcgccacggtggcggctatttgcagccgagcgcatcgcaaggtggcaaacgcgttggtcaatggacgggcaatcgtcatcgaaggcggcaatatcgcgtactcccccattaccacggcaacggccgtatggccagcaaaggagatcgacaccatgagggtggcaaccacgtacgacaacggcaacatctttatgcactttggccacagcgagcagttcaagatctacgacattcaggatggcaaggtactcaacgagcaggtcgtgggcaccgacggcaccggccacggtgcccttgcgggcctgctcgacaacggtggcgtggacacgctcatctgcggcggcatcggcggtggcgctatcaacgcgcttgcccaagccggcatcacggtgtacgcaggagctcagggcagctgcgacgcttgtgtcgaggcccttatcgccggaacgctcgcacagaacggcgaggccacgtgcagctgccacggccatgaccacgaccacgcccacgaacatggcgagtcctgcagctgccacggccatcacgagcccgagggccatgagggctgcggctgccactaacggcacggcaccgcgagctcggggcgcgacgctgaacgcagcccaactatcaaagccaacaacaaaggccacccggtagcttccgagtggcctttgccatatcaagctggaattacagccctatttcttattgcgcatctgcgcttccatctggcgcagcagctccatatcggacttgggaccgcccgtacccaggccgcccatgccgcccagacccatagcgtccagcccagggatattgggcatgcgcatcttcttgcccttcttgccctttttgcccttcttgccgccggcctgtgcctgattggccatcgtgcgcatgcggcccatcatcttgttcatctcgccccactgcttcataaggctattgacctcggtgggggtcacaccggcgcccttggcgatacgcgcgcgacgctggccgttgatgatggagggacgcagacgctcctccttggtcatcgacatgatgatggcctcgttcttgtcgaagatgccctcgtccaggttaccgcccatctggttgagcgcgcgctggccaccggggagcatgcccaggatacccttcatgccgcccatctttttgacggctttcatctggtcgagcatgtcattcatggtaaagccctcgcgcagcatgcgctcggcagcctcgagctgttcggcatcggcggcctcctgggccttctcgatgatgccgacaacgtcgcccatgcccaagattcgcttggccatgcgatcgggatagaacggctcaagcgaatcgggtttctcgcccatgctcacaaacttgatgggcttgccggtcacctgacgcaccgaaagcgcgccaccgccacgggcgtcaccgtcgagcttggagataatcacaccatcaaagtcggtgcgctcggcaaacgtcgagaccacgttgacgatatcctggccggtcatggcgtcgacgaccatcagcacctggtcgggcttgacggccttcttgatgtcgacggcctcctgcatcatctgctcgtcgatctgaagacgaccggcggtatcgacgatcaccacgtcacgaaggtggtcgacggcctcctggatggcgcccttggcgatgtcgaccgggtgcgcaccgtcgccgcggaagaccggcacgccgatctcgccaccgagcgtggcaagctgatcggcagcagcgggacggtagacgtcgcacgcggcgagcagcggcgagcggccctgcttcttgagcaggtaggcaagctttacggcagccgtggtcttaccggagccctgcaggcccacgagcatgatgacattaggaatgcggttactaaaaacgagcttgctctcggtggagccgagcatctcggtgagctcgtcgagcacaatcttgacgacgttttgcgccggcgacagcgactccatgacctcggcggtcatgcagcgctccttggtcttagcaacgaactccttaacgaccttaaagttaacgtcggcctcgagcagcgccatgcgaatgtcgcgcatggccgaggtgatatccgcctcggtcagcttacccttgccgcgcaggcggtcaaatgtgtcgttgaggcgatcgctcagagaatcaaacactagtcactcctaaattggactcgcccaccagggcgcggcagaaatctttggcgttaaactcctgcaggtcatcgacctgctcgcccacgccgatgcgaaggatcgggagcttgagcttctcggccacggccatggcgataccgcccttagccgtgccatcgagcttagtcatgataataccgtccaggcccagcgcctcgttaaactcgagcgcctggttcagaccgttttggcccgtcgcggcgtcgatcacaagcacgaccgaaaccggcatgggaccggcggccatattggcggcgcgcttacgggtcacattgaccaccttggcaagctcgcgcatgagctcagggctcgtgtgcagacggccggcggtatcgataagcaccaggtcgctgccgcgcttgtcggcctcgtcgagcacgtcgtagcaaacacttgccgggtcggagccgcggtcgcgcttgatgacggggacgccagcgcgctggccccacacatcgagctgctcgatagcggcagcacggaaggtatcggccgaaccgatcacgacgttcttgccgcgggcggccatggcgctcgcgatcttaccgaccgtcgtggtcttgccggcaccgttaatgcccacaaacagcacgcagctcggcgtatcggaaaacggatcgcgctcgatgggcacaaagtgctgctcgagctgctcggctagggcacgacgaagctgcggagcggtcttgaggttcttcttggccgcggcatcgcgtaggtcatcggagacctgaatggcgacctcggcacccatgtcacccataacgagggtgtcctccaggtcctcccaaaaatcctcgtcgacctcgccgccaaagtaaaagacctcgttgagggcctcgcgactgcgctcaagtccgcgcgagagagcgtcaaagaatcccattatgcattcacgacctttccggtttcgcgatcgagtttttgcgagacgacgcgactgacgccgtcggcttgcatcgagacgccatagaggacgtcagcgtcctccatagtacggcgctgatgcgaaatgaccaagagctgcgtatcggaacgcaacacatcgagcgcgccgatgagcttggacaggttggcgtcatcgagtgccgcctcgacctcgtccagcacatagaacggcaccgtgcgcgtgcggtacacagcaaagagcagggcgagcgccgtcaggctcttctcgccgcccgacatgagcatcatcttggtgatgcgcttgccgcgcggctgcgccacgacctcgatacccgtctcggcaggatgctcgggatcggtcatctccagatgagcctggccgcccgggaagagcatagcgaagatctcgcgaaagttcgcgtcgaccttctcaaacgtcaccaggaacgccttgcgcatcttgcggtcgatggccacggtgatcttggtgagcgccttgcgcgcgctctccagatcggccagctgcccctcgatgtagtcggcgcggcgcttgagctgctcgtactcctccatggcaacttggttcacagggcccaggttgttgatctggcgcacaagctggttaagctcgcgctcggcggcatcgcggtcggtgggcgccggaagcatgagcgcttcctcgagtaccgtggtgccatcggcggtaatggccttaatggcggcctctacctgcacctcaagcttgccgcgtgcgaccttgaactcgttttgcgtggcggtggcggtatcgacccgctccttagcgcgggcaacctctgccttggcatcctcgatggtcttcttgagcgaagcggagtccgcttcctccagagaggcctggtcacgcagacgtgcggcccaatctgacgcgcgctccagcagggccgaatagcgctcgtgcatgggatcgacgcgcaggcgcagcaactcgagtgagcgcgaggcctggcgtgttccgcggatacggcggtcgatgccctccaggcgatgctccagatcgggcacgcggcccttcagagaacgaaggcgctcgctcgtctgggccaggcggaccttggcatcggcgagcttgccggcggcctcggaatcgtcacggcgaacgcggtcgagttcgtcgttggcctcggcaatctgcaagcccaggtcgcttgcctgcgctcgagcctcgtcgcgcgaacgggtgagctcgtccacacgcgggcgcgcggcgcgaacggcctcggcagcctgctcacggcgcttggagatacgcacgcgctcgacctcggcattgttggcgctttgctccaggcggccaatctcggagagcagcgagcggcgctcgccctcaaggcgggcaatctcgccggcggcatcgccctcggcggcacgtgcctcctcgacggcggcgttggcctcaacgacttggtccgaagcatgctcaaagatggcagccagatcgggctccaggccctccagctcgcgaatgcgacgcttgcgctccaaagcacccgaagcctcgccggcgtcgagccccacacgcaccaggccgccgcaggcgacgcgggcgccatcaggggtcacgtaagtcacgccgtcaacgaccggcgccgacagcgcggcagcaagatcgtccacgacgtaataaccgccgagcagcgcctcaacgacgggaccgtagcctgcgcgcacggacagacgatcgaccaggcgggaaccggcagcgcccttagcggcagcagaggcgctcacaccgcgcgcgaccagcagcgcctcacccgaggccttcttttggtccagagccgcgcgaccggcacgctcaagcgtggcggcgtcatcaaacaaaagagcatcgatatcgccggcaagcagctgctcgaccaggccctcgagctcacgaggagcctcgagcacgtcacccagacgacccgagacatcatcgcccagcgcgcccatcagacggctcaccagcggcgagctatcggccatgcgggcatcgagcttcttttggctggcaagctccgagcgcacctcggataacttgttgcgtgcctcgctctcgcgggcacgcaggtccttcagggccgcgcgtgccgtctcggtagcttcacgcgcatcgacctgagcctggcgcacttcctcaagagcaccctcaagctccttggcgcgttcgcgacggctctcgagcgaggccgtgacctcctcgagctgttcatcgatctgctccaagcgcgaggcgtacatgttgtcctcaacctcggcgttactcagcgagtccttcaccttggcgagttcgagcgccgcgttatcggccccacgttgcacatcgcgttgctcacgcgtaagctgcgaaatctgattgtcgagcgcaacgcgacgctcgtggagctcggcggcggcaggtccggcggcgtcaacgtcctcctgggcctgcatgtgcgcgccggtcacttcctcaagctgcgcacgtgcatcctcgagctcctctaccacgcgacgacgctgatgctcggagctcgaaatctgcccgcgcatgtcggacaggcgcgacaccatgttgtggcccttttcctcgagcaggcgcatatcggagttaatgcgaccgaccacatcttgcatatggcggcgctgctcgcccagatcgcccacaaacaagcccttttcctcgagcatgacctggagcttctcgagctcgcgctccttttcgcccatgcggtactgcgcaagctccagctcggcggcgccttccttggagcggctctccaggtcgttccactgcgactgcagcgaacgcagctcgtcgacggctaacatctgcgtaagctcgttcgcgcgcgaggacagctctttgtacttgcgcgcacgatcgacctgacgctccagcggtcgcagctgacgggcaatttccttattgatgtcgcgggcacgcgtcaggtgctcgtccatcgacttaatctttttgagcgcacgctccttgcggcgcttgtgcttggagatgccggcggcctcctcgatgagggcacggcgctcctcggggcggctctgcaaaatggcatcgagcttgccctggctgatgatggaatgcgtatccttgcccagacccgaatcgtgcaggatgtcctgaatgtccatcaagcggcacggactcgagttgatgaggtactcgctttcgcccgagcgatacatgcgacgggtgatggcgacctcgtcaaaatcgacgggcagcatatggtccgagttatcgagcaccagcgtgacctcggcgacacccaccggcttgcgtgccgacgagcccgagaagatgacgtcctccatggcctggccgcgcagctgcttggcgctctgctcgcccaggacccacagaatcgagtcggagatgttcgattttcccgagccgttgggaccgacgatgacggtcaggcccggctcaaatgacatatgggcgcggtcggcaaacgacttgaaccctttgagcgtgagggacttgagatacacggttcctcgcttaaacaggcttcttgttgagaatcacgccgttggtggtgtagcccatgcggtcgagtgcctcgagcgcagcggctccctcggcctccttcttggaggaaccggtgccgcggccctggcgaataccgtcgatgagcaccacagcggtaaaggtgggcgcatgcgcggggccctcggagccgaccagcttatacgcgggaggctcgtggccgtctgcctgcacgcactcctgcaagaacgacttggggttcgcggggtgctcggcacgctcggaggccagatgcggcttgagcgtacgatggataaagtccgccgcaacatcccagccggcatccaggtacagcgcgcccacgagcgactcgtagacgttctcgagcgccgagtgcagaccgcgcgcaccggtaccggtctcggaagcaccaaagataatgatgtcgtcgatgcccagctcatgcgacacctcggacagcgtggcgcccgagacaagcgacaccttcaggcgcgtgagcttcccctcgtcaaactcgggataggactcaaagagcgaacgggccaccacggcgcccaaaatggaatcgcccaaaaactcaaggcgttcatagctggcagaaaccggctggccctcgactgccgagggatgcgtaagcgccgcgcgcagcagcaccttattattgaactcatggcccaggatttcctgggcacgcgtaagtcgttcagacaaagccaagacctaggcctccctggcgttttcgatcgcgtcgacggcgtcggcgacagagttgagcgagagcagagtctcgtcatcgatctcgaggttgaactcgtcctcgatagccgtaaccagctgcaggcgctcgagcgagttggcatcgagatcgtcaaaggtggtctcatcgctaatttcggcaacatcgacgcccagaacgtcagcagcgacctcggcgatcttgtcgaagatttcggagcggtccatagcgcttcctctcatagtgcatgaataccaaaagaatggtaccgcccgggcggtaccaagacacggttctgattctaccccacgaagcaggccgcgaggcacataacagcgctctaactcgctcttacaaaacgatgccgtccatggagttggcgacgttctcgaccagccccgcgcgcacggcttcggccgccgcgagcgtaccgtttttaacagcctcgaccgaggtggcgccatggccgatcaggacaacgccgcgcagaccgagcagaatcgcgccacccttggcgtcgcccgaaagcttggccttgatctcgcgcatctgctttttaatgagcagcgcggcgatcttggtgccaagcgaagacataaagacgcccttgagctcctgcagcaaaaacttggcagcgccctcagtggccttaagggcaatgtttcccgacatgccatcggcaacgacgacatcgaagctaccggaggtgatgtccgttccctcgcagttaccaacaaagccgggaacggcggctttcatggctgggaagcaggccttggtaaagttggagcccttctcgtcctcggtgccgttagcaagcaggcccacgcggggatgctcgatgcccaggacgacgcgagcataggcgctacccatctgagcaaaacgcaccatgtcatcgacctcgacatcggggttggcgcccatatcgcacagcaccgtcagaccgccggcgcgattgggcagcgcatttgtcagacagggacgcaccggctgcttcttaccttcggccatatatctaaacggcgtgacgtaggcggtcgcagcggcggtcatggcgccggtggagccggcggagaaaaacgcgtccgcatttcccttcttgatggcgcggcacgacagcacgatcgaagacttgcgtttggtcatcacggcgcgaatgggatcgtcatccatggcgataacgtcgggtgcctcaagggcctcaacacgtgcgtgggaagcagcaaagggattgacgatttcggcgggaccagctgccaagacctcgatatcgggatcggcggcaagtgcagcctcgataccatcgagaacgacctgaggtttctcgtctccacccacaacgtctacacaaacgcgaacgttactcatatacatgctccttatacaaaaatggccgactcattgagccggccattgtggttccatttggaacggcatcgcatccagagtataccgttactcggtaacgataacctcgcggtccttgtagaaaccgcagctggggcacacgtggtgcggaagcttgacagcgccgcaacgggggcacgtggactgagccgcagccgagatcttcatgttggcggaacgacgggtgtgagtgcggatacgaccctgcttttgtttaggtacgggcatagtgaccttccttatgaactatccagtgtggcgattacgcgcaagtagcgatactaccacagttttactcatcgagcttgagattcttcaatgctgcaaatggattttccgtggcagcggcccattccgcctctgcctgggcggcgcaatcgcattgctcgacgttgagattgcaaccgcatgtggggcacagaccacggcaatcgggcttgcagagcactacaaacggcgtgtccataacgaccgcgtcattgatgggctcacccagatcgactagacggtcctcacccaggagctcgtagccgtcctcgaaggcctcgggatcctcgggctcctcaaagagatagaactcctcgatctcgccggcgatatcaaacgaggcgggctccaggcaacggtcgcactcgccggtggcgtgcgcgcggaccatgcccgtgagcaagacaccggtaccggcattggtaaagacaacgtcgtagtcgatgccgtcctgaagctggtactccttctcgcccaccgtgtaggtggcgacatcgaccttaccggtcagcggatacgaatctcctggaaactcgagctgctcggaaagatcgacggtaacgctcgggaactcagccattaccactgaccattctgttgggcggcaccctcgttgagctgctgacggcaacgggtaacggtgccggtcaggctcttgaggttctcctccaggtgcgtaaagacctgctctgcgtagtcctcggcagcataacgcgtctcgcgctcgtactgctgggcacggtcgcgaatatcgtcggcctgctgctgtgctaagcggacgatctcctgctcaccggcgatggtgagggcctgctgctgagcatcggcgatgatggaatcggcctgagcggcggcggaagccataagctcctcgcgctccttgaggatacggcgggacttctgccactcctcgggatagctcatgcggatctcgtcgaggatgttgaagaacacgtcggcgtcgatgaccttgaactgagcgttcttgccgaaaggcggcttggcttcctcgatcagcccttcgagctcatcgaccaagctgacgatcctatcgccaggaaaattctcgcccggcatccggtctcctttcataggtaacatatcatcgtgctagtttaccacatgccaccaggcaataaaaaacgtcacgaaaagcgatgtttgagcgcttcgaccacattggacggcacaaacgtcgatacgtcgctgccgagcgaggcgatctgtcgaaccaccgaactcgagacatatccgtactgcggggcactcatgacaaagatggactccagctcgttgtccaggcggtagttgaggtcggcctgctgcaactcgtactcaaagtcggtcatggcgcgcaggcccttgaccacggcgccggcgccctgctcacgggcgaagtcgaccaagaggccggtgaagggcaggacctcgacaccttcgatatcgccgagcgcctcgcgggccagcgccacgcgctcgtcgagcataaaggtggtgcccacgccgtttttaccctgcgactcggcaacagcgacgataacgctggggaagatgcggcgagcgcggcggatgacatcgatatggccaaaggtgatgggatcgaaggtacccgggacgattacgcggttgatggtgtcactcatgggcgtcctccggggatactgcctcgtcgttatcgttagcatcagcgctgtcgcccttgctatcgccgacccagcgcagcaggtcgaccgaggtgatgccgtagcgcttctcgcggacggtctcaaaaccggccggatgtgcgcccgcgtcgttggcggcatgctcgaacagtgcatatgcgccaggggccagcaggccccactgggcaaggttctgcagcagttcctgaaccggctcggcgccaaaggcatacggcggatcgagcagaaccaagtcgaaggggccgcccggaacacggccgcgcgaggcactagccagcatgtcgcccgtcaccacgcgccaacgcgcacggtcgcgacagagcgactcgatattcttggtaataagacgcgcggcatttcgatcgatctcaaacgtcgtgagcgagcgggcgccacgcgagagcatctcgatgcccagggcaccggagccgccaaacgcatccagcacgcggacctcgtccaaatcaaagtcgaatgccgacatgaccatagatgcgcacgcctcgcgcacgcgatcagtcgtggggcgggtgacatcgcgaccacggggctcctcgatcttgcgaccgcgccattcgccgccgatgattctcatcctccgctgacctccttaaagatgtgtcgataccgcgtggcgaccgcatcgcgcagagggcgcgtcgccacggagtcaaggttgcaagcataccgcaagagctcgaccgcgtccaaatgggcccactcgataagctcctcgtcggcatcgagatcgacgaaacgcaaggtcacgccgccatgttgacggtagcccaggatctcgccctcatgacgcagacgcaggtccatctgcgcgagcgtaaagccgtctgcggtcttttcgagcgactggagacggtcttgcgccgccgacgtaccgccattgccctttgagtgggtcatgaccaggcacgtgcccgacacactgccacggcccacgcgaccgcgcagctggtgcagagcagccaaaccaaagcgctccccgttctcgatgaccatgacggtggcgttaggcacgtcgacgcccacctcgaccaccgtagtcgagacgagcacgtcaatctcgccacgcttaaaggcatcgataacctggtccttctcccccgctggcatgcggccgtgaaggcgctcgatggcaagacccggcaacgccagacgcaggcgatcgagctcggtcgccgtatcgtgcagcggcacggggaccgtcacgcggccctcgtcgtcgcgggcgataccgggcacgtcctccagatcatcggccgagtcactcggctccacgagcgggcaaatcacgtaggcctgctgacccttttcatgcgcctcgcggatggcgccataggcaaggtcgcgactcgactcggtaagcacgcgtgtcgtcacgccagcgccagggacgggccgatggcggatgatactcgtgtccagatcgccgtagaccgaaagcgccagcgtacgcgggatgggcgttgccgtcataacgagcagatcggcaccggggcccttcgcgcgcaaggcattgcgttggccgacgccaaaccggtgctgctcatcgatgactacgagcgacagatacttaaacgccacgttatccgaaaggaccgcgtgggttccaaagaggacgtcgagctctcccgattccagctgtgcatggatgcgctcgcgctctgcggccggcgtggcacccgtcagaagcgcccaagacatgccggcctgcgagagcagagggccggtcttatcggcatattgacgcgccagcacgcccgtgggcgccataacgcaggcctgtgtgccgctatcggcagccacagccagcgcgcaggcggcaacggcggtcttaccggtaccgacatcgcccagcagcaggcggttcatcacgcgcccgccatcgcacatatcgcgcaggatgtcttggaacgcggcctcctgctcgtcgctcagcgaaaacggcagggcctgcttgagcgcggccaggtgctcgcccgcggcgtgggcgtagggagcgacttcgaccaagataccgtcgttgcgcaggcgcagcgccagctgcaggtagaggcactcctcgtaggcaagccgtgcgcgcgcgatatcgcgctcagccctgctcaagggaaaatggatcgatcgaagcgcacgggcattgctcatcaggcggcgcttgacgcgtaagcgtgcgggaatcgggtcgaagggattgccgacgacctcgagcgcgccacttacgatacggcgcatccatgcctgactcacgccgtcactcacgtaatggaccggcaggatagtgcccgcggcgcgcccttcctcaagcttttcaaagtgcggcgaggccatccgcttaaagccgtaggcaaactcgaccttacccattacggccaggcggtcgccctgcttaagctgctgggcaatccagggctggcggaaaaaggcgacctgcagcacgcccgtctcgtcaacgagtgagacctcggtcacctgcatgcgcggacgcggctgcttttggacgatacgatcgaccgtggcgatgatggtacacacggtaccgatgggcgccatctcgatggaccaggagcgcgtaaagtccaggtatcgatgagggatatggagaaggaggtcccccaccgtccgaattcccagacggcgaagggcctcctcacgtttacccgaaacatatttgagtcgcgcgatatcctcgtcgagcgcattgctctgggcaaagcgctccgagacgcgcggcacggagcacagttcggacatgggcagttgcctactcgatcgagaagatcacgggatagagcggctgctcgccacgatgggcgtcgatctccagatcgggctgagtctcctcgatagcgtcgacgatctcctggaaggcctcatcggacagttcctcgccggccagaatcgtcagcgcgtcgccctcctcttcctcctgcatacggttgatgcaatcgagcgtgacctgcttcacgtcggagccgaccacgtcgatggagccggcaatgatgcccatgacgtcaccggagtgaattggcgaaccgtcggaggcactggagtcgcgcacggcgcgggtgacctcgccatcgcggacctcgctgatggcgtcgaccatagcggcgacggcatcctcgagctcggaatcgggcaggaccgcgaacagcgcggagaaggcctgcggaacggtcttggtgggaacgacggcgaccttcttgtcggtgcaggcagaggcagcggcctcggcggccatgcggatgttgccgttgttgggcagaatgatgaccgaggtcgcgttgacctggtcgacggcgcccagcaggtctgcagtcgagggattcatggtctggccaccggacacgatcacgtcaacgccgagggacttgaggatgtctgcctcgccggaaccggcggcaacggcgacaaagcccagggccttcgcgggctcggcggccttctcctggtcctcgtggatcttggcggtacggtcgtgggcctccatctccatgttgtggataaagacctcgtagatctggccaagctgcagcatgtgctcgagcaccaggttcggggtgttggagtgcacgtggatcttgtagtcgggatatgcgcccacgagcagctcacagtcgcccatggaacccaggaacttaaggcactcgtcctcgtcaaacggggcgtcggccttaaacaggaactcattgcagtaacggaattccgagccctcccagtcgtcgttagcctcgatctcaacgcggccaagagcggcatcacgggcagagccggcggagtcaaacgtagcggagaaatcctcgacaacggtgctgcggccaagagcggcagctacgaagttctcgaggaagatggcaaagccaaaggcgccggagtcgaccacgccgttctccttcagaacgggcagcaggtcgggcgtgcgagcgacggactggtaggcctcgacgacgatggcatcgagcgcgtcctcggccgagaacttcttcttttcgcactcgtcggccttggtcgagacatcgcgcagcaccgtgagaatcgtgccctcgatgggcttacggacggcctggaaggcgaccttgacggcgcggcggaacgcataggcgatgttggcggacgtgatgggctcatcagcagagacgagaccctcggccacgccgcgcaggatctgagaggtgatgacgccagagttgccgcgggcacccatcagggagccgtgggtgatggcgccggcgatggcctccatatcggcatcggcgggaagggcggaaagctccttggtcaccgaggcgagcgtgagcgacatgttggtaccggtgtcgccgtcgggtacggggaagacattgagcttgttgatctcctcggccttgtcggaaacagcagccgcagcgatcggaaaacaggtgcgaatggtctttgcaatcatgggtatttgaatctccgttttcggatgctagttcagacggctcttgagcgcgtcgatgtgaatgccgatcttaaggctggcgggatcgatctgggcgatctcctgcagggtgaaggcaacggagctcgaaagattgtggcagacggacttcatgttgacgccgttctcgagcacgacgtgaagatcgaccgtaaggccgttctcgtcggcggagacaagcacgcccttgcggaggcgctgaccggcaagcaggcgcacgctctcggcgccctggagctgctcagccataccgacgacgccatagcacgtcatcgcggcataaccggcaatatcggcaataacgtcgttcgagacgctcaggctgccgttgatggtctcagacacaagaatctccttatctggtgctcacggcaccatgtcgtgggagcaatcattgcaatattctacaacgaccgcgccatgttgaggtgatgggtcgcgggattacatcctcgacacgaaatgttgatatggcaacgttcgagtcaagtggtcgcggcatgaaaaaacccgccgcataagcgacgggttttacaacctggctccccgggtaggactcgaacctacaacagcgcggttaacagccgcgtgctccgccgaagttgaaaggcagattgccgctctggcgggcttgcagcgtcggccggttacggcgtttggtaaaacgccgtaactctaaacccgctctgcgatctcgtggatgaggtagtcggtcttttcccaacccaggcacgggtcggtgatcgacttgccaaagacgccgccgtcgaccggctggttgccgtcctccaggtaggactcgatcataaagcccttgaccagcttggagatggactcgttgcggcggcagctgtcgagcacctccttgcaaatgcggtactgctccagcggtcgcttgcccgagttgtcgtggttgcagtcgatgaccgcagctgggttggcgtagccggcgtgctcggtgtaacgctcggccaggcgctccagatgctcgtagtggtaattggggtaggtgcggccgtcgaggccaatgtagccgcgcatgacggcgtgcgcgagcgggttgccgtcgcactcaacctcccagttgcggaagataaagctctggtgtgcctgggcggcatagatggagttgagcataacggtggtggaaccggcagtggggttcttcatgcccaccggcaccgaaatgccactcgacaccagacggtgctcctggttctcgaccgagcgcgcgcccacggcgacatagctcagcaggtcgacgaggtattggtagttggagggatagagcatctcgtcggcggtgaagaaacccgtctcctcaatcacgcgcaagtgcatgtggcggatggccttgacgccctcaagcaggtcgtccggcgcctcggggtcggggttgtgcagcaggcccttgtaaccggtgcccttggtgcggggcttgttggtgtagacgcgcgggatgataacgagcttgtctttgacttcctcggcgaccttggccaggcggttcatgtactcgaggaccgagtcctcgcgatcggcagagcacgggccgatgatgagcaccttacgtgcatcctcgccggtaaagatcttggcgacctcggcgtcaaactcctgctttttggcggtgagctcggccgaaagcggcatttcctcgcggatctccatggggatcggcaacctgcgtttgaattccatggccataggggcctcctcatctatagaaagctattgagcgcattttcgagtgctcggcattatccgctgtcgcacgctaaagtgcaagcgaaacccgccaaaaagggacaggtttattttggcaggttttatctggggaaacgacgacgttcatcgcaagaaggagagctgtcgttcatgggggcattttgatttcagcttttgcaggacctcgtggtcaaaaaatgccaaatatgagtactgttgctgatggagtatcatatcgagtctagaaaataatagacattacactgattatgttcgttaaatccgatgcatccgagcccggtatcggtcgcgcgcgcagacgtggtgtaagagtgtcctgaggtccgtcgctgcaagtcccgccgaagttgaaaggcagattgccgctctggcgggcttgcagcgtcggccggtccgccgttcggtagaacggcggaaccgattacataagctcgcagacagccgccgcgaaggcaacggggtcctcggggaggataccctcgaccagcagggcctgatcgtagagcaggccggagtactgcttgatcttgtcggcgtcacctgccttctgggcagcgacaagcttgtcaaagaccgggtgcttggcgttgagctcgagcacgcgctggctcttgggcatgccgtcgggcgcgccctcgggccccttctggagcaccttctccatctcgagcgaaagcggaccctcggtggtgatgcaagcgggggcatcggtcaggcgcgcggagacggcaactttctcgaccttgtcaccgagcgcctccttcatagcgctaaagaggtcctcgttttccttggtggcgtcctcggcctccttcttctcgtcctcggtcgccagatcaagatcgccagtcgcaacgttcttgagctccaggtgacgatcctcgacctcgggctcggcaccgtcggcaacggccttttcggcagcctcgcgggcggcgtcgtcctcgtagatcttggacatatcggcggcaacgtactcacgcatagcctggaacgtgaactcatccacatcctgcgtcagcaacagcacgtcatagccgcgctcgagcacgccctttaccacgggcatcttggccaagcgctcacgcgagtcgccggcggcgtagtagatggccttctgatcctcgggcatgcccttggcatactcggccagggtaatcatcttctgctccttggcagaccagaacagtagcaggtcggcgagctcatcggccttcatgccatagctcgagtagatgccgtacttaaggccgcggccaaagttctcaaagaacttctcgtatgcctcgcggtcgttgtcgcgcatgtcctcaagatcggcagtgatcttcttctcgacacgcttggcaatggccttgagctgacggttctgttgcagcgtctcacgcgagatgttgagcgtcacgtcggcagagtccacgacaccgcgcacaaagttgtagtagtcgggcagcaggtcgtcgcacttctccataatcagaacgttggagctgtagagcgccaggcccttctcgtagtccttgctgtacagatcgaacggggcgcgacccggcacaaacagcagcgcatcgtactcaagcgtaccctcggcatggaagctgatagtgcgcgcgggatcgtcaaagtcgtggaacgtggacttgtagaactcgttgtaatccttctgctcaacgtcggagctgcgctttttccagatcggcgtcatggagttgatggtctcgagctcctggtagtcctcgtactcgggcttgtagtcgtcgccggcgtcctcgggcttgggtttctggcggctcttggacaccatcatctggatcgggtaacgcacatagttgctgtactgctgaatcaggctcttgaggccccactcggtcaggaagcgatcgtaggtctcggcctcgccgtcggcgtcgagcttctcgttctcgcgcagcgtcaggatgacatcggtgccgtgctcggcgcgctcgccgtcttcgatggtgtaaccctcaagaccatcagactcccacacgtgagcggtgtcctcgccataggcgcggctgacaacctttacgtggctggcaaccataaaggcagagtagaagcccacgccaaactggccgatgatgtcgacatcggagccctgctgctcggcgttctcggtcttaaactcctcggagccggaatgggcgatggtgcccagattgcgctcgagctcctcggcggtcatgccaatgccgttatccgagatggtaatggtgcgggcgtctttatcaaaggaaacgcgaatagccaggtcgccctggtcgagcttgacgctcgggtcctgcaggctcttaaagttgagcttgtcgacggcgtcgctcgcgttagagataagctcgcgcaggaagatttccttattggtgtagatggagttgatcatgaggtcgagcagttttttgctctcggtcttaaattgacgcatgtgcagtcctttcgcgctacccccgtccgcaaaaacggcccggttgcccgagccgcatcgcagacctgctatgttcagacttagattttataacccattagcgcgcatatatacatacggaatcgaaaaactgtatgtccaaacgctctgatgcgccaattgccaaggagtgtccccgactgccggcaggaaaggaacgtccctatctgccatctacgcgcttggccatccaagcatggggctggccctcgtcttcgtagtccaccggggcaatctgcgtgtagtccgccttggcatagagcggcagcacgtattcctgcgcatgcagcttaatgagcttggcgccggcatcacgcgcgcacgtatcactggcctcgacaatcttgctcgccagaccgagacggcgcatgctcggcagcacagccacgcgccccataatgtaggtctcccccgccgcgacgccttcgtccaagtcgcacgccggcgacaccggagcctctgcgtcagccgcgcgctcaagctcttcgggaaacacgcgcgagcaaccggcaagctcaccgtctacatagagcgtcacatggatgcagttcggatcctcgtcgatagcgtcgaactcattctcgtagccctgctcgtccataaaaacgacgcggcgcaccaacgccgcgtcatcaaagcatcccgtcttaagttggatatccatggctgccctttcattcaatgcgaacgttagggacagattttagcgaaaatgagctccgcgcacgctaaacttcgcgcgagccttcgccaggcagtcgtaatgacccacattatgggcatcgctcgcgatgaagctgtacaggttctgatcgaacaggcgctgtgccggctttttctcgcgaccaaagcgaccgccggcaataaagtccgccgaagcctgcagcttgcagcccatatcgaccaggcgctccgccacgcttacatccttttgaaccgcacgatagcgctcaggatgagcgatgatcacctggtagccacggcactgtaaatcgtaaatcgtgttctcgtactctctaaacgcatacgcatcggcatgcgtcgaaagctcgagcagaaactcgttggtcccatcgaaatgcaggtgctccgcggcatcgataccaagctcaatgagctttcgatggttgacctcgaagcccatctggagcggaaaaccgtcagcgttatcgcgcagcagctcaaaggcatcccacatcttgtcgtaatcaaaatagggatcacggcagtgaggagtgcaaacgattctggttacaccggcccgcttggcagcctcgagcatcgccaagctctcttcgagatcggcggcgccgtcgtctacacccggcaagatatggcaatgaatgtcacgcataggtcggccttaatcaactaaacgtttgctcggttggtgaagatgccctttttggaagtgccctgatcgccggagcccttcttaaccttcttaccgtccttggtgtagtaagaatagtagtactcactggtctcggtctcacagtaattcatgacagtaccgatgagcttgaccttctcggacttcttaagctgggcgatagcgttgagcgcctcctcgcgcttggtaaagtcctcgcgcaccacgaacagcgtgccgtcggtcaggctggcaatctcggcagcatcgatgaaggtgccgaccggaggagcatcgaagatgacgtactggaacttagcagacagtgccttgaccaacttggaaaagcgatgggagacgatgatgtcggcaggattgggaatgtgtggctcggcatcgaggaagtagaagttcttctgacccgtctcgacaattgcctggtcaatggaaatctgctcggaaaggaccgcatagagtccgccgcgcgaacgaacgccgagcatatcggaaagggacctgcggcgcatatcggcctcgaccaggagcacggacttgccgctcgtggcgattgcctgagcaaggttaatggaaaccgtagacttgccctcgttgggaatcgaggaggtaacggtgatggtacgaatggggtcgtccacgctcgcaaagcggatgttggccagaagggtcttggcggcattctgtacaacgagcttatcggtgttctttgccttagccatgcctatttaccacctttcatagccggaattcggccaacaacgggaatacccaggagctcttctgcctcttcggcaccgcggatgcgggtattgagcatgtctgccaaaacgacataggcaactgcgataaagataccggcgaggaacgcgacggcaatatacagcgtgcgcttggggccactgggggcttcgggggtcttagcctcgtcgataacgttgatgctctgggcagcgccgacgttctgagcgaccgtactcgccgagctggcaatggcctttgcgacctcagccgtctccttggcatcggtgccggtaaccgaaagcgtaatgacacgcgtggtggtctcggaggaaacagacaccttgtagtcatccagatcggtgaggcccagttcattggcggcgccgctcttaacgctatcgctatccagcagcgtggcgatatcgttggaaagcatctggctcgccgagagatcgttgtagctcatctgaccgttatcgtcggtcttggcgagaatgtacatgctcgtcgtcgcagtataggtgttgtccatcgcaacgaaggacacgatgcccatggcgatcgcgcagaccaccggaagggtgatgaccagcttaaggtgctttttgagcagctggaacagttcgagaagggtcatgcagcttgcctttcatttccccagttcggattgacaaaactgtccgtatgttatcgcatctttttaccgagaccaaactctatacataagaaacaggctcttctgtaaaaatgtcggaagcaatcgtaaaattgcacaacaacgccgcacccgaaagtcaaatgcggcgtctacatcaatatctatgttgtatcgctatgcgaatggctcgtcctgctgtatgggaaacgtcaccgtaatggtggttcccacgcccaactcactcgacagatcgagcgcggcgtgatgatacagggccgcatgcttgacaatggcaagccccaggccggttccgccgcgtgccttggacctactcttgtccacgcgatagaaccgctcaaataccttgccctgttcttcaggcgcgataccgattcccgtgtcggcgacagcgaggaacggatagccttcgtcgttggtgccgcactgcagcgtaaccgtaccgccgggccgattgtagcggatggcgttgcttgccagattatagatgagctcgtcaatcaggcgcgacacgccttcgatgaccacaggcttggtctcatgacttatcgtcacattcgcctgacgggcaacctgttcaaggcgctgctcaaccgcgtagatcgcacgcgagagctcaataggctccgtggacccaatgggcactgcctcgccttcagttgcacgttcggcctcgtccaagttagacagcgtaaggatgtcgttgacaagcgctgacaagcggcccgcctcacgatagatgcgaccgccaaagttgcgcaggtcgtcctcgccctcgaccatgccatttgcgatgagctcggcatagcccgaaatcgccgtaagcggcgtcttgagctcatgggtgatattcgccgtgaactcgcggcgcatacggtcgttatccgctagcaccgccatttggcgcttgagttcctggcgctgcgactcgatacgctcaagcatggggaccatctcggcataggcgtgctcatagctacggcgtgggtgatccaaatccacctcttgcaacggcgcgatgatggcacgggactcacggcgcgccataaaaaacgagagtactgcacccgctgctgcgataagcagcatcggcgccagcatcgacagcaaaatcgccgcaacgccaggctgggcctgcgccaagcgaacgacctggccgttatcaagggtgacagcgcgatacagcataatctcgtcgagtgtagagcttgcgcgctccgcggaacccgaaccactctcaaaggcctcgatgacctcggggcgatcgccatggttgggcagtgtggaaggcgacgcctcgttgtcgtaggcaacagatccgtccttattgatcagcgtgatacgaagatcctcgcgatcgaggcttcgcaagaacggaatgggctcctgctgctcgtcgagggcggcagcaatgagctcagtttcctgcgccagattggcactcgtggcatccgccaaagtgttttgcacaaagaacgcgcccagcaccgtaaacgccacgataaccgccatggcgcagacaaagatcgtcacaaaaacgcggtgcgacagcgtatgttttccctggggggcgaagaccacgggttactcctccgatgcggtggccgcggtgtcgtcgccttcggcaccatcaccggcagaaggctcggccaagcggtaacccacgccgcgcacggtctcgatggcgctggcatgctcgcccagtttttggcgaagcgtctgcacatgcacgtcgacggtgcgcgaaccgccgtcgaagtcccagccccacacgctctgcagcaacgactcgcgggtaaagaccacgccgggcttgcgcatgaggtactcgagcaggtcgaactcgcgcagggtgagcttaagcggctcgccggcaacggtcacctcgcgatggctgggcgagagcacgatgtcgcccacgctgagcacatcgctcgcctgcttgaccatgccgccgcgacgcagcagtgcgcggcagcggctcgcaagctccatgagcgaaaacggcttagtcaggtaatcgtcggcaccgccatcgagcgccatcaccttgtcgagttcggtgtccttggcggtaagcatcatgatgggcaccgtcgccgtcaggcgatcggcacgcaggcgacgcataatcgccaagccatcggtgtcgggcagcatgatatcgagcagcacagcatcgggcacccgtcgtgccacggcagctttaaactcgccatcacacgaaaagccctcggcctcgattccctgcttgcgcagcgcgtagactgtcaaatccctgatgttgtcatcgtcctcgacgtaatagatcatgttgaacccctttgcggccgatatgaccgcatcttaaccctaaaggcacctgtaaaagacagcgtcagccaaaacgccccgtcaaataatccgcggtgcgcggatcggacggattcttgaagagttgcgcggtgggcgcgtgctccaccagctcacccagcaaaaagaacgcaaccgaatcggaaatacgcgcggcctgctgcatgttgtgcgtcacgaccaccagcgtgcaggtctccttgagctcgcaggccagctgctccaccaccaacgtcgacacagggtcgagtgccgaggtcggctcgtccatcagcagaatgtcgggctgcacggcaagtgcgcgggcgatgcacaggcgctgctgctgtccacccgaaagacccaggcctgactctttgagcttgtccttgacctcgtcccacagggcagcgcgacgcagggagtcctcgaccagctcatcaagcacggcgcggtcgcgcacacccataccgcgaggaccgtaggcgacgttgtcgtagatgctcatgggaaatgggttggggcgttggaacaccatgcccacgcgctggcgcaaacggcagatgtcgcaatcgcccaggatatcttgaccatcgagcgcaatcttgccctcgatgcggcaatccttgatgccgtcgttcatgcggttaaagcagcgcagcaacgtggactttccgcagcccgaaggcccgatgaacgaagtgatctgcttgtcgcggatcttgatattcacgtccttgagcgcatggtgatcgccatagaacaggtcgaggccctcgacgtcgatgcgcgtcggcgaggcggcaagatcctctgccgtggggcgagtcgcatccccaacctcgcgctcatgcgcggcctcggcctgcgcttccatgagttcttcaagctccgtgggctccacagccgcagcagccgtcataccgcacacctccatatcgatatcaattcagcagtatcgatagtaggaatcgcggctcatacgcacgtgagcacattgtcaagtgtttgtaagggcacactggctatgcggcgggcagctcgatggtgaatatcgtgtgttcgggcgtcgattcacatgcaacggtaccgccgtgtgccgcgatgatctccttggcaatagcaaggcccaggccggcaccaccgcgattggtcgcacgcgccgcatccaggcgatagaacttctcaaagatcaccttgagcttagccgcagggataggatcgccctgattgataaagcgcacgcgcacaccgccatcgtcttggcgcctggcctcaatcgtgatagtcgagccctcatagctataggcgacggcgtttttcatgatgttgttgaacacgcgggccatcttgtcgccatccacgagcaccgtcaggtcctcgcgaatatcaacctgggcttccttatgctgctcgttgaggatgggatagaactcgtcagccacctgagccagcagcaaccccagatcaacatagccgcgcgtgagcacgatatcgtggaagtcaaagcgcgtgatatcgaagaactcttcgatgagcgcatcgagccggtgcgccttgtcgagcgccacgcccgtaaagtgcgcacgttgctcaaccggcagctcaggagcctcttgaagcagcgaaagatagcccaccacactggcaagcggggtgcgtaggtcatgtgccaagtacgtgaccagatcgtccttgcgatgagactcgtcacgcaaggcctgttgcaccttgcgctcgcgatcgcgcacacggttgagtgcgccctcgacctccaggaagtcgccgtcgatgttgtcccaggtgtcggggtgatcgatcaggcgatcttgaatacgagcggccagcacacaatcggcatgctgctcgccctgctcatagccctggtagtacagggcgcggccgcaaaagaacagcacgcacacggcaagcgctagcacaaagccaagcatgttgaatacaaagccggcatcgaacagcaccggcccttcgatgccgccgagtgccatggcgccaatcgccaacgtcatggcccacgcggcaccgccaatcaccacgcagcggcgtacgatttcaaatcgatcgatcagcaaaaagccgacaagcagcaccgccaagattccagcgatgttatcgatgccaatcagcagcaggctcagcaaaaagagcagcaccgttgcaagcgcgcggttgtcgacgaccgacctcacgtattcaaagagtcgatcgggcacctcgaatgcctgcctatcgtcttttgtcatatccacttccccaccatcaaaggcgttattcgattatgtagccgacgccccagacgtttttgataaagcgcggcttttgagcgtcgtcaccgatcttttcgcgcaggtggcgaatgtgcaccatcaccgtattgttggagccgggcataaaatcctcgttccacaccgcgcggaacagatcctccacggccaccacactgccgcgatgctcgaccagatacagcaagatggaatactcgatgggcgtgaggcgcaccggcgcaccgtccaccattacggaacgagcatcgcggttgatctccaggccgtcgagctggatggtcggcgactcggccacctgcgcgcggctaccgtagctggtgtagcgacgaagctgagcatgcacgcgcgcgatgagctcaagcggacggaacggcttaaccacgtaatcgtccgcgccaagcgaaaggccctcgatcttgtcttgctgggcatcgcgcgccgtcagcatgatcacgggataggtatggctggaacggatcgtacgcagcaactcaagcccatcgatatcgggcagcatgacatccagcagcgcaagatcgaactcctgctccaagattgccttggcagcatcggccccgctataggcgacctgtacgtcaaagccttcttttgtaaggtagataccaaccaagtcggcgatggccttttcgtcatcaactaccaaaatgcgctcgttcatgcgtgctcctctcgcgctccattatgcccgagggggcgcatgccacacacaacaagcgtgggtgattaagtcggccttaagcacccttgtgcccgttcgggcgcggatgtgggccacgcacgcacgcgatgatcgccgacaccggcaaacgatatactctagttccagaagagaccatcccgtcgaaagcgaaatctgtgaagtccctcacctcttttgcaaagcgctcagctcagcttgccgccggctttgtctgcgctatcgcccttgccgctggcgtgcccaccgtcgccggcgcccaagtactcacgaccgacaatgtttgcggcaaaaccgccgatgcgcgcggcatcacggccgaaaatctgcccgatatcgatgcgaccaatgcgctcgtcatgggcaaagacggcaccgtctactatgggcgcggcgccgatgagcaggttaaaatcgcctcgatcaccaaggtcatgaccgcaatcctaaccgtcgagaattgcaagatggacgagaaggtcacggtgagcaacgccgcagccaccgtgggtaattcgaccgccggcttgctcgaaggcgacgagcttaccgtggagcaggcactgcgcggcctgatgattccctcgggcaacgacgccgccgtcgtgctcgccgaatatgtgggcaagaagatcgaccctaagaccaaagacgccgaggcaacctttgtgaaggccatgaacgagcgcgctaagaagctcggctgcaccggtacgctttttgaaaacccgcatggtctggactttgatgagtgggctggcgatatgcactcaaccgcacacgacgtagcgctgatgatgcaggaggccatgaaaaacgacacggtccgcgaggtcgtagcgagcgaggattcctggatcgaggtcacgggcgccgacggcaccgaccattcgcattccatggacacgcacaacgttttgctcggtcaggacggaaacattggcggcaagaccggcaccaccgacgacgcgggctactgctttacgagcgcctacaaccgcgacggcgacgagatctacactgttattttgaactccaccaccaccgaccagcgctttaccgataccgccagccttgccaactggtactacggccacaaggtgacggtcgcaatcgccaacacgcaggaaaagaccgccaacggcaacccgcttatggcgcgcattggccaaaccgactggacggataagacgatcgacgccacactcgccgatcctacggcgcaagcgaccgtgttttcccttgccggcgaggtgaccgaaaaggttagctacgacgatctttcgggcacggtgcatgtgggcgacaaggtgggcagcgtcacgctcaagcaggacggcaccaagatcgccgtcatggacctagttgccgacgaggaagccgcagggccgaatcccattgaatggctactcgtgaagctcgatcgcttgggccgtcgcatcgacaaccgcccactcacggcagaaagcgagaccgtcgccaaggcgcccgaggtgtagggcgcaagaataataagtccactgaaaggaggcgtccgaaaggatgcccccttttttgaggttcgaatccccagccgccattcttgataataaaaagggccccaaatgggacccttcttcaaattcgtactggcggagagctggggatgtccgggcatgctgcgcatgccctccggcttcaaagcctggcggcttttcgcccacgggctacaaacgctttcgcgtttgcttaacgcccgtgccctctcgggttcgaatccccagcctcctttctccacacaaaaaagggccccaaatgggacccttctttcaagtcatactggcggagagctggggattcgaaccccagatgcccttttggggcatactcgcttagcaggcgagcaccttcggcctctcggtcagctctccgtaacagctgttctatagtaaccaaacagccaaggatgggcaagaggaaattttctaattgcctagcatccgttcctccttggaagcttcgcctaccccagcgagcggttgagggagccgagctcgtcgttgcccatggtgcgccacatttggaagatgcaaccgcgtgccaggaaaaagaacccgttgtcgaccagttgcacagcggcatctgccagttgattcgtcacggcggacactggcggcagctcgagtccagccttgtggatggtctcgaccgcttcctcgaacgtcggaggctcgctgacacccatctcgttcataaggccctgcatttcttccagcgcgctgctgcccgactcctcgccgcgcggcaccagacggtaacaagccagtgccaggtcgagctgatcgcaattccaataggcaaacgccaagcgatagaacaggtagccgattgcagaacgatcgctggcaatgcgcaagccgtggcgcgccacctcgataatctcgtcaaagcgctccagacgcgcaagtacgttgatgagcgcaaagtgcgactgcatggacgagcgcgccagatcgtaaagatggcgcacctcgggcagtgctcgttcaaagtcctcttgctcggcgtaaaagctgcagatctcgtgctgggcaaagtacagcgcatcgggcgcacgaaggattcgcacagagcggtcttcttccaacaccggtagcaccatgcgcaccagctggttatcgcaaaactgcgtttgaaccggacctgtcgccaaaagctcggcgacggcgcacttagcctccaactcctcaacaagacgggaaaagccttcaaaagcacctgtacggtcgacttttgcctgctcgcgcaattcaacaacacgggccacgtatgggtcgtcgtcctcttccatgacctccaactcgtcagccgtatcggcaagcagcaaatcgcgcagcgccggcggcagcgtgcgatggtcatcacgcggacgagcatgaacctccgccggttcaatcgtctccggagcggttgactcatacgcctcaagcacacgcttgcacggcatatcgtccatgtccatgctctcaagatccttggcgacaggcacgcaatcggccagataggccgcgcgcccaaagaaatacgttgcgacaacgcgctcgccctgctcactgtcgggagcagcaatctgcacatagcagcgcgtgatgcaggtgcccgcggcaaaacacgctgccgcaagcgtgagtgccacacgcgcatcgtgctccgcggcccagaccgcgcgtgtgtcctcgtccagctcgcgccaggcgtcatcttgagcatcgtattcacgttgcggcatggcatccacgacagactgcccaaaccgaacgagcataatcccctcggcaacgtttgcccgataggtatagtcgagccgtgtgaccacgttaagcgcctcgacgatacgcgcgaagcgggtacgcacatcccactcaccgcccggctggcaagccaccgtacccggtttgccccacgggttatcgctcgaggccgtatcgagcagtcggggaacatcgttggtcgtcttggcgatatgccacgcatcaaagagcgcgcagccctcaaggctcggcgaggatgccgcagggaccaatccggccccgatgcgctcaaggataccggagaggcggttgagacggcactcgatggcaagcagcatgtcaatctcgtcctggtccagcaggctgcgatcaaaattgagatagaaaagctttgagcgatcgatgcgagccaggctcatctcggacttagcggcgatggtgcgcaagcgaggcaagtcaatttcactcataagggcggcggcatagcgctcgataccgctcggattctcggcatggtcaacgcggtagagcagcgtctcgatagcgtcaggtagcggtgtcgtgttaaagcccaaaaacacctcgaccggctcgggcagctttacgagcttgatcttgtcgacatcgttttgcataccctcgtcgagtccgtcggcgtccgccgtgctcgcaatggtattttcggagtcagcgaatatcacgtagcgcaggaacatcgatgccatgaactcaccgtaaggaagggagcgggtcgaattccatgtctcgtgatcggactgttcgcgcatgggaccttcgggagagccgacggttcgcgcgcacgcgcgcatcgtgccgtttgctcccctcaccataatctcaccaataccggagtccgactcgtcaaggaccagttccatgtcgggatcgttgggcagcggagcctcgctgacggggcggtccaccttgtacacctcacccgaaacgcttacgtagcccaaaagcgacacatggcttttgccaacgaattcgacgacataacaagattcatgctgatcctcgccaaagagtttccagaccacgccatatgagcgtcccgcaggctgctcgggcatcgccggaaagcgcttcttgggatcgagaaacctgagcttgtatgtcggacgctctgccacgaaatatcaccctgatcggtcgcttgagaaggagtggtcgcgaataagtcgcgacatctactcggaatcttacacgagtcgacaggaaatcgtccctttggacaaaagcactcaagctggcgcaaaagaaaagcccccgttgccgggagctttaatctcaaatggtgcggcgtataggggcccgtgggttataccctaagagcaaaccaccctttttaagggtggttctgatttgcttcgcgccatgtgggggtgatggcgacgtgcatttttgcgagtattctgcaatcgaaggcccctgcataccgacctcgggcaaaaaatcgggatttctcgatgttttctacgaatgatgggcggggttatgggccggcagcgtttgatttgcagggatatttgcgctctttggcatttatcgcggcgcccgaagcccttggttatgttgaatactcctaaaaatgcacggcgcttagagggggaccttcgcgaaaaaggaaaccgccccgtcgaagtatgcattcgacggggcggtttatgcatttggccgattaaagatgcgctgtcaaactactagaacttgacggtcggggcctggcgggctgcttcggcggcctcgaagccctggcgctccttaaactggaagatgccggcaaagatgacagccgggaacgtctggatggcgttgttgtagctgagcacgcagtcgttgtagctctggcgtgcatagctaatcttgttctcggtatcctcgagcgatgcctgcagctgcgtaaagttggtgtttgccttaagatcgggataggcctcggctacggcgaagagctggcgcagcgcgccggtcagcacgttgtcggcttccatcttggcctcgggcgtggtggccttgacggcggtgttacgcgcgctgatcacggcggagagtgtctcctgctcgtgcttggcgtagcccttgacggtctcgaccaggttggggatcaggtcgttgcgacgctgcagctgcgtatcgatgttctgccaggcgttatcgatgcggttacgcttggtgaccatgttgttgtagatgccggcgatggcgcagacaatcacaatgacaacaacgatgccgatgatgacggtaatcatgatgtctccgtttcgaatggccgcggcggcatgcgccagctgccgttggtataacgctactagtatacccgcaacgttttgccgtgccgaactttccggtaagcgttatgttttcggcggggtcggcaccggggtaaaacgctcgaggtacaggtgtaagatatgcgacagattgacgagtgttgtctttgccctgaggatggcgataccagtggaccttcgcattaagaaaacctaccgtgccctgttcgatgctttcaccgagcttctcgaggagcatcgttttgaggacctgacggttgccatgctgtgcgagcgtgccatgatccgccgcacgacgttctataagcatttccgcgacaagaacgattactttgccttttatgtcgacgagctaatgtcgggactgccgcaaaaacggaccggtaaggggggcgcagtgtcggccgacgacgtgcgcgtgcttcgccatgaggtgttcgccgatgccatggacatgattctggcacatgagcagctcatggataacatcctggagagcagcatgtcgggcatgctgaccagcatgatttgcgaccgcattgcccactccattcgcgagcgcgtgatgagcacgcttgacgagggcgccttggcccctgtatcgctcgagacgacatcggagtttatcgccggcggcattattcgactgttcaccaagtggtgggaatcgggtcacgatcttgagagccgacccgagattgccgacgtggtcgatgcgctgttcgagcggaccatgacgccggtgcatcactaagaatggcggagagagggggattcgaacccccggaacgctctcgcgctcaacggttttcaagaccgccgcattcaaccgctctgccatctctccgtgagtcgtaatgatagcatcgttttgaatttgcaacagggaaggcgaacgatgacgatcaccgaaatcgacgagaagttcatgcgcgaagcgctggccgaggcgcgcgctgccgcggcggtgggcgaggtgcccattggtgccgtggtggtgtgcgcgggcgagatcgtcgcgcgggcgcacaatcgtcgcgagctcgatcaagacccttcggcgcatgctgagtttgcggcgttgtgcgccgccgctcggacgctcggccgttggcgcctttccgactgcaccgtctatgtgacgctcgagccctgctgcatgtgcgcgggccttatggtcaacgcgcgcgtgggtcgctgcgtgtatggtgcggccgatgccaaggcgggcgcgctgggttcgctgtacgacctcaatgccgattcgcgcctgaaccatcgctttaatgtgacggccggcgtgctggcggacgagtgccgcgaggtactgagcagctattttgccggtttgcgtggcgcggatggcggcggttgcgggtccgatcttgaggcgcacgccgctcatgccgcggcgctggttgatgccgacgaggttgctggcgcggcggtcgaccttggccccgtgcagcgccggccccgtcgcgtgctgctggcgatcgactcctttaagggcagcgtgtcgagtgcgcaggcggagtctgcggttgccgagggcatgcgccgtgtgtggcctgatgccgaggtacgcgcgttgccgctggcggatggcggcgaggggacgctcgatgccgttgccgcgtgcggcggcgagatcgtgacctgtgaagttgcggcccccctgggtgatcgcgtgtccgcccgaatgctgctggatggcgcgcgcgcgtctgcggtcatcgagatggccgaggccgcgggcattgggtattcgccttgcacggagtcggcggcactggctgcctcgacctatggcgtgggcgagctgatgcttcgcgcggttcgcacgggggcgaagaatctatatataggactgggcggcagcgccaccaacgatggtggtgccggcatgctacaggcgttgggcgcgcgtcttgtcgacgaccgtggctgcgatattgcgccggggcttgcgggccttgagcaagtggccagtgttgatctggtgccggcggcgcgggcgttggatggcgtgcgtatcgtcgtgctttccgatgtcgagaatccgctcgtggggcgccgcggcgcactggcggtgtttggcgggcagaagggcctgccgacgggtgacgccgaggcagtgcatgagtacgacagctggatggtcggctatggccgcctacttgatacggcgattgccgaggctcgagcgcgggagttgctgcgcgtgcccgagggcgcgcggacgtttggttcggtactcggcgtgccgggcgcgggcgctgccggtgggctgggggcagccttgctggcacttggtgccgagctgcgctcgggcgtggagacggtgctcgaccttgtggggtttgacgagcgcgtgcacgatgccgacctggtcataacgggcgagggcaacatggacgagcagtccgccgccggtaaggcgccagtgggcgtggcacgtcgcgccaagcgccatggcaagccggtggtcgccgtcgtgggcggtcgcgccggcaacctggatgcggtatacgagcaaggcgtcgacctggtgctgcccatctgccgcaagcccatgcccctcgaccaagcgctcgatccgcaggaagccacaaccaacctcatctgcgccggcgagtcagccgcccaagcctacgacctcgcccgcatctaaaacgcatccctcgataagttgcggtgaaatagttcctgtttttgcggctcgagcggccaagcaggaactattccaccgcaacttcgagcagtcattttgggacggtagggggcaaggattgccggtggatttatttcggcgggtccccttggtggcgcgaatggttcgcttctacgcctgagtggcaacctgatgcggaatttcgggtcagccaaattgctacacttttaagtatattgcgatgtcccgccttgcgtttctgcgcggggggggggcgtatatttgcatcgatgaggacgacgacatacatataatgagccgctgcttgccgtcctcatggattggggagggccttcatgaatcgcgtatgtgcgagagttcgagaaatactggagccttttggcacaaaaaccaatactgccaagcgcgttctaaaggttttgaccgtcccgctggcggcgtgcgcgctcatgtttggtgcgacgagcgcatcggccgaccagacggttccctatagcaaccataccgtagagacggtgaatcctaccggcaccacggtcaatctgttcgactactgggttgtcgatggcgataacgacaattccgccaacgtaaacaactacaacgagaatgacaacaccggcatcaataaagaccatcagctcaagtttaatggcggcgccggtacgggcattaacaagtggacgggcagaagcggtactgctggctacggtcgccttcggtttgttgagaatcagcttgtaaatggctatccggcaatcaagaaaggcacctacacctcccaaggcaatggcgttaactacaccgatgagtcgcttgcatacctttttaataatgccagccaggccaatggcaagcagaagggcaaggccgtctacaacaacgtgcagggtctcttccagctcaaggatggctattacgtctacgactcgtacggctctaacggctctaacggcaactacgctgtgtataactccacgaccaattcctttgacgtctacgataaagcgggcgtatataagggcgatgcgagcaaagaaaccaatctgggccagttcttcccctttgactctgcaagcaaggtttttgatgagcagggcaacaacctttcccctaaaaagatcgttgatggaagcacggatctcaaccaccactttggcatgtccatgaccacggagtttgtccaacctgcaagcggcaagaccacaaaaaacgaggacatgatctttgaattctcgggcgacgatgatgtctgggtgtatatcgacggcgtgctcgtgggtgacttgggcggcattcacgagaaggcgacgctcaagatcaactttgccacgggcgcggtgcatgtcggccatatcgacaacgcaaatgatgccgaaaagaccattaaagacaccaccattagggcgatgttcgaagccgccggcgcagataccaaaaacttccgcgacaacaccttccgcgacagcaccaagcacaagctgagtttcttctatctggagcgtggcgcgggtgcatcgaacatgtcgctcaagttcaacctcaccaccctgccgtcgtccgaggtcgagaaggtcgaccagaacggccaggcagtccagggtgcaaccttcgctttgtaccagtccgatgaaaaatggaccgtgccagacggggctgagcctatcgcccaaggcacgacggacgccaagggccaactggtgcttctgaagtcggatggctccgttctctccttcgacgaagagcacaatgcccataagagcgactattatgtactcaaagagataagcctgcccgcggggtaccgctcgagtctgacctcgtcgacctccgcaaagtcaggtgagctgcatctgcagtacaaggaagctgcgagcggcacgggcggcgtggttgttgcaccggaaacaacggtcaccacggccgacggtacaacgcaatggacgggtagccgcatgtggctgaacggcggctatctggctgcaaaggagaccatctctctcaacaaagatataaaagacaataagaacaaacccatcaactcgggcacgacctttgccgtcgtgctcaagcgcaccgatgcgaacggggatcacacaagcgaagactcgtggacggcagtcacgggcaatccgctcaaaggctacaagctgtgctccgcgcatggcatcgccggtgccgttgaggccgcccagtcaaaggacacgagcgtctttgccgtcaacaccaagggcgactacgaggtgacggttaggtccctgcctggcgatatcgagacgtacgccgccatgatgaaagataagtcgaatgccgactataccgtggcggtctaccacaccacggcatcgtctctggctggggcaaccacggacaacacctctatggttgaatacaagtcgacaagcaggcaattctccaccgtaattcacctcaccaacgtccagaaccgcctgtttgtgcagaaggtcgacgacttgggcaagcccgtgaacggcgcgacgtttgagctgtaccaagccaaagacgttaccggcgatagccctaaaacctatgccattaaatcgggtgccgagccgtatgacaccgtgcaggcaaacggcatgacctatccgtatgacattgagggcgccgcatgcttcccactcgattcgacaaagcaaaagccccttatcaagggtacgtactacctgcgtgagtctgtaagcccggatggctatgagattaacaacaccatcaccaaggtaatcgtggacgattcgggtgtgtatgtggacgctggcgagaagggcgacgacgtgctcagcctgagcggcccgggctcgctgatcgcctcgttggcgcagtttggctctcccgactccattgacaacacgcttacacacatcaagggcaagcttcagagcgcgactggtgcagatgtcaagggtaacttgacgtggggccagacgagcaccgccgagggcgtgacgccttcgctcgaaaatgacttgatgcacatgcgctatgacaaggcgcctcagggcaccaagaccgttctgcgttatgtcgaggacaagggcgtccgcgacggtcagctggcgacgatctttgccgatacgggtatcaaccgcatggccctctatcaagagagtgactcaacatatatagaggatgcttccaagactcgcactgacctgggcacgcttcagctcaaccatctctttaccacggcaacggccgtgcagtataccgaccgtcgtgtggcgcgtctgcaagtgaccaagaccgtgacggcagacgatggccttaccgcgcccgccaaggatgcggacggcaaagatctgacgttcacgtttaagttcaccctgccggagtccgagaagggctacgaggcgcaggtgttcgatgcgaacggcaagccaacgggcaagtccttcaaactcaagaacggctatacccattccatcaaggccggcgagactattcgcgtgtacgaccttaagcagggcgacgagtatagcgtgagcgagctcaccaccaagggcgagtcggcgagcggcaacgtgctggcgagcatcgtcaacaccgtgaccggttctgccggcgactccgtgcttccggccggctttagccttgtgagccgtagggccggcggcgtggagcagtcgggccccggcaacactatcacgggtaagatcggcaagctcgagggtggagagattcccaagagcaacaagcttgagttcaccaacaactacagcgccagctcggtaacgcttgatgccaaagatcgcctgagcgtcaagaagaggctcaacggccgcaattggaacgattccgatacctttactgtgcagcttgcggccaaggacggcgcccccatgcccaacggcgccaagagccaggtgtcgacggtcgagatcaccgagaaagccccgacggaaaagattggagacatcacctataagacggcaacgtttggcgacatcacctataccaagccagacacctacacctataccatctcggaggttatccccggttccgatgccggggcgggcggcataagctattctgccgcctcctataccgcgacgatcgtggtggaggacaaccatgccggcgctctgttcgttaagagcgtgacggtgatgcaggagcgcaacgacgcgggcgccgagactaagaaggaggttaccgatagggtagcgaccttcaccaaccgctacgacgagcatgagaaggacatcatcatccatgctcaaaagaacctgactgacaaggcgggaacgtttaagcttgcccagagcgcctttggctttacgctcgagggcctgggtggctatacggatgccagcgtagcgttcgaccccacgacggtcgatgcaaacgtgaaggcccccatgccccagggcgccgagggcaacttcgccaccgtgggcaacaacgccgacggcacggtgacgtggccggcaatctcctatactgccagggcggatgcgggacacgcctacgtgtacaagttcgttgagaatcctggaagtgtcgcaggcatgacctacgacggatcggtctattacgccgtcgtgcgcaatgccgcaaagggcgctggcatgacgacctcaatcgagtactacaaggctgcggcagacggctcggtaaagcagctggataagaacgtcacgccttcctttaccaattcatatagtgtgaagcccgcgagcgtgacccttcagggccaaaagaccctgagcggccgcgactggaaccagggcgagagctacacctttaacctcaccgccgctacggacgatgccgacacgaccggtttgagcaagaccacaaagcaggcggtaacggacggtgccgttgccattaacaccaaccaggccgacgccggcgcgcccgagtcgggacgcgtggcatccttcgcctttggcgccgaggccgccccgaccgtgacgttcaaccgcgcgggcacctttagcttcaatatcaccgagaatgccgcgcaggacggccaggcgggcatgtccatggacaagcacaccgctcgcgcgaccgtcgtggtgaccgacctggacgagtcgggcaaacacacgggcaagctcgtatcgagcgtgacctacaccaataccgacgcctccgatgcggacaaggccgtaacagataaggctgcctttaccaacgcataccatgcgtcgggcacctttggcggcgtgacggtgagcaagacccttcagggccgtgcctctgctgcgggccagtttgcctttgtcgtgacgggcctttggtacaacggcgtccagacgtcggtcgatggcgccgaggccaacctgtccaacaaggcggcgaaggccggcgtgtccggcgccgtggtgggcgcgagtggggcggagaagctctttgcccgtaaactcacggagcaggatctgggccatacgtttgcctatcgcatccacgagaaccagcctgctactgctgccggctacacctatgacaccggctacaccggcgatgccatcgtgctcgttaaggttctagcacgcaaggacgaccccgctaagctctacaccgtgacgaccgtgctcaagggtgcgggtgtgacggagctgctgggcgacggcgccgacgcgagcgcgctgacggacgaaaagatcgtcgagctcaagcaagattcgcatacttacgtgcagcagtacgatgcaagtgagaccggcgccacgacgcctaccgtctcgtttgtgaaccgttatacggcaagcctcgactatggtactgctggcggtatacagatcgagaagacgctgacgtaccccgagggtgcgacggtgtttggctcgcccaagagcaccttccgctatatcgtcaagcctgccgacgagacgtctgccagcaaggttggcatttccacgaatggcaaggtctttgagaccgcaaatgtcgaggccaacgctcccaagaccgtgagtttgatgcctgcgggcgggctgaccttcaatcaggatgatgccggcaagacgtttacctatacggtgagcgagattgacgacaaagcgacgggctatacgtacgacgagacggtccatacggttagggccgtcgtagcggataacggcgacggcacgcttagggtcacgacatcggtaagcaagcaggtcgatggcaaggacgagctcgagggccagtggatctacccgtcggatgcgacgtctaccggtgtcgcgacggtcaaattcaagaacacctatacggtcgccgaggcagcaacctatactccgtccgtgaccaaggtggttgccggtgccaatgctccggacaagtttacctttgccatgaccgcggccgatgatgtcaccaaggctgctatcgacggcaagctcatcaccggctcctcgatgagtgcggagaacggctacgctgagaagaagcaaacgaaggagggcctcaaggacggggagcactaccagcttgacttctcgaagcttaccttcaacaagccgggcacgtataagttcgctattaacgaggtggctgcgaacagcggtcttggcgagtggaagtatgaccagcacgtctataccgtgacggtcaccgtaaccgatgagggcggcaaacttgtagcgcgtgccgatggcacgaccggctcggaaggcttcatctttaccaatagttaccaaacttcaacgagctacgagctccagggcggtttggagatcgtcaagacgcttaacgggcacgatctgcatgccggcatgtttggctttacggtgacgggcgaagacgatgcttcaatcgaaaagctcaacaagctgctgcgcgcggatgagggtaagctcaccgttacgaacgatgaaccgcaggccgatggcacgtcccacaccggtattttgggcggcctgaccttcgcgacgggcgatgcggacaagacgtttgcctacaagattgtcgagaatggcggcggtaggggcggctatacatacgactccacctattggaaggtagagattgcggttaagaagcgcgataacggttcgctctataccgtgaccacggtcaagcactatgacgccaacgacgttgaagagccccgcgatgcgaatacctttagctccgagagcggtaccgccaaggcccaggtgtcctttaccaacagctacatcgcgaccggaacattcgacggtcttgctgccgagaaggtaatggactccggcgacaagattgaggcgggtcagtatacgtttgacctgtatgccgagaagaccgatggctcgctcgaaaagatggatgagggtaagacccaggcgagcgataacggtatcgccacggtcgacttcggcaaggttaactttaagcttggcggcgctctcggcggatcccatgagttgactgacctcgccgccgccgtggcggatggctttgccaccaagcaacacaatgccgaccacaccactacctacagctttaacctggtggcaaaagagcgcttggccaacctgcccgagggcgtgcgtcccgtggacacgtccgcgacgtgccgcgtgctgctcgaggtgaccgataacaacaacggcaagcttacgtccaaggtgacctatcgcaatggtaccgagaacggcaagatcgtcttccacaacacacgcgataaggtcaagacgatcggcacggttgcgaagcccgatgtggacatcgacgggcagttgctctccgtgggcgactcctacgtctacaccattaactgggtcaacaccgaggccgatgccaatggcaacttggttccggccaacgtgaccgtgaccgacaagcttcctgccggcgttgtgttcgaggcctttgagggcgagtgtgccgataagggcgccgcgagcggacagtcgcttacttgggacctgggtaagcaacccgcgggcagccacggttcggtgcgcgtgcgcgtcaagattaccgaggacgccgtggaggatgcccagggcgctgtcggcaccgtcaaaaacgccgccactattacggttggcaacaagagctataccggcaccacgaccaactacgtgcccaagaagtccgagagcgacgctcaggattcgaagggatcgggcgtcaagttgggcgatgagctcacctataccatcggctacaagaacaccgagaacaagccggccacggtgacgatctccgatactgttcccgcggggaccgagttcgtggagttcgcgggtgaccataaggatgtcggctccaaggacagcgacggcaacctcacctggacgctggcggacgttcccgctggcaaggagggcacggtacagtttaaggtccgcgtgaccgaggatgcgtttaagagtggtggcgcttcggacgacatctccaaccaggcttcggtggcggttggcaacaaccctgccgtcaagaccaacaccactaccgacgatgtctctgacggtcgcttgacgctgagcaagacggtcaagaccgccgagggcattgtcgcgcccaacaaggcattcacctttaaggtgctgctctatcaggccgatggcacaacgcctctggccggtacctttgcgtacgccggtcgtcccagcggcaccaacggcacctatgtaagcggacagatcaagagcggtggcaccatcgcgcttaacgccggcggttccgttacggttaccgtgcccgtgggcgcgcactacgaggtacaggagctcgactccaagggcaacctcatgacgagcgaggacggctttgcagttgccgataaggcgaacacccagaagggcatcgtcggacaggcgacgcaggtgggcttcaccaatatctatagcgttgagtccacgaaggtggagaacgcctttaaggtccaaaagaagatctccggacgcaactggacgacgtcggatgcctttaccatgacgctgaccgcccagggcgaggcacccatgcccaagggcgcccaggacggtgtgtcgacgattgcgctgagcaaggacgttcaggtcggcaacttcggcactatcgagtacaccaagcccggcacctatacctatgtgattgccgagcaggcgggtgacgagacggcgctcacgttctcgaaggccacctatcgcgccaccgtcacggtgaccgacaatggcaccggcaagctgactgccaagaccaagattgcacagctgaccgacgatgccggtaatactgccgagcgcacggtcgaggcggcggtctttaccaacaccgctaagaccggcagcctcaccgttaagaagacggtcgtcggcggcgacggccagcgcgagttcggcttcacggtcgcgctgaccgacggggacggcgagcccgtctccggcaccttcggcaagggcgacggcgccgtgacgttcacggacggcagagcgaccttcacgcttaagcacggcggggagaagaccatcaccggcctgcccgtgggcgcaagctacaccgtgactgaggatgcggccgagggctacacgaccacggccgagggggccaagggcaccgtgaccgaggccggcgcgaccgtcgcgttcaccaacacgtacggaacggccaccgagggcagggacgtctccaccgcggggctcttcaccaagacgctcaagggccgcgactgggcggagggcgacagcttccagttcacgctcacgggcgaggacgacgcccccatgcccgagggctctgtcgacggctccaagaccgtcagcgtgacggccgccgccggcaccgaggcgggcactaaggtcgccttcgacttcggctctatacgctacacgcttaacgacatcaaggacgccggattcgcggaggtcggcggcaagcgcgtgcgtgccaagaccttcacctacacggtgcgcgaggccaagcccgatgacggctcggcgattgccggcgtgtcctatgacggccgcgtcgccacgatgacggtgactgtgaccgacgacggctccggcaacctcacggcctcgacgcccgcgatcgcgcaggtgagcggcggcgacttcgtcaacacctacacgaccgagctcgactactcggcccgcgcgggcgtgcgcctgtccaagacgctctccggccgcgccatggaggcggggcagttcgccttcaccgtgaccgccgacgacgagacggccgccaagctcggcctcaagaccggcaagaatgcctacgccgtggccgcggccgatgatggagaggccgccgtggtcgacctcatcggcggcgccgcgaagggcgacgtgacattcaccgatgccgacgcgggcaagacctacagcttcaccgtcgccgagaccaaacttggcggcgacggctacaccaacgacaccgagccgcgcacggtgaccatcgcgctcgcctacgacgccacgacgggcgaactcacggtcacgaccacggtcgtcaaggacggtgtcgaggtcgctcgcagcgaggtctcgacggccgatgacactgcgtcgctaccagcgcccgtgacggtggcgttccagaactcctacgaggccaccggcacgctcggcggcgagggcagcgtggccatcgatgccaccaagacgctgacgggccgcgccgcggcggcgggcgagttctcgttctccgtccgcgatgcgcacggtaacgtggtcgcgaccgcgtccaaccgggcctccggcgacggcgaggtcgcggagcttgcgttctcgcccatctcctacaccaccgacgagctcgagcagatggtggtggacggcaccgccaccagggccgacgacggctcctggaccatcccttataccgtttccgaggacacggcggcgctgcccgccggcgtgacggcgaccgcctcgagcttcgacatcacggtcaaggcgaccgataacggcaagggcggtctggatgtggccgtggcctaccccgagggctccgacggcaagctgtcgttcgtgaacggctacggtaccaacgaggcgacggtcgaccttgcgggcaccaagacgctggcgctcggtcaggccggactcggcctgacgcaggccgacatcgagggcaagtacaccttcaagattgagccgctggacggcgcgcccgcaccggccgacgcctccggcaagacggtgaccgaggcggtcaacgatgccgccggcaacgtcgagctgggcagcgtcacgttcaggcagccgagcgacctcgatgacgtcgagatcgacggcgacggcctgcgcaccaagacgttcgcctaccgggtgagcgagtccggctcggttgatggcgtgaccaacgacgcggtggcgtccaggaccttcacggtcaaggtggtcgaggacaccaacacgggcacgctcgccgcgaaggtcctgcccgccgagggcacgcccgagggcaagggtgcgttcgagttcaccaacacctacggcgttgacccggcaccgagctccgtcaccgaccagatcaaggtgaacaagaagctcaagggccgcgacctggccgagggcgagttcgagttccagctgatcgagatttccgccgacggcagcgagagcgtcgcggcgatgggcaagaacgccgcagacggcacggtggcgctcggcccggtcacctacaccgcgcccggcacgcacagctacgagctgcgcgaggtcgccggcacggcgggcggcgtgacctacgacagggcggcgtaccgcgtgcgcacgacggtcaccgatgctggggacggcacgctcaccgtcaagcacgagctcacggatgccgagggcaaccccacgggcgatgactcagtgacgttcaccaacggctacaaggccgcgcccgtcaccctcaagctgggcgccgccaaggtgctcaagggcgccgagcttaaggcggggcagtttagctttgagctcaagggccgggacggtaaggtcatgtcgaccgccaagaacgccgccgacggcagcgtcacgttcggcgcgctgaccttcaagcaggccggcacctacaccttcacggtgagcgaggtcgacgacggccaggcgcacgtgacctacgacaaggccgtgcgcaagatcgtcgtcacggtgagcgacgaggcggcagacggctccaagacgggctacctgtcggcgaaggtctcctacgagggcgacgccgacgtgccgccggtcttcaccaacagctatgccgaggagcccgagacccccggcacccccgagaaccccggcacgccgggcggcggctcgggcggcggttccgatagcggctccggcagcggcggctccggcgacggctccaagggcggcatgcccgacaccggcgaccgcagcctgccggtcgaggcgctcgcggccatggccggcatcggcgcgctggccgtcgcgggcggcgcggccctgtaccgcaggcgccgctagcggtatgcacgagtggggcgaatccatccgatgagttcgccccacttgccctgctgggcgggagcgggtatgatataccgagcgcctagcgcgttcgatgggttcggatgacgacatgttccgaatctggtcaggtccggaaggaagcagccataaggagcctctgtcgggcatccgaatccatcgagcgcacgggcgctttttggtgccgcgacatggtccgggaggcggcgaggtatttggtgtctcgctggtcctcggctttgcctgcgggatcgctcgactaccaaatacctcgccgcctcccggaccccgtcgtccaaaaatcacccgtagaggcgcatttatctgaataatttaatcccgtgctttgtgctgcttgctggcgttgccgggagcgcggtggccacgtggttcatgagacggcggtgctgtctcctattttgcaagtaaagaggtccgtttgcgaacgagcttcgactactgaagatgcgatgttcgcactaacgacatagcgtaattacggcattgttggtttacgcacaaattgaagaaatctaaaagatgcgtcgatttcacttcgcccgcagcgttacggcgcgagaacgtccaatggaacaacttggacgccgcggtcggtaacataggcttgtgaaccaaatccaataatcgctactttagaaaccggcggggtgtttccggcagcaaccatccgctcttcgacggcaacaagattgtcagatgcctcttcgatttgagcggaactgagcttgacctcaacgggaatccacatcccacctggagccgctatgacagcgtcgacctcaagatcgcgggaatcgtgatagtgataaaggcccattccgtttgccctcgcatagacccatagatcatggagcgccaacgattcgaaaagcagcccaagtgtcttgaagtctgacaacaacgtctccacagtcgccccgagcgcagccgctgcaagcgacgggtcggcaagatgatgcttacgcgcctccctcagatgtaccggagatctcatcgcgggattccatgcggggatatcgcagacgaaactcaatctgctaagaagggatatgtatgatgccgctgtttgtctcgatacgtcgccacccaaatcggccacaagcgtcttgagcgtcgcaagagtggattcgttgcgcgccaacgacgcgatgacggctttcactttctcaggatctcgtcgagagccatcgacgcgggggatgtcttcctcagcgactatctcgatatatcgttttgccgtcgcggacgcaattcgcgcgtcacgcccaatcgacgccggccatccaccgcaaacgatgcgctcggcgatctcggcagaacccatcgatccgaaggcgccattgaacttttcgccagaaataatgcccgacagcttaaccgcaccgctagatttcccaagttcgaaaagcgtcatggtgtccatgcgcaatttagcgaaccttccagcgccactgtgcatcggccgctcattgtctcgcggcgtcgccgaccccgtaaatatgaactggccaggctcgccgccgcggttgtcgcactcaaaccgcgccgcgtcccaaagtttcggaacctcctgccattcgtcgatcagccgcggcacctcgccggaaacggcaagcgccgggtccgtctcggcacggaagcgattctcgaagttgcgcgacgggtccatgaggaggagcctggacgccgcacgggtcccggccgtggttgtcttcccgcaccatttaggtccttcgatgagaacggcaccgaatatcccaagcatctggtcaagctcattttcgataattctagtgtagtacttttttggcatagttttcaccattgcttaccagcgcgtttaaccaaatttacagttttcatttaaccagatttcaattttttgattaaccagatttgcatatttcggttaacgagacagattaaacatgaacgagccaagtcagatgagaatcatctactcgacaccgcgcatgagctccgaaatggtgatgtgaaagccgtcggcaatcttgttgagatttgaaaggctgacattgcgctgcccgacctcaatgctcgcgtagtaggagcgatccatctcaatcaaattagcggacggagtgcccgggctcgttgcgcctagggcgcggcggggtcggcgacgtcggaggtgtcgatctcgccaagaatggcgagccggctgatgaacgggatgccctcgggttcgtccacctcgacgccgccgagcacgatggtgttgtcacgcatgtcgatttgggtcgtgaacacggcctgatcgcggcccgaggcgataaagccgatgcccgcgagtacgatgcccgcggcaataagcccgcccgccacggcgaggtaaatcttcttctccgctggtcatggtactcactcctttctacgccgcgagatacgcggcagcagcccggagagcgtcgcccccgccgcgaactccccatcctggacgagctgggctacgtgccgctggacatcgagggcgcgaggctgctgttccaggtgatgtcggtgccggagggcagacagagcatgatcgtcacggccaacatagagttcagcaagtgggtgaccgtgttcggcgacgacaagatggcggcggctgtcgtggacaggctcgtctacacgggcaggctcgtggagttcaacggcgcaagctgcagaattgaatcccgtgttttgtgctgcttgctggcgttgcctgggcattgatggctacgtagttcaagagacgttgctgctgcttggattttgcagttaaagaggcccgtttccctggttttggttggggaaacgggcctcttttgggtttgtggattgacgaaggtgacgttcgtcggcagctattttgagttcttgaggcggcgggtggctgcggcggttattccgagtcccatggcggcgattcctgcgagtgcgattgcgctcggcgttgtgtcgccggtgtttgcgagcttgtcggcggtcgtagttgcttgcttgccgccgcccgtgttcgacgagcgggggctcctgtcgtttccgtgccctcggattgggtcatagtgtctgtccgtcctccacctacggcgttgtcctggttggcacttagggacgtttctttttggtgcaaagcaacctgtctccattgcgccaagcggcgtgtgccgttaagcggagaggcgtattgctggcccttcgtttgggcatacaatggctattggtttgctgcggtgaaggcctgtccgctccgcagcttttttctacggttaaaggagtatgtatgtccgttgaggtcatgaggtctgtgatcgaggccgccgagggtcgcgtgcccgtcgacacgctgtttgccaacgcgcagatcgtcgatgtgtacggccagcgtgtggcgcccggtagcgttgccgtcaaggacggcgtaatcgtcggcgtgctctacgacggtcgcgacgatgccgccggcacctacgaggcgaccgaggtcattgactgccagggccgctatctcgcccccggctttatcgacggacatctgcacattgagtcctcgaacatccgtcctgccgagtatgcgcgcatggcggcgacgcgcggtaccactaccgctattgccgacagccacgagatcgctaatgtttccggcttggacggcctgcgctttatgatcgaggacggtcgtcgtgctcctatttccatcaagtacatgatgccctcgtgcgtgcccgcactgcccgacgagcaggctggtgccgtcatcactgctgccgatatgcaggcgttttttgccgaatatccgggtgatgtctttggtctgggcgaaatgatgaacctgccgggcgtctttatggccgatcccgagacctgcgctcgtatcgacgctgccaaccagacgccgtccaaacaggttgacggtcacgccccgctcgttgccggcaaggacctcaacgcctatgccgcggctggcattatcgccgaccacgagtcgacgattcccgaggaggcactcgacaagctatctcgcggcatgtacgtgatgctgcgcgagggcacgtgcagccatgacctggccaacctgtcgccgatgctgctggagaatcccgcgcgcgctcgccgctgctgctttgcgaccgatgaccgcgccccttccgatgcgcttgcgaccggcatgatcgacaatgcctgccgcgtggcgattgaggccggtatcgaccccgtggtcgctatctctatggcgtccctctccacggctgaggcatttggcttggaccacggctgtcgcgacccgcatgagctccgtggcgcgatcgccccgggcaagcgtgctgacctgctggtgctcaatgacctgacgtttgccgcggctccgcatcgcgtatatgccgccggtgctctggtggcgcaggacggcacctttgtgggcgagatcgcacccgagatggccgaggttgcggcccttgccgatgagctgcgcgcctccgttaagctgccgaagctttcgctcgacgtattcgactatgcctttaagccgggcgaggccgtgattgacgtggtgccgggtaaggccatcacgggcatggttcgtcccgagactgacgaggacttgcgtcgcattatgctgattgagcgccatggccgcggcgtgtcgctgcaggccgagggcgccgacggcgacggccccgctggcctgggcctggtcggtaagcatatcggtcgcggctgggtgcgcggtttcaccatcacgggtggcgccattgcctccacgatcggccacgactcgcacaacgtgtgcgtggtgggcgacaacgccgccgatatgatggctgctgtcgaggccgtgggccagggcggtcacgtgctggtgcgcaacggcgaggtcgtggcgcgcattccgctggcgctcggtggtcttatgagcgaaggcacggccgaggacgttgccgcacagcacgacgactttatggtcaaggcgcgcgctatgggtattgagccgccgctcgaccccatcatgggcatcatcttcctgcccctgccggtgatcccgacgctccgcatccgccccgagggcatgttcgacgtcacgaccttcacctacgccgactagtcatcggggacgttctttaacgattagccatcggggtggcgtgtcgcctggcgccgtgaccgtaggacctctggcatgtgtgagctatttgccaggtccttgtaacgtttacgcccgcggagtcttatttgagctccctttgggtacgttgaaatcggatacacgttcgattccaacaagcccgaagggagcttttctatgtttaaactgattgcatccgatatggacggcacactgcttgacgaaaacggccaggtgcctcccgagacctacgaactgattctggcgctacacgagcatggcgtgcatttcgccgcatcgtcaggtcgtcgctacgatcgcctgtgcgagttctttgcgcccgttcgcgacaagatggactttgtcgccgctaacggtgcccaggtcttcgccgacggcaagatggtagaccgtgaggtgtattctcacctggcgattcgaaggctcgcccaagccgtcaggacgtttcccaatctgcatcttgcgctttttgaccgaaccaagtccttcttgctcgatgacgagtgcaagttcgtgcgtgaggtcgataaggaccttcccaatgccgagcgtatttgggagctgcccgatcccagcgtaaatatcatcaaggcgagtatcttttgcgatgacggtgccgttatggacagcgcttacgtactgcagcgcgaactcggtcagctctttacttttgcgccttcgggtaacgcgtggattgatgccatgcagcccggcgtgtcgaaggcctcgggcatcgcgcagcttgcggagcattacgacgttggacgcgacgaggtcatggcgtttggcgactcgatgaacgactacgagatcattcgctttgtcggcacgggctgcgcgatggaaaacgcgcgccccgcgctcaaggcggtggccgatcgcgtcgtaggctgcaaccgcgaccatgccgttcagcgtgagctccgccgcgtgctggagagtctcgcttaatccggcagctggggacgttccttttctgccggcagtgggggacagcccttgcagctttttcgcgaagactgtccccaacgactagtcattcaagaacgtccccagtgactggccaatgactaggcgagggcggccatgatggtgcgggcgacgccgtcgtggtcgttgtcgaactcggtgatggcgtcggcggccttgcggtcctcgggctcggcgttgatcatggccatgccgtggcccgccgcctgcagcatggggatgtcgttgatgttgtcgccgaaggcccaggcgtcggcgagaggctcgcccaggtgctcgcatagccacgtgagggccgttcccttggtggctccctcgcccatgacctcgatattcatggcgtaagaacgcgtgacctcaatgcctccgagcgtgtcgagctccgccgcgatggcgtcgcgatcggccgggtcgtgccagtacatggcgatgcgttcgagcgtctcgacctcgtcgatcttgctgtcgatatccatgtcgatcggtgttcgtgtgcgcttgagcgaagccgcgatgtgggggtcgccgccgcagaactcatccaggcgcgtgtagagcgagcgggggaggaagcactgcccgtccgcgaagatatcgaaggtcacatcgtggccggcggcgatgcgatggatgcgatgggcgatgccgcaatcgagcggacggctcaagatgcacgtggcgcgcgaggcgtcggtgggcacatcgtcgtcgagctgccagacgctggcgccattggcgcaaacggcatagtgcacggcgggatgggcgaggatgggttcaaagatgcccgacagcgggcgccccgtgcagggtacaaactcaataccgcggcgcgcaagctcgtcgagcatcgcccaggtggtatcgctcatctgcttatcgctcgtcagcagcgttccgtccatatcggaaaacacaatcatttgatgcagccctttctactggcataaaaagcgtggccgagggcggtgatgccctggccacgctcgagttctataacggtccgcgtcctagcggtcggcgagcggcttgtactccagcggctcgatcactggacgataggccgggcgaataatacggtgcgcgcagaagagctcttccatgcggtgcgccgaccagccggccatgcgggcgacggcgaatagcggcgtaaaaagcgtttcgggtacgccgagcatcttgtagataaagcctgtgtacaggtcgatgttggcgcagatgggcttggtcatgccgtggtcgcgcatcacctgcggtgccaggcgctcgatgcgctcgatgagcgcgaactcatcgcccaggtccttcttggcggcaagtgtgcgcgcgtaacggcggcacacctcggcgcgcgggtcgctcagcgtgtagacggcgtggcccatgccgtagatgagacccgtgccgtcgaaggcctgcttgtcgagaattttgcccaggtaggctgcgacctcgtcctcgtcctcccaattggagacatgcgcacggatgtcctcgtgcatggacgcaaccttggcgttggcgccgccgtggcgcgggcccttgagcgagccgatagccgcggcgtaggcggaatacgggtcggtggccgaggaggacagcacgcggcaggcgaacgtggagttgttgccgccgccgtgctcagcatgcagcatgagcatcacgtcgagcagcatggcctcgtcgcgggtgaatgccatgccgccgcgcagcacctgcaggatggtttcggcggtggagaggccgggtgtggggtgcggtacatgaacctcggagccgcggcgcttggcgaccgaggccatatgcgcgaaggcggcgatgcgggggagacgggcgagcatggagatggcgacgtcgatttcgtgctcgggtgtaatggcgtcgggctcggcgtcgaaggcgtagagcagcagcacggcgcgctgaagcacattcatgatgctcgacgacaccgtggtcatggggaactcgcggacgtattcgtcgctcaggtgcctaaaagcacccagacgttcgcaaaaaccgtcaagctcttccttggtgggcagagagcccgtaatgagcagataggcgacctcttcgtagccgtagcgatcctcggcctgggcgttgttgaccagatcctcgatgctgtagccacgaagcgtgagtttgccctgatcgggcacgaccttaccgtcgaccttgttgtagccgtgcacgtccgagatgcgggtaagacccgcgaccacgcccgagccgtcggcattgcgcaggccgcgcttgacgttgtgctctacgaacaagccctcgtcgtacggggcggtcggcaggccgtggtagaggttttcgctttcgggcgaaatctgacggctcgcctcgtaatccagaaccaggcggctcaggtgatcgtcgaagcggtagtagattttcttggcgtcgtaggccatgcgcgctcctctccggtccgctttggggcggcgcgcttggacgatatgacgtcaagctgccccgagcggcttgttcgctacaggcggtacataaagttaaagacgtcctcgcgctggatggacacgttgacgcccgaaagctcgcctgcctcggccagggccttctgcagctcggcgaagtcgagcttggactcggcggtgtcggccagcatggtcatggtgaagatgtcctcgataatggactgcgtgatgtcgcggatgtcgacgttggcctcgcccagaacgcgggtgacgccggcgacaatgccggggcggttcttgccaaggacggtgatgacgatgcgggaggacgagatctcggccatgggaaaccctttcgcgtggttgcggcgcgcgggggcgctccgctacggtacagtgttcatcattgtacctgtctggcgccaaaaggggcacctttgctgcggcgttacacgtctgcaacatgggagaaggggcaaaggcgcccgtttgccgcgattcgtcgtgtcgtctgctgtgtcttgggcgcgatgcacagtacaaagaccgtgaaccttttgtgggacgctcgacgccgtggtaccatagccgagtttgttgtcttggtcggaaaccaagacgccttatgcgctgatcggtaaccagcgcctgaccaataaggagtcctaccatgaagcagggtatccatccccagtatgtcgagtgcacggtgacgtgctcctgcggcaacaccttcaagacgcacgctaccgtgtccgagatgaaggtcgagctttgcaacgagtgccacccgttctacaccggccagcagaagttcgtcgacaccggtggacgcgtccagcgcttcgccgacaagttcggtggcgccgctgccgcccagctcaagaaggccgaggaggccaaggctgccaaggccgccaaggctgctgaggccgaggccgctcgcaaggccgccgctgaggctaaggctgccgagaaggccaagcgtgccgctaagtttgccgaggaggctgccaagcaggccgccgaggctcccgcagaggctcccgtcgaggaggccgctgccgaggccgagaccaccgaggctgctgagtaaatagcttgccgagcaaacactcgcattcatggcaaaagggccgcgcatccatttgggtgcgcggcccttatctttttattggtgcaaaccaacctgtccccattgcaccaggttggcgcgaaggggacaggttggtttgcaccaaatggcagagaggcagcgttttcccagataaaagctgccaaaataaaccagtccctttttggcaggctgtcgtagttattacgtggtcgagcgtgtcgaccgcataggcggcgccttgtttggctaaagtacaaatatctgtgtttaactcgtccaaggtttcatgccacgggcgatggccaaaaaggaaaaccacatgggattcatgtcaaagctgctgtcctttggatccgataaggacctgaagcgctactacaagatcgtcgacaagatcaacggtcttgagccccagtttgagaagatgaccgaggaggagctccgcgcccagaccgataagttccgtgagcgctacgccaacggcgagtcgctcgacgacatgctccccgaggcctttgccaccgtgcgcgaagcttctaagcgcaccatgggcatgcgtcactttgatgtacagctcatcggtgccatggcgctgcacgagggccacatcgccgagatgaagaccggcgaaggcaagaccctcgtctccacgttggccggctatctcaacgctattgccggcaagggcgtgcacgtcgttactgtcaatgattaccttgccaagcgtgactccgagtggatgggccgcatctataagtacctgggcatgacagtcggtctgctccagaacaacatgccgctcgagctcaagcgcccggcctaccaggccgacgtcacctacggcaccaactccgagttcggctttgattacctgcgcgataacatggtcacccgccccgagcagcgtgtgcagcgcggccacaactacgccatcgtcgacgaggtcgactccatcctgatcgacgaggccagaacgccgctcatcatctcgggcgccggcaccaagtccgccagcacctacaaggacttcgcgcgcgccgtgcgcggccttgagcgcggcgaggacgtctcgcacgacatgctcaccgccaccgaggacgtggagcccacgggcgactatgtcatggacgaggccaagcacaccattgccgccaccgagcgcggccttaagaagattgagcgccgcctgggtatcgatgacatctatgccgatctctccggccagctggtcaaccacctgcagcaggcgctgaaggcccagtacatgttccaccgcgacaagcagtacgtggtcaccaacggcgaggtcaagatcgtcgacgagtttaccggtcgcatcatggagggccgccgctactccgagggcctgcatcaggccatcgaggccaaagagggcgtgctcgtgcgcgaggagaaccagacccttgccaccatcaccctgcagaactacttccgcctgtatgacaagctctccggcatgaccggtacggcactcaccgaggacgctgagttccgcgagatttacaagctgcccgtcgaggtcattccccccaacaaacccgtgcagcgtgttgaccacgaggacctggtgtaccgcaccattcaggccaagtacaacgccgttgccgacgacgttgagcgtcgtcacgccaagggccagccggtcctggtgggtaccgtctccatcgagagctccgaaaagctgtccgccgccctcactaagcgcggtatcgcgcacgaggtcctcaacgccaagcaccacgagcgcgaggcccatatcgtggcccaggccggacgctacggcgccgtgaccattgccaccaacatggccggtcgtggtaccgacatcttgctgggcggcaaccccgacgagttggtgcgcgagcgcctggagtacgagggcctgaccatggaggacgtgacgcccgagcagctcgagcagtttaacgccgaggccaaggagacctgcaaggccgagcgcgagcgcgtgcttgccgccggcggcctgaccgttatcggcaccgagcgccatgagtcccgccgtatcgacaaccagctgcgcggccgttccggccgtcagggcgacccgggcgagacccagttctacctgtcgctcgaggatgacctcatgcgcctgtttggcggcgacaagatggaccgcgtctccaagatgatggtcacggccgacatgggcgacgacatgcccatccagcacaagatcatctccaaggccgtcgagagtgcccagcataaggtcgagagcattaacttctccatgcgtaagagcgttcttgagtacgacgacgtcatgaacaagcagcgccaggtcatttacgccgagcgcaacaagattctggatggcaaggacctgaccgaccacatcaccgaggtcatgcacgacacggtgtaccgctgcgtgcaggagttctgcaccaaggacagccatgagggcgagcgtgatcttgagggtctgcgcaaatgggtcgtcgagctgaccgggcatatcgatacccctcagttccccgacgaggactttgaggccctggctgccgatgtcctggcctatgttgagaagtgctacaacatgaaggccgagcgtctgggcgaggacctgatgcgcgagctcaacacccaggtcatgctgcgcgtcatcgatacgcgttggatgaattacctgcaggagatggactacctcaagaccggtatcggcctgcgcggctttggccagcgcgacccgctggttgagtacaagaccgaggcctacagcgcgttccagatgctcgtcgataccatgtacgaggattacctgcgcaccgttctgcgcattgagatcaaggctgccccgcaggctgtggagcacaaggaggaccccgccctcaagggtgcgcacttctctggtcccgccgaggtcgatggcgacaacggcgattcggtactgcgcaagcaggctcaggtgcaggctcgcaccgccgtccagggtggcccggctgccgttaacaacggtggcaaagtgacgacctaccgcaagtccgagagcgatgacccctatgtcaacgtgggccgcaacgacccgtgcccttgcggtagcggtaagaagttcaagtactgccacggcaggaatcgttaatggccgaggctctagaggtaacgcccgccgagttggacgcgtttgcggaccgactcggcgaggtcgagtcatatctccatttggacgagaagcgcacccgcgtagcggagctcgaggccaaaagcgtcgccccgggtttttgggacgatgccgacgccgcccgtgtcaccatggaggaaatcgcgcgcaccaaggaagatatcgctgccgtggacaacgcgcgcggcgagctttccgatgcccgcgccgcgctggagcttgccgaggagatgggggatgaccccgatgccgccgcccttcgcgaggaggctacagccacggctgagcgcctggcccgtgccatcgatgagcttgagctttcgagctggtttaccggtgagttcgatcacggcgatgccattgtgaccatcaagcccggacagggtggtctggaggcccaggactggaccttcatgctctttaagatgtacatgaagtactgccagcgtcgcggctggaaggtcacgattaacgactgccccgctgctgaggtcatcggcatcgaccgcgcgacctttaccgtcgagggcaaggacgcatttggcatgctgcgcgccgaggccggcgtccaccgcttggttcgcattagccccaccgacgacaagaagcgccgccagaccacgtttgccggcgtcgaggtcatccccgtgctacccgatgatatcgacatcgaaatcagtcccgatgacatccgcgtggacgtgtaccacgcgagcggcccgggcggtcagggcgttaacaccaccgactccgccgtgcgcgtgacgcatttccccagcggcattgtggtcacctgccaaaacgagcgcagccagatccagaacaaggccgcgtgcatgcagatcctcaaggctcgcctgtacgagattgagctcgagaagcgcgccgaggccctggatgagatccgcgggcccaagaccacgattggttttggcaaccagattcgcagctacgtgctctacccgtatcagatggttaaggacctacgcacgggcgttgagaccagcaacgtcgaggcagttcttgacgatggcgacctggacccgtttgttattggctaccatcgctgggccactggcaacgctgacgcagagatcccatctgcataaaccgcccggtttatgtggaaatggataaaaccctccgagcagggtggttttgtatccaaagcaaaccctgcgcaggggtggtttttgttcggcgaatcggtagaatcgaatacagcaagaagttcgaagcgcatccgtttgggtgcgcttttttgagggaggtagcatggcatatcgtctggacatcaagcgcattctatcgatgaacttctttcacgacctgccccagattatgttggggtgcgctctggccgctattgcgaccgacctgtttttgattcccaacggccttgctgccggtggtgttacgggccttgccaccattatccaggcggtcggcgcatcgcgcggcatatcgcttcccgttggtattcagacgatcgtgatgaacgccttgctgttgctggtcgttatgcgcgagggcggcatgttctacgtggtgcagaccgcgacgggctttgtgctgctgggcttctttaccgatctgttcgccccgtttgtagcacctctggcggatgcggacctgatgctccctgccatgtggggcggcattattacaggcatcggttacggcatggtgctgcgcgccggcgccaacaccggcggctcggacacgattggccaaatcatctcgcgtaatacctcgctgcccgtgggctcgaccgtcatggcgatcgatgttgccgtatgcgcgctgtcggctccggtcttttcaatcgaaaatgcactatatgcaggcctttcgatggtcattagcggctacgtgatcgatgccgtggtcgatggtggcaacaaacgccgtatggtactcatcatctcggacaagttccctgatatcgctgccgatatcatgtatggcctgggtcgtggttgtaccaagtttaaggcgactggcatgtattcgggtgccgagaagccggtgatcatggtcatcgtgaaccgtcgagagctcaataccctcaagacgatcgtgcgcgagcgcgatcctcacgccattgtgacggtcgccgacgttacggaagctttcggcgagggattcaaggacattagcgcgtagggccgaccgcgtcccatccaaaagacgttcacattgataaaccgtttcatcagcggttctgcctgctaaattgttcaaataatgataaaaactctggtaaagccatcagtttccagcataatgaatgacgtacgtgcattgcggctgtgttgggattaccttcggtgccgtgcgcattttgtctaatgaggatgaaaggaaggcacaatgagcgacgaagagctcaaaaaggttgccaacgaggtaaggaagggcatcgtcaccggcgtgcacgctgccaagtccggccatccgggcggttcgctcggcgctgccgacatcatgacctatctgtactttgaggaaatgaacgtcgacccgtccgacccccgcaaggccgaccgcgatcgcttcgtgctttccaagggtcactgcgcgcctggtctgtacgccgtgctcgccgagcgcggattcttccccaaggaggatctcgagacgctgcgccacatcggcagtcacctgcagggccatcccaacatgaacgacactccgggcgtcgatatgtccaccggctcgctgggccagggcatctccgccgccgtgggcatggcggttgccgccaagcactggggcgatacttaccgcacgtacgccctgctgggcgatggcgagagcgaggagggccaggtctgggaggccgccatgtttgccggcaaccagcagctcgacaacctctgcgtgatcgtcgaccataacggcctgcagatcgatggccccgtcgaggaggtcaacgaccccatgccgctcgccgacaagttccgcgccttcaagttccatgtggtggagctcgccgacggcaacgacttcgaccagatccgcgccgcctttgccgaggcccgcgccaccaagggtcagccgaccgccattatcgctgagaccacgaagggcaagggcgtgtctttcatggagaaccaggtgggctggcacggcaaggcccccaacgatgaacagtttgagcaggccatggcagagctcacggccgccggagaggagctctaggatggcagacgtcaagaaaatcgccacgcgcgtaagctacggcgaggccctcgtcgagctcgccaacgagcacgatgactttgtggtcctcgacgccgacctggccgccgccacgcagaccggcaagtttaaggccgcctgccccgaccgcttcttcgatgtgggcattgccgagagcaacctgatgggcgtcgccgccggtatcgcgaccaccggtcgcgttgccttcgcgagcagctttgccatgtttgccgccggccgcgcctttgagcaggtccgcaactccatcggctatccgcaccttaacgttaagatcggtgccacgcacgccggtatctcggtgggcgaggatggcgccacgcaccaatgctgcgaggatatcgctctgatgcgtgtcatccccggcatgaccgtgatcgttcccgccgacgacatcgaggcccgtgccgtgacgcgcgccgcctacgagtgcgacggccccgtgtacatgcgcttcgcccgtctggcctcgccggttatcaacgaccccgagacctacaagttcgaggtgggcaagggcatcgtcatgcgcgagggcgccgatgtgaccatcatcgcctgcggcctgatggtcggcgaggctctcgaggccgccgagcagctcgctgccgagggcatcgacgccgaggtcatcaacatgcacaccatcaagcccatcgatgccgacctgatcgtcaagagcgccaccaagaccggccacgtcgtgaccgtcgaggagcactctgtgatcggtggcctgggcagcgccgttgccgacgtcctgtgcgagcagtgcccgacaccgctcaagaagatcggcgtcaacgacaccttcggtgagtctggcccgggtgccgagctcttgcacaagtatggcctggacgccgccaacatcgtggcgaccaccaaggagttcctggcctaagacgaggtggctcacagccggcctcatgccaacaacattggaatgcgaacggggcgctctctataagagggcgcccctgtttcagttgcggtgaaataaggactgattagcccttttaacttgtaaaacactccctatttcaccgcaacttttgaaggcgttcccgcttgtgctggctgcggtgcgacgattgattgctgcctagcacagggccgccacatcgggcgcgtcgttgcctttgtatgccatggcaagcaatgcggcgtcgtagatctcgttgttggtcatatcgacggcgccgatggggcggaaggtgagtatcgagtcttgctcggcgagttcggccagattgatcgtttcgcccgtggcgaagacatcgtcgagggtgagcgtggcgctcgtgcacggaatttgatagatcgtgccgtcggcggcgatgggggagcctgccgcctcgagcgtgtacacaccttgaatgaggctgataccggaaccgtcggaggctacataatcaacctcgtcgactgctatcccgtcgacagttttgcccgtaatgtgtatcgggacacgcgaggccccgttatcggtatcccaacctgtggccgagatgttgagcacaatagcatgctccgaatgagccgatataaagcaagacatcgtctgatacaactgaagtcccagccagctgctaccggcaagggcgatcgtcaacatgcaaacaaggacgactacaatatgcttccgagactgtatccaaagcgccgaggcagccgataggccatgaacggcaaccccacaggccgtgcagtacctcacaccatcgcgcaactcagtgccacaacaaggacaaaccataccagcctcgcaaccaaagaagatcccaacgaggctactgtaagtcgatcaatccaatccaagttgcgcaacaattagcccaaatagaagttgcggtgaaatagagactgattaggccttttaactggtaatacagtccctatttcaccgcaacttatgaagatgtcctgtcaagcaaagccccatcagggaaaagggcccagaacagaaaagtgcaattcagccaaccccaagcatggcgctgctgcacctcaagaaaaacgcggcgaccccatagtagccgcaggccgggcgcagggttacctcccaaatctttccgcaggacggagggagccccgcagcgcgaagcgcgcggcggggctcccgacatgtccgaggacgatttgggaggtaaccctgtgcccggccggtgggaatagaagcacgccatgcttcttatgtgcagcaaagctaatgctgctaaaatacaaagcgctcatgtagtttaaacgcacgacgataaggagcaccagtgggtaaccacttccgtacctccggtgcgggcgatgatgcccccaagacgcagccaggcgtccagggcagtcgtttcgccactccggattcagagggccagcatgtcgatcaggcccccgttcagccggcagatcaggcacagccggcatccgatccctttgcctacaatcccaccagcgatgtcgcgctttccggcacggcgggttttgagcccgtccagaccgtaaccgctcgcgtggagcagcctcaggctggtgccgccgcgccgcagcctactatggccggcatccccgaccccatggctcctgcgacaccggctccgcagcctgcgcagtctggtctttttgccgctattcccgaccccacgcagcccgctgcgccggtggtcgagcgcgatcaggccgccgaggtcgcaagtctcgacaacgcgctcaacaaccccgattttacgtcggtgttcgcgcccatcgacccgcaggcgagccgcaaaaagatggccaagcaggccggtgtcgagcctgtcatcctcatggagcacgtcaccaagatctacccggcgcagcccaacaagcccgcgctcgatgacattaacatcgagatctaccctggtgagtttgtcttcttggtcggtcactccggctcgggtaagaccacgctgctgtcgacgctcaaccgcgacgtcaagccgacgagtggccgcatcttggttgccggtcaggacctcatgaagatcaagaaccgcaaggttccgttcctgcgccgtcagattggcgccgtgttccaggactttaagcttctgccgcaaaagaccgcctacgaaaacgtggcgtttgccctgcagtgcatcggcaagcccaagggcgtcattcgcagccaggtgcccgaggtcctgcgtctggtcggtctggccgatcagatggactccctgcccgaccagctttcgggtggcgagcagcagcgcgtcgccgtcgctcgcgctatggtcaaccgcccgccgctgctgatctgcgacgagcccacgggcaacctcgacccggcgatttcgctgggcatcatgaagctgctcgagcgcattaaccgcaccggcacgaccgtgatcgtggctacgcacgaccgcgagatggtcgatagcatgcaccgtcgcgtgatcgccctcgagggcggccacgttatccgcgaccaggagaggggaggttacggcaactatggcaccaactaacgtgggctactccttcaaggaggcaatcagccacttcttccgtaactggaccacctcgctcggcgccgtcatcacgattttcctttcgctgtttatcatcggcctcttcattatgggctccgcgatgctgaactccgtgatcggcaccgtcgaggatcaggttgtcatcaacgcgttcattagcgatgacgccgatcaggccgatgttcaggcttttgaggccgagctcaagacgtggagcaacgtcaagtccgtgacctacaaggacaaggatgacgcgctggccgagtatacgagcaagatgtcgggcaacgccgacgctaccatgagcgcgctcgatggccagaatccgctgccggcttcgtttgcgatcgagatggacgatccgtccaaggtcgagagcacggctgagaagctcaaggacgacgccgatttccagaagatcgcggatgatggcgatgtcaacgcgagcgtactgtacggccaggaggaagtgagccgcctgttccaggtgactaactacatccgcattgccgctgtggtgctcgtcggtctgctgacctttatcgcgttcatttttatcaacaacacgattcgcttgtccatcacggcgcgtcgtcgcgagatcgcgatcatgcgtctggtcggcgccagcaacggcttcattcgcgggccgttcattaccgagggcgtgctgcaggccattttgggttcgctgctttccatcggcgtgctggagctgctgcgcaacctgatgattccgcgtttgcaggagagcatcggctggatgtcgtttgccctgccgatgcagtactacctggtgacctatgctgcgctggtcctggtcggcgtgattatcggtctctttggttctgccatcgccatgcgccgctacctgcgcgtgtaggcatgtctggatttcattccttccaacgggtcgtctcttatggggcggcccgtttttttttgattccgatgcgacggcaggatcgcggatcatttgggtagactctttggagtccgcaaccgatagtaaggaggcgccatggggcgcaacaacaagcataagcgcggtgcccgcaacaagcgtggaccggtgcgcagcgagcgccgcccgagtctgaccggacgcgtgcagctccatgagcacagtgcctatgtcataaccgagaacggcgactacaaggttatgggtcgcggtaagcgcgaaatcatggacggcgataccgtcgccgtgagcattaagaacagcccacatggtgagcgtcgtgccgtgattgagggagtcgtcgagcgcgctgccatcagtgtggtgggcacgtaccagacggccggtccgctcggcgtgatcgagccactcgattcgcgtctcaaggccgatttctttattttgcccgaggacacctcggccgagcgcttgggcgttcatcccggtgacgctgtggtcgcacgcattctgacctatccgacgcgcttggaatcgggcgccgtgaccattgagcgccgcattggcggcgatgacgcgcccgacctgggtgttcagtatgtaatggcgcgttatggctataccgatagctatcccgaggcagcactggccgaggccgaggggctgtcgctcgatgtggccgcggcgctcaaagatccgcttcgacgtgatctgcgcgaccgctttatcatcacgattgacccggtcgacgcgcgcgactttgacgatgccatttctctggagcgcacgcccgatggcggctacaagctgggcgtccacatcgccgatgtctcgcactatgtggcttgggacgggcatatcgatcttgaggcgcgccatcgtacgacatcggtgtatctggccgatcgcgtgcttcccatgctgcccgaacgcctgtccaatgacctgtgctcgcttcgccctgatgaggaccgtcttgcgtttaccgtcgatatcgagctcgatgcgcagggtcgcgtgcggcattacgatccgtaccccagcgtgattcgctcgcgtgtgcgtatggactacgacggcgccgaggcgctgttggtgcgtgccggcgcggtggagtatggggtgctggagggtgccgccgaggatgtcgcggctgtagagacttcgcgtgaggaagcgctcgagcgtgggcttgcgtgcgaggaaactgctcgcggctataacgtcgatctgggtgattttcttgtcgccgccaacgaactcgccgagcttcgccgccacattcgtcgcgcgcgcggttcggttgacttcgatacggccgagattcgcgccctgttggacgaggacggcgtgcccgtgcagattgtggcgcgtgagcgctcgtgtgccacgtcgttgatcgaggaagccatgctgctcgccaacgagtgcgtggccgagtggcttgccgaccgcgatatcgaggcttgctaccgcgtgcatgaagaccccagtcccgacagcctgcacggcgccgccgtggcactggctcagctgggtattatcgacgaccgccgtgcagccggtattgccctgggaaaccccgatgagctgcaggccgcagttgatgctgccgccggtacggccaacgcgccgctcgtcaacacgctgcttctgcgcagcatgcagcgcgcgctgtataagcctcgcaacgagggccactttgcgctcgccgcaccgtgttactgccactttacgagccccatccgtcgctaccccgatctggtggtgcaccgcgtactcaagctgcagctggcttacgagcagctgggcggcaaggacgccctggtccgcacgccgcgcctgatcggtaaggggcgcgagtcgctgccgcgcattctgccccagatttgtcgcgcctgcagcgatgccgagcgcgcggccgacgccgccagccatgcgacgcagaagattaaaatcgctcagtactacgaggatcgtctgggtgagcgctataccggaaccatctcgtgggtcagcagcatgggcctttttgttcgcttggatttgacgcaggtcgagggcctggcctcgattaaaagcctgggcaacgagtggtttgagttcgacgaggacgcgcttacactgacgggcgccgacacggggactcgttatgagctgggccagcgcgtgattatcgaggtctcgcgcgttaataccacgcgtggacacttggactttaagcttatccattagtcgaatcccgaccgtgcggggagcggggcggtccttcggggccgcccttgcatttgaatgatggctgcgtcgccgcctgctcggccgcctatccgcctgctatttgggaggtaaaacctaccaaaataaacctgtccctttttggcaggtttacaagaaagcggggatgagatggcgactgtgtacggctatgcgcgcgtgagctctcgtgatcagaacctgaatcggcagtttgatgcgctgatcgcctatggcgtggagtctgcgaatatttatgccgaccgtgcgagcggcaaggacttcgaccgtccgcaatatcgcgatctgctgcgcgtgctgggggatggggacgtgctggtggtgttgtccatcgatcgcctgggtcgtaactacagcgagatactcgaggaatggcgcctaatcacaaaagagcgcgggacggccatcgtggtgctggatatgccgctgctcgacacgcgcgcaaaggatggagaagcgccggacgtgacgagtacactgattgccgacattgtgctgcagctgttgagctacgtggcgcaggtggagcgcgagaacatccaccagcgtcaggcggagggaattgggttgatttccgatctcagccgaacacattgagcggataggccgttcccgcaacgagcgggggctcctgtcgtttccgtgccctcggattgggtcatagtgtctgtcggtgccaagacatcggcgttgccttagctggtgcttggatcccttggggacggaggaaaatgtaccatccagaatgagcgtggataatctcccggttttggcctgtgtgggggctcaaagtgggagattgtccacgctcatttgataagtgtccgaaaatccacgcttgttgctacttgagtcctggcaggcgggtgtaggggaatgagcgctctaggaactcggcgcagcgggcgtagtctttggcgaagtagctgctgtagagcgaatcgagcacgtattgcacggcgatgtggctggcgaactgcgtgatgcggtgcgtcatgctctcgtggtcgctcaccgtgagataggcggcaaagccagggtggatgcgcgtgcagtaaggcgtgccgatgacgatgaccgggacatgccggctgctgaggatcggcaagatttccttgaggttgggcgcgaggccgctgtaggagatgacgatggccgcatggccggaatccgaggcgagcgccgtgcgcacctgggcctcgatgctgccgtagcacgtggcgcttttgccggacgaaagcaggcggtcgcggaacatccccgctggatagaggttgtgcgagcctgtatagatgtcgacctgccgtgccttcgcgatcagtttggcggcgtggtcgagctgcgcggggtcgagcatttcctgtgtctcggccagtgtggtctggtagagaccctccatgcgttccataacctgtgcaggcgtggatgtggcatcgaagggaaagttgatgtccacgtcgcggcggttgcccgcttcggtcgccaggcggataagctcgaccttgaggtccttgaagccctccaggccgagctttttgcagaagcggtgcacgctcgcgaccgaaacgttggtgcgcgcggcgaactccttaatggagagcccgcggatgtcctcgcccatggcaagggccgagataccgagctgctgctcggtgggggtaaggccctgcgcctcggaaatcttgcgtttgatatccattcgaactcccacactcgccaaacctgccaaaaagggacagggttattttggcaggttttgcccgcaaagggtaacggggccgaggacgccgctgggcgcgatgggctcggtgaggacaaagatgtcgggaatcgcatggtcgagcgtgttgatgacgtcgatggtgagctcatgcgtgccagcggcaagcgggccggcggcaaagcgatagggcgggcagatgcgcgtgccgagcgtttgcccgtcgagcgtgagcgtcgcgacttcgtagacatcccccaggtcaatggcggtgtcggcgaggtcgcaggccagctcgaacgaggtgcggtagcggtatgtgccgcaggtgccggcgaactgctcggccgtgaggtcgcacaggtgctcgagcttttgcggctcgccaaaggccccgtcgcctccggcgggggagagggcgacggtccaggggctgtcgatatcgaggacggacgcaccatccgcgctgctatcggactcgacttcgccgtttgcccccagaacaacaatgcagctctcgaagggctccagctccaacacgccgtcaaacgcgacaggggcagcatcgtttagcaggtcgaggcgcgtgccgcaaaggcgttcgcctgacggaagcgaaacggcgcaggcaatgctctcacgtggatgctcgttgacttgcatcacataggtctcgcccgcgcgctcgtagcgcagtgcgcgcagccagggctgcggcgtatcggtcacaacggtctgcagtcccgcggctgccagcacgtccgccacgccggcaagtggtgtcgccgtaagcccgtccagctcggccgcgccatccgcgtcatagaccgcgccgggcacctcgtcgacggcaagcaccgtgacgcccgcagccatcatgcgcctcgccgcctccgtcgtagcagtgccaataaacgaggctccgggcagaacaaacgcctgataacggcagccgttgacggcaaacgttccatcggcgatcgaaacctcgtaacgcccctcatcctcaaaagcctcggttggcacaaaatcaaagtcgatttgcgcgcgcgtgagctcggccgccacgcgctcgacgggcatggcgttgccggcccattcggcatcggcatggtacagaacggcgacggggcgggtggcagcgcctcctgaaagcaacgaggcagtgcgattcatatagctcatgagctggccaaagtgcggccattgcgggttgttgccatgcgcgtaaaagtgcggcgggcagtcccaatcggggaagggcgccatgctaaacgcgtgcggcgtaaaccaattaacgccgcggacgagcatgtggtcggcgatccacttcatctcgcgcaagccctcgtgccagccaaaggcgccaaagacctcggccatacagcgcccctgctttttggggtcgaggcgcgcggctgaagagcccagcttggcaagcgcgtacgtaaagaactccatgttccacgcgccgtggaaatagctgtagtgcccacggtcaattccgggggcaagctggttgatgaccacatccacgccggccatgtcctgtccggcgacggcgcggaagtagtgcccggcgccttgacccagacgcgtgtggcaacccttgtcctcgatcacatgtccaatgtgcataacgccgtgcgtgcggcaccaatcgccgatctgctcgtcaaagcagctgcggtagagctgggtggcaatgtccatgtagacgtgtcgagcgcgggcgccgtccgcctcgcgcgtccaaaggccgtgcagttgggcaagccaatcctcgccgagcgcatcgcgcaggcgacgggcaagctcgtccgaccacggcagcgccaggtcgcctcgcccgataaagctgctggtagaagcatcgtcgagtgtggtgcccttctcgttcataaagccgggctcgtcggtgaaaaagcccaggatggtcttgccgaactcgtcgcccaggtgctcaagcgtgcgctcatagacagcgtcgatgagaatgcggcacgaggccatatcgaccatgttgatgtactcatcgcgaaagccggtcttttggctggtgacgtacagctcgatcgtggtgacgccggcgggggcgttaaaacgcagacgggtaggggcgccgtcgtcggcctgctcaacggcgatcccaaggtgcagcggcgcaccggcggcatcaaaagccgccgcgcccacataatgctccgtggggtccatgagattgccgagcttgatggtcgtggacggctggggaccgacaaccgttatcgtgcgatgcttgagcacggtcttcttgagcgcggggtcgacgccctcgccttcgagcgcgccattggcatagcccgtggggaagtgcgcgtcgtcgagcagccaggtcttcagccccagacgcttgcactcgccgatgataaagcgcaggtcagaccaccagccgtcgcgacagaaatcgggatgcgtgcgcgattccaggcagacctcgcggatgtccgccccagcgatctgctccagatactcggtgatcgtctcgcgcgcctcgcccttgagccacaagaacggaagcacgtggttgtcgtagatgccgccaagcacctgctcaaaatacgccgccatatacgctcctccaaaacagcctttcaaattcattgaagtcagagtacgccgagcgcgccgccctgctaatatcaaaaccacggcagaatatgaccgaatcaacgatgggagcactatggagctcgcgcgtctggataacctgctactcgagctgaccgacagtgaacgcgcctatcgttcgggcgcccattacgactggagcgatgcgctcggtcaaggtgatcacacagataacgatggtcgacatgtccgtaaaatcggcaacccaacgctcgtcctgcaccaagagggcatgcccgagggcctgtcgatcgtgcgcaattcacgcttcaatcctgtgccggaacacgttcacgattatgtcgaaatcagctatgtctatcgaggacgagcgccgcaaatcgtcaatggcgcggcgctcacgcttgctcaaaacgaggtcctcttgctcgatgccgcctgtccgcatgccgtaggcgagctcggcgagcacgacattatgctgagtgtcatcatctcgcggccaatgctcagccgcagcctggagcaaagtctttcgcccacaagcgctgtctcgagcttcctgctcaacgccctcacggacgaaacggaccaccgcggacacgtgcatttccatacgggcggcagccgtcgcgtgcgccgctacatgcaggagatgctctgcgagcgcttggagccgacggcggcgagcccccagatcgtctcgaggttgttcgagctgctgctagtcgagctcatgcaaagttacgaggccgcgctgctgcaaacggacgagcccgcgctgccatcggcgcaggtcgcggctgccatgggcttcatcgagcgcagcgcctgcgactgcaccctcgatgacctcgcccgccacctgcacctgagccccaactacgcaagcgctctgctcaagcgtcagacgggccgcacgtttatgcagctcgtgcaggagagccgcctggcacgcgcagcggcactgctcgacgccggcgccaccgcggaggtcgcagcgcacgaggcgggctatgccaacatgagcttcttctacaaaaagtttgccgagcactatggctgcacgccggctgcctatcgtcagcgtttgcccagataaaaccgaccataataaacctgtccctttttggcaggtgtcaggaagtgtcaagggcagggtggcggcaggctgcgggcgcgaaaagaagtgtcgggtttggctccatcgcctccgcatgccccgcacgtgggcgatactcggattatcgacccacgatgcaaaggagatgctcatggcaaacatcaagttccccgagggtttctattggggtggcgccaccgccgctaaccagtttgagggcgcttggaacgtggacggccgcggcgcttccgtcgacgaccacttcctgggcggcagctacaaggagccgcgtcagatcacgatcgatatcgaccccaaccgcttctatcccaaccatgacggcatcgatttctaccatcactacgaggaggacatcgcgctgttcgccgagatgggcttcaacatgttccgcatgtccatctcctggagccgcatcttccccaacggcgacgatgccgagcccaacgaggccggcctcgccttctacgaccgcgtcttcgactgcctgcgcgcccacaacatcgagccgctcgtgacgctttcgcactacgagatgccctatcacctggtcgagaagtacaacggctgggcaagccgcgagctcatcggcttctttgagaagtattgccagaccgtcttcgaccgctaccaggacaaggtcaagttctggctcacctttaacgagatcaactgcggcaccatggacatgggcgccatgatggagaccggcctgatccagggcttcgagggcccggcaagcgccatcaagaccaccgctcagcagcgcttccaggccctgcatcaccagtttgtcgccagcggccgcgtcgtgcgctacgcccacgagcactacccgcagttcaagatgggcaacatggactgctttatcctctcctacgccgccacgtgcgatccggtcgacgtgttcgccacgcagcagcagatgaactccatgaactggtactgctccgacgtgcaggtgcgcggcaagtatccgttctatgccaagcgcttctgggccgagaacgacgtcgagctcgcaatggaggacggcgacctgcaggatatcgccgacggtaaggtcgacttctacacctttagctactacatgtccggcaccgtgggcacccacaaggaccacgagatgaccgagggcaacatgacctttggcggcaagaacccctacctggagtccaccgactggggttggcagatcgacccgctgggcctgcgcatcgccctcaacgagatctacgcccgctacgagattccgctgatggtggtcgagaacggcatgggcgcctacgacgaggtcgagggggacggttccattcacgatccgtaccgcatcgcctatctgcagagtcacatcaaggccatgggcgaggccgtcgccgacggcgtcgacctgatcgcctacacctggtggggccccatcgacctggtgtccgccggcaccggcgagatgcgcaagcgctacggcttcatccatgtcgataagtacgacgacggcaccggcacctacgagcgccgccgcaaggacagcttcttcgcataccagaagatcatcaagtccaacggcgctgagggcttggagtaattgagttccggcgattgagttccggcgttctgacgaacgccggaccggcggccgatttcgtgaccacgaatgtcgacgacgacggcatctggaacgccttcgtgcacctggggctcatcgagggttaatcaacaaaacgggcgccgatggacaaagacgtcggcagagttttcgattcgactccccaccttagtttttggtccaattggcactataatcaccataggcatgcgcactacgttgcgcttaatcaagaggagaaaacgtatgggtctgtttgacatgttcaagaagaaggctgagcccgcggctgccgctgctccggcctccatctctgcttctgccggcgccgacgtgctgtgttcgcccgtcaagggcaaggtcatcaagatggccgacgtgcccgatcccgtctttggtggcgaggttctgggcaagggctgcgccgtgtggcccgaggacgatttggtctatgccccctgcgacggcaaggtgaccgtcaccatgggtcacgccgtgggcctgcagtccgatagcggcatcgaggttctggtgcacgtcggcgtcgataccgtcaacatgaacggcgacggcttcgagggcttcgtcaaggctgacgatgtcgtgaaggccggccagcccatgctcaagatcgaccgcgccaagatcgccgctgccggttacaaggactgcgttgtcgtggccgtgtccaacaccgccgagttcgccgatgtcgagctcgccgtcgaggccgactccgccgtcgccgccggcgatgctatcgtcaaggttgtccgcaagtaaatcgcggcatcgcatgatgtctaagggtggtcggattgtccggtcacccttttttattgcacggtacggatgcattttattgcacgctgagcggactcgcagaccgttcggacgctaaaacgaaccgaccgcgccttcgtgctgccgagggtgttcataagtggatagtatgtgcttactatcacaacgtgcgccgtgtctgggaagcacggtgccgcttattgggaggacaacatgaaaaagaagctgctgcttgcgcccctcatggccgtcttggttgcatgcgtggtcgtgctttccggctgcggaggcccctcggttgaggagctcatcaccgaggaccttacgactcagttcgatgaggtcaaaaacggtggcgacgatttcctctctggtctggaagaggcttcgggcgacgagttcgagcagctgggcatcgatcccaaggagtatgccaagacctatctcgagggttttgattacgagatcggcgacgtgacggtcgacgaggacaagggcgttgcaaccgccgaggtctccatcacctgcaagtccatgaacaagatcgtcgaggacttctccacccagtatcaggagaaggtcgctgcacttgacacggttccttccgatgacgagctgtacaagatggccggccaggtgatggtcgatgtggccaaggccaccgagcccaggaagaccacggttatcttcaagtacacctgcaacgatgacggcgagtggtctgccgacgactccgtcaactccgagatgatggatgcgatgctgagctagttcgttacggcgttttaccaaacgccgtaactgctcgacgctgcgcgggcaccagagcgacaacttgtcattcaaagaggacggcatgaccagaaggtctatgccgaactgcgggaacggcctatccgctcaatgtgttcggctgagatcggaaatcaaccaagtgaatttttggcactaaaattgagtattgccctgttgaccgtgggtgttctttttgctaacacgccatgaggacacgcgtgcgcgccccgacacttcaaaaccacagtctgttcgctttacaacatgcaaacatgcgttcgataataggggcatggaatatcgacagacagatggcaaaacacggcgcgtgcacaagcagtacgtggacgtcgtggcccgcatcctcgcgggcggacaagtcgtgccggtcaccgtctgctgggtcgacggccgttgctttacgattgacgagatcgtctcgaccaccgggttcggtctgacggttcacggcatccgtacggcaacatataaggttcgttttggcgggcatgcgaccgagttatatctggaggaccaggcgcgcgaacgggcggatggctcgcaggcgcatgtgatgcgttggtgggtatgggcgttcgaccgcacactcgagggggagcgccgtaggtaagagcacgcagcattcgggtacaatggcagaaatcttgtcatctacggcgccgtcattcgcggcgctttttgaaaggacgaagtatgaacgatattcagggttatcagaacggccccatcgagaccggtgcaagccgcgctaaagagatgtcgccgcgtgcgtacaaccttgccatgtccgccctcatcttcttgggcttttgcgtcatgggcgccggcgcctactttacgagcaccatgtcgtttgcccgcatgatgatgagcggcgccgctctgccgctggtctttggctcgtttatcctgaccattgtcggcatcgtcatgatgtcggccgctgctagcaagcagtcggtgggcctgtcccttgtgggctacgtggtctttgcgagcacctttggcctgacggcgtcgtttggtcttgccaactacgacctgcccaccatcaacaccgcctttatcgccactgctgccatcacctttgtctttggcgcgctgggcgtaacattccccaagttcttccgacgcgtatatggcattggttttggcattctgctcgccaccattctggtcgagatcgtgctcatgttcatgggcgtttcgcagaccatcaccgatctgatcgtgattgtggtgttcgccggctttattggctacgacacctatgttgccacgacggtgccgcccacgctgcccaatgcggtgcttatggcgtccaacctgttcgtggatatcatcaacgtgttcctgcgtgttctgaatatcctcggtcgtcgcgactagtgcgatgccttgcgttgctcttatcgggcgcggtaaaacgatgcgaaaggcggtccttcggggccgccttttttatgcgtggcggggtatcatggatggaaaaagccgatagcggcagcgacaggaaaggtgaccacttatggcagacgtcgacaacaggaaccgtaaccgcaggcccaaccgcgcggggcagccgaaccctaagcgtgaggctcgcgccaaggctgccgagcgtcatgtggcggctgtgtccgaggcctgcgccaaggatatcgagcgctcgcttgccggcgttcgcgagttcgacggcatgcccgccggctttgtcgcggcgatgaaggccaaggcccaggcggtcgtggctgctgaggaggcggttgtcgaggagacgaaggccgccgagaccgttgaggtcgacgccgccgaggtcgaagctgcggttgaggccgagcctgcgcccgccgaggataccgccgaggatgccgccgagcctgcgcctgccgaggagcccgctccggtcctgcccgaggtcaccgtgctcgatgcttcggccacgcaggccatcctagacaacggccgtggctatgcgcagttctgcgatatggccgtgctcgcctttgcctcgtttaccaatccgggcggcggctatatccagggttatctgggccaggaggcgacgctctgcgccgattcgtacctgtacaacgtgctcgacaagcagcgtaaatggtatggcgagaaccgccgtcgcaacatcaactgcgagctctaccgtaaccgcgccctggtggtgcccgccgtgcgcttcgaccgcaaccacgtgcatgcgtatgccgacgtgatcgtggccgcagcgcccaacgtcaagcgtgcccgtcaggagtaccgcgtgagcgacgacgccctgctggacgccctgcgcgaccgtatccgctttgtcctcgccatctgcgacgagctgggtcgcgagaaactcgtgctgggagcttggggctgcgacaacaacggctttgacgccgaggctgtggcagagctcttccgcaaggagctcgcgtcgggcgactttaaggtcaagcaggtcttcttcgccgtgccttccacgcgctgggacgaggacttcgctaagttcgagcacgtgctggcaaacttccccgagcgcaacgaggagtcctatgcccaggttgccgcccgcgccgcggctgcccgtgctgccgagcaggcgaagtctgctgctgaggatgatgaggacgaagacgattggcgcaagtacctgtagggcgacgcgcgcgatgtgacatgccaagccggcgggaggagctgctcctgacggctttttactgagtgaggagctcaagatgaaaaacgttctgtgctttggcgacagcaacacgtatggctacgatccggcgggtatgcgcgacggcaccgcggtgcgctatgcgcaagatgtgcgctggtgcggtgtggcccagcgcgatctgggcgagggctggcatgtgatcgaggagggcctgaacggtcgcacgacggtgcgcgacgatatgtaccatctggacaccaacctcaacggcattcgcgcgctgccgatgctgctggagtcgcataagccgctggatgccattgtgattatgctgggcactaacgactgcaagaccgcttttaacgtaacggccaccgatatcgctgacggtgccatggcactcgttcgcacggtccgcgtgtttccgtggactgatgccgcaccctgcccgcgcattctgctggtggctcccatcaagattaagccgcagattgccgatgtgtatatgaccgagtttggcgagcatgccgtggaggcgtcggagcattttgccgagtactacgcgtgggtggccgagcagctcggctgcgactttatgaatgccgccgactttgccgaggcgggggatattgactatctgcacatgatgcccgagggtcacgagagcctgggccacgccgtggcggccaagctccaagagatgctcggtgagtagtccgaccccaaaccaccacagccatctttgcggtggtttggggcgtttgtttgtctcgatctgtaacatctggggttgattttgccgagtaattgttacagattgagataaataaaagggtgcgaataaaaaatctcgatctgtaacaggtagacctagaaatggactctaactgttacagattgagatatttgcgggaaccaccacgaaggtgcctgtcccctttgtggtggttttgactgtgggttttagtactgccacatgtggttgacggggccggaacctttgcccatgtccaggccggcggcgagggcgcctgttaggtaggctttgccggcattgatggcgtcggcgaggtccatgccctgggccagcgcgcaggcgatagcggacgagagcgtgcagccagtgccatgcgtgttgctggtctcgatgcgcttgtgacggaaccacgtggtgagcggatcacccaggtggtttccctcgtcatcgagcggcgcgggctcggccagcacgtcgttggcctcattgacaaaatgcccgcccttaacgagggccgcgcagccaaagcggcgggtgaggagcatggcggcattttgctgcgtacgctcggaatcgacctcatagtcgagcagcgccatggcctcgggaatgttgggcgtgataaccgtcgccaacgggaataggcggcgggtgagcgcctcggcggcatcttcggcaatcagccgtgcgcccgaggtggctaccatgacggggtcgactaccacgtttgtcgcgttccaggcgctcaggcggtcggcgataacatcgataatctcggcagccgaaaccatgccaatcttgacggcgctcgggcggatgtcgtcaaagaccgcatcgatttgcgcagcgacgatatcaggggagatattctgcacggcggtgacaccgagcgtgttttgtgcggtgatggcggtgatggccgtctcggcatacaggcggtgcgccgtgatggtcttgatgtcggcctgaatgccggcgccaccgctggaatcggatcctgcgatggacaggacggcaggtaccttactgcgatccatgtttgctcccttgttcggtcggaatcaaatgggtctttaagccagcattataaagatgcccgggccgactctatgtcgaacccgggcgggcgatgcaatctttacgcaagtgtaagcaaatgttcacacgtcaacaattgacgaacaccatgttaccgattgtggctccggtgacgagttagtcctccatgccgaggtcgatcgtcgtgccttcgaacaccttgttaacggtgcggacggcgcacatcttgccgcacatggtgcaggtgccctcggtggcggcgggggattcttcgtagcgtttcttgccggtgaccgggtcgagagcacacttccacatggcatcccagtcgagcttgcggcgtgcctggcccatcttgtcgtccatgtcgcgggcgtgcggcaccttcttggcgatatcggcggcgtgcgcggcaatcttagtggccatgaggccatcgagcacgtcctgggcgttgggcaggcacaggtgctcggccggcgtcacgtagcacaggaagtcggcaccggagctggcggagatggcgccgccgatggcagcggtgatgtggtcgtaacccacgccgatatcggtcaccagcggcccgagcacatagaacggggcattgtggcacaggcgcttctgcagtttcatgttggcggcgatctcgtcgagcgccatgtgacccgggccctcgaccatgacctggacgccggcggcccaagcgcgcttgcacagcttgcccagctcgatcatctcagcggtctcggtggcatcgttggagtcgtagaggcagcccggacggcaggagtcgccgagcgaaatcgtcacgtcgtactcgtggcaaatctcgagcagctcgtcaaagtactcgtagaaggggttttcgttgccggtgacctccatccagccaaacagcagcgagccgccgcgactgacgatgttcatcaggcggccggtctccttaaaggtcttggtgaccgacttgttgatgccgcagtggatggtcataaagtccacgccgtcctcggcgtgcgcgcgcacgacctcgaacaggtcgtccttggtcagcttgaccagcggcttttccatgtagccgatggcgtcgtacatggggacggtgcccaccatgagcggcgtctcgtcgatgagctgctggcggaactggcgcgtcttgcccgagttggaaaggtccatgatggcgtcggcgccaaagtcctcggcgatcttgaccttcttccattcctcggcggcatcggctttatcgcccgagatgcccaggttgacgttgaccttagtagacaggccctcgccgacaccaaaggcgcgcatgccttttttgatgtgcacgatgttggcgggaatggcgatgcggccgtcggccacgcgctcgcggatgtactcggggtcgcgatgctcgcgctcggcgacttccttcatctgcggcgtgatctgcccggcgcgggcgaagtcgatttgcgtgacgagcttgggctcggtctgtgtgctcattggcacggctcccttcgttggcattacccatatcaggtttgcgggtcagggcgggcgcgcccagtctcagcctgccgtcttgtcctgcaagctccccgtttatgtaatgggctcaagtatagctcgaatgggtacgattggcctaacgagcgtgcctgtggggaggcgaacatggaagacaagcatctatatcgagagacgcaatgggatgtatcggccgaggaaagccgtgcgcaccatggccttgtcgcgattggttttgcggtgcttgccgtgctggtgattgccttttgtatctggacgtttggcggtcacggcggcgctgcatgggagttcgaggccgacgatgccctgccgatcatgacagtgaaggttacgggcggcaataccgttgccgcgccgggcgactattggtatccgcgcgacgagtttgtgcagctgcagttgagcggcgggtctattccgggcgaagaaatcgaacgcgtgacgtatgatgcggcgctcaaaacgctgacggtgaagctcaagaatcagggcgacgtgcctacgactatggatatcgcgctgacggaatggcgcttggagcccccatcgggtgttgcggtgtccgaggtagagcacgttaagattacctaccaagatggctcgacaaacgaagttgccaaagccgacggcttggcggaatagacgccgtgcctaggcagcacattcaaaagtagcggtggtcctacaaggtctgttcgttcaggaagaccaaagtgttcttatttgaaagctcgggaaagtgacgataaccaacatcaaacgcggtgagcccgcttacatcctcgagcttgttttctgccatccagcgcaccatggaaccacgtgcctttttgctggcggtcgagcgctggatgggcttgccgttgcggatgccttcgccaaagaggcacgtgacgaccgtggcgtcgcccgcgagatggggcagaacggctttggcgtactctacgctggcgaggttgacgatcgtggtgtttgagcctgccggggcgatagtccgcgcgagcttgtcgctccaaaacgcatagaggtctcgggcatcgtcaacggcgagctttgcgcccatttccagccgatatggttcgacggcatgaaaggggcgaacgcacccgtaaaggcccgagaggatccacagatggtcttgcagccatgcgagctgcgcggaatccatcacctcgggcgccatgctctggtattgaatgccgtggtaggacatgacggcaggggagaggtgacaggcgagtgcgggattgtcgagatcgccgtttttcaggatgggcccgaactcatgcagggtgttgaggcaaggccccagcagtttgtcactcacgttccatagcgcctgcaggctgtcgctgccttcattccgctcgatatctagcagtgcgcggtggaggcgagccgtctcgcgcgcaaagggtggaatgcccaggacttcaaaagcatcttgggccgcgcgcatctgcttggcgggcgaaatgacgacctgcagcatggactctcctctgccaaaaaggaagttgcggtggaatacggtctgttttggccgtttatgggccagtttagtctgtatttcaccgcaactgatgaagggttggttacgcgcgctcgatgaaggccttgtagccgcgataggcctcgtagatatcggccttgttagcgacctcccacagggcgtgcatggacaggacggcaacgccagagtcgatgacgttcatgccgtacttagccatgatgtatgcgatggtgccgccgccgcccgcgttgacgcgaccgagctcgcaggtctggaagtccacgccggcctcgtccatgatgtcgcggatgagggccacatactcggcgtcggcgtcgttagagccgcccttgccgcggctgcccgtgtacttgttaaagcacaggccgcgacccataaaggctgcgttcttggtttcgaacttgccggcgtagcccgggtcgaagccggcggacacgtcggaggagagcatgcggctgcgggcgagcgcgcggcgcagggccagcgggctatcctcgccggcgagcgtcatgatctcggcgacggtgttctcgaagaagcggctcgtcatgccggtggcacccacggaaccgatctcctccttgtcgacgatgagtgtgatgctcgtgcgctccacgttggcgacgttgatctgggcgagcatggacggataggcgcagacacggtcgtcgtggccatagcccagaatcatggagcggtcgaggcccatgtcacgggcggggccggcgggcacgacctcgatctcggcggaaaggaagtcctcctcctcgacgtcgtactgctccttgaggatatccaggaacatctgcttgacgggctccttgggagcgtccttgtcgtcctcgtcaaacttgacggggcggccgcccacgatcacgtcgaggatctcggcgtcgacggcgtccttggcgggcttggccatctgctcgctcgagaggtggatcagcaggtcggagatggtaaagaccgggtcgtcggccttgtcaccgatgttgatgtcgacggtggtgccgtcctttttgcagatgacgcccacgagtgcgagcggggaagcgacccagtggtagctcttgacgccgccatagtagtgcgtgtcgagataagccatgtcgccggcctcgaaggcggggttctgcttgaggtccaggcgcggcgagtccacgtgggcgcccaggatgttaaagccctgctcgagcggggcggtgcccaggttgacgagcatgaggtccttgccgtggttggcggcgtacaccttgtcgccggccttgagcgcgcggccctcggcgatcacggtctccagattgacgtatcccgcctcctcggccatcttgatgccggccttgacgcacaggcgctcggtcttgttctcactcaaaaactgcttatagccgcggcaaagctcctcgagctcctcgatttgctgtggcgtgtactttttccatgcgcagggacgctccatgacgcaggctcctttcggatcgatcgtgctggttgatgtaccgtgagccatcgtatcacgcgcgggcccgcggcggcagggaagcctgatgtgcggtggccgcggggcggggagcgtgtaaactggtgtgagcaaaccgtgcccagcccaaagcgaggtattcaatatgtctgaaaagcgccgtacctttgccgtcatcgacggcaactcgctcatgcatcgcgccttccacgccgtgccgccgaccatgaacgcgccggacggtcgccccaccaacgcgatctttggttttctgaacatgttcctcaagatgatcgatgcctttaatcccgacggcgttgtcgtggcgtttgacaagggcaagccgcgcgtgcgtatggagatgctgccgcagtacaaggcgcagcgcccgcccatggaccccgacctgcacgcgcagttccccatgatcaaggagctgctcgccgcgctcaacgtgcccattttgcagtccgagggctgggaaggcgacgatatcctgggaaccatggcgcgcctgggcgaggaggccggctgcgacatgctgctggtgaccggcgaccgcgacatgtatcagctcgtgaccgagcacgtcaacgtggtctcgactcgcaagggcctgtccgacgtggcgatcatgacgcccgagagcgtggacgacctgtatcacggcatcacgccggcgctcgtgcccgatttttacggtctgaagggcgatacgtcggacaacattcccggcgtaccgggcatcggccccaaaaaggcgagtgcgctcatcgcgcagtacggcagccttgacgaggtcatcgcgcatgctgacgaggtcaagggcaagatgggagaaaacctgcgcgcacacatcgacgacgcgctgctgagccgtaaggtggcgaccatccgcaccgatgcacccgttgagctcgattttgaggcgacgtccttcccggcgttttccgccgatgaggtttccgcggcgctgggcacgcttggtatcaccgccatgcagaaccgtttcttggcgctgatcggcggcgagggcggggcagctgccagcacgtttgagattcccgccgttttgcgcgcagccgccggcgatgctggcgcgcttggtgccgttgcggctgaggtctcccgcgtgattgatgccggcgagtgggtcgccgccgtggtggacgatgacaaggaagagggcgcgctctttgggctgacgcgcacgctgtggttggcgacgtccaagggcctgtttgcgctcgaggagggcgacagcggtgcggcggctgaggttgagggcttcaacttcgcccacggcgtaattgccggcgtgctcgcgcgtctgtttatggaaggccgtgtggcgagcccggatatgaaggcgcttctgcatgagctttcgcccatcgattcttctgagctcgagctcatggatccgctggcagtcgattccacgcgcatcttcgataccgttgttgccgcctacctgttggattccgaccgctccgagtttgacgaggtgtatctggccgatacgtatctgcagatggcgctgcctgcggcgcgcggcgcagagggtgctggcgaggacgctcctgcgcccgccgctcgcacggcggccttgacgctggcgctggttgcaccgctgcgcgagcgcatggcgcgcgagaacgccgccaacgtgttcgacggcatcgagatgccgctcgtgccggtgctcgccaagatggagcgcgcaggcatgctcgtggaccccgaccgcctgcacagtctgtccgagggcctggcgacccagattgccgatgtcgagcgcagcattcgcgacctggccggcgacgagacctttaacatcggcagccccatgcaactctcgcacgtgctgtttgatgttatgggacttccgaccaagggcctcaaaaagaccaagcgcggctactattcgaccaacgccaaggtgctgagcgaccttgcccgcgaccacgagatcgtgcgcctgattttggactggcgtgagaagtccaagattaagtcgacctatctggacacgctgggcccgctgcgccgtggtgacgggcgtgtgcacaccacgtacaaccagaccatcaccgcgacggggcgtttgtcttcgagcgaccccaatctgcaaaacattccgacgcgctcggagctggggcgtaccgtcaagacggcgttctcggcgggcgagggcagcgtctttttggcggtggactactcgcagatcgagctgcgcctgctcgcgcatctttcgggtgacgagcacctggtgcgcgccttcaacgagggcgaggacttccatgccgagacggccgcgcgcgtatttggcgtgccggtgtccgaggtgacacccgacctgcgtagccgcgccaaggccgtgaactttggcatcgtgtacggccagcaggcctatggactgtcgcagtcgctgcacatctcgatggccgaggcgcgcgatatgatcgatcgctactacgaggcctacccgggcgtgcgcacgttcctcgacaatgtggtggcgcgagccaagcagacgggctatgccgagaccatgtatggccgcagacgccatattcccgagctcaaggccaaaaacccacagctccgcggctttggtgagcgcacggccatgaaccaccccatgcagggcaccgccgccgacatcatcaagatcgccatggcccgcgtaagccgtcgcttggaagaagaaggctttgccgcccacatgatcctgcaggtacacgacgaactggactttgagtgccccgtcgacgaagtcgagcgcctcaccgccatggtccgcgacgtcatggaacacgtagtagacctccgcgtaccgttgatcgccgaagccagcaccggcataacctgggccgacgcgaaatagggaagcactccgtaaggcaagctcgcccaagacgcaagcccccacatacttaagatttgggacaaacactactgattaatttgtcccacagtaaccaaaacagaggggagcccctcccaacaaggagctcccctctgctcaaatcatttcagctaagtatctagacactcaagacgccatcttggcgcccggccgggtccgacgagctccgttaacgggccgccaagatggcgtcgatgagcgtcagtacgcccccgtcgttgttgctcggaatgcgccatttggcatgcgcgttcatgtgctcctcggcattgtccacgataaagctatgcccgacgtgctccagcatggggatgtcgttgtacgtatcgcccacggcagcggcgtcggcgatatcgatgcccaggcgctcgcagagatgtgctacgcccgaccccttgtcgacgcccaggttcatgaagtcgatccactcgcgcccggcgttggtgacgtagagcttgtccgagaactcggggctgtagtcctcgcgaaacgctggctcggcatcgtaggcggggaagaagatcgaaatcttgttggactcgatatcaaggccctcaaagctatcgacgtagttgatcgtgttgtagtacacgctgatctcgtcgtggtactgatggtcgcgggcgagcacatagaactcgtcgtagcagcacaagacgggaacggcacgcgggtcctccgaggcacgggcgagcacctgctgatacagcgccacatcgatgttgctcttatagatatagctgccgcgatagatgacgcaggctccgttgtcgggacaaaaagcaaggcggttcttaatgctctcgaacatttcctcgagtttgggggcggggcgtccgctggcggggcagaatacaatgcctgcgtcggcgagcttgtccaggcgctcatcaagaccctgcggcagtacgcgctcgtcggtgagcagcgtcttgtccatgtcgacggcgatgagtttgatgttgccgatgttggcgtctgattcataagtctgcataaatgcgcctttccgtttccagattgtttcgggcgtaatgaccctctgctatgtaatcgagcgtattttcgcaggaatggtgcgtacttgcactgcaattcacaaactaatgaaaaaacttttcagaaatttgaatttgtcgcttgtacagcaggcactttagcgtaatatagcaaccatcgaaaacggagacggcaaaagcaccgcttaccgaggaaaaggtaccgtttgcgatattagaattgcgcccggcgataggtgaaaggagaggcagatgcagttcgtaaagatcatcactactgcagacaatgccatccgacgccagcgcgcaatttcccgacgacgataacaatcgtctctgtccgtatggggcgaattgcctcaacagagtcattttgaggtcgttgggttttagcacgacattgctgcatgtttctagggcatgttgtgctgctttttgctatttaacctgatattgcacggtttttgacctcgaaatgacttgcaactgaccgatgttctaactagctaccaagggcgaaaggaaacagccatgagcaaggaaaaagtcgttctcgcatattccggtggtcttgatacatccgtatgtgtcaagtggctccaggacgagaagaatctcgatgttgtttgtgtctgcggcaacgtgggccaggaggagaccggcttggatgccaagaagcagaaggcgcttgacctgggcgttctcgattgccaggtgctcgacctgcgcgacgagttctccgatgagttcctgactaaggccatcgccgcaaactccatgtacgagaacaagtacccgctgctctccgcgctgtctcgcccgctgctcgccaagaagcttgtcgaggtcgcccacgagtttggcgcgacctatgtcgcccacggctgcaccggcaagggtaacgaccaggtccgttttgaggccgccgtcaaggccctcgaccccgagctcaaggttatcgccccggttcgcgagtgggacctgaagtgccgtcccgacgaggtcgcctatgcccacgcccacaacgtgccggttcccgagggtgccaacgacaacccctactccatcgacgacaacctgtggggtcgtgccattgagtgcggtcacctggaggatccctggaacgagccgctcgacgacgcttgggttatgaccaagaatcccgaggacacgcccgacaccccgacctacaccgagattgagtttgaggccggcaagcccgtcgccgtcgatggcaagaagatgaagctctccgagatcgtcatcgccctcaacaagatttcgggtgacaccggctttggccgtctcgacctggtcgaggatcgtctggtgggcctcaagagtcgcgagtgctacgaggttcctggcgccctgacgctcatcaccgcccacaaggcgctcgaggacatctgcgtcgagggcgacctgctcaagaccaagattaagctcgagcaggattgggccaccgccgtgtacaacggtcagtggtacagcccgctcaaaaacgcgctcgatgcctttatggccgacacccagaagttcgtgaccggcaccgtccgtctgaagttctttaagggcaactgccatgtcgtcggccgcaagagcccgtttagcctgtatgactacggtctggctacctacgaccgcgacactacgtttgacgagaaggccagcgccggctttatcgagatcgatacgctgtcgctcaagacgtgggctaaggtccagggccctagctctgctgccgcccaggcctagcgcctccttcctttggtatccgcgcggcccatccgcgtgatacataacgggcacatggggtccctacctttcgttatgcttgctgacacttcttaacatcggtggcccctacgttccgcccgcatatatgatgccgcgtctgcggctgagtccgagccccgccggggttgtccggcggggctcctcctatcaatttgacggccctgcgcctatatatatggggagtatccattatgttcaatgctatcgcgcatgctttacttgccctcgcgcccgagttcgatgctgcaaaggtcgaggacgttcctatgagcctaaaggcctggatcgatggttcgcagggcaacattcggagggagacgttgggcgccaagtgcatggcgcgtcacttctttgcaaattagctatatggcctcgcacatggtggggaatatgcaaaactagcggttgagaaatcgctttagcgacagggcgcattgctttgggcgcttgttttgggatttgatgaaaggggacggttccatggctctttggggcggtcgttttgaggcaggcgtggccgaggtcacgcaggagtttggcgcatcgttgccggttgacaaacatctctataagcaggatatcgccggatctaaggcacatgccaagatgctggcggcccagggcattatcagcgccgaggacgagcaggcgattgccgagggcctgaccggaatcgaacaggatatcgatgccggcaacttcacctttgatatcaacgacgaggacattcatatgtccatcgaaagcgagctgacgcgtcgtatcggcgaggctggcaagcgcttgcatactgggcgttcgcgcaacgaccaggtggcgaccgatacgcgcctgggcgtcaaggcgctggccaaggagctcatggaggccaatcttgagctgcgccatgtgctggtggatgcggccaagaagtacgacaaggtgattcttccgggctacacgcatatgcagcacgctcagcccgtgctgctctcgcatcatctgctggcgtattcctggatgttcgcgcgcgactttacgcgcctgaaggccgcctttgatgccgccgacaactgcccgctgggtgctgccgcgcttgccggtacgagctatccgctcgatcgccagatgacggctgccgaacttggctttgcgggcgtgattcccaactcgctcgatgcggtttccgaccgtgatttcttgctcgatctgcattacgccggatccgtcatggcgatgcacctgtcgcgtctttccgaggagatcgtgctgtggtcgagctccgaatttggctttatcacgctttcagactcctactccaccggctcgtccatcatgccgcagaagaagaatcccgactttgccgagcttatccgcggtaagagcggtcgcgtgtacggcaacctggtgcagctgctggtaaccatgaagggcctgccgctcgcttataacaaggacttgcaggaggacaaggagggcgcgctcgataccgctcgcacgctcatgcagtgcctgtccgttatggcgggcatgatctcgacctggactgtcaacgaggtcgccatggcgcgcgagtgtggcgtgggccacttggcagccactgatgttgccgattacctggcaaagcgcggcctgccgttccgtgaggcgcatgccgtggtgggccatctggtcctgatgtgtgagaagcgcggctgcaatcttgaggacctgccgtttgaggtgtttcaggaggcaagcccgctctttgagcgcgatattaccgaggcgctcgacatcccgtcgatcgttgccgcgcgcacgaccgagggcggcaccgctcctgccgccgttgccgtgcagttggggcgcgccgagacgcagcttgcggccgatgagggcgtgtttggctcgttgaccaaggtcgtcgagatgggccacggagctaattagcttattggatgcgtctgtctggtgcgttcatcatatcttgcctttacgggtgcctgctacggtgggcgcccgttttgttatagagaaggaaggagcttgtcgaaaacttttgtaggacatttgcgcaggttgtgaagggggtacgttcgcgggtggcaaccgaccgcccgctctgttcgatgtggttgatgagcggtcggatggtactctaatcgggcttcgaaacagaagtgacacatatggagcgctttaataaattgcagcgtttcaataaacagctttttgtttaactgcagctaaaactctgttacgatgcagtccaggcgggtgccggaatgggacttgggcacgcgcgaacctacttgaaaggctaccttatggctatcgagaagaccttcatcataattaagcccgacgccgtgcgcgaccgcaagatcggcgagatcgttgctcgtattgagcgcagcggccttgtcatcgagcgcatggagatgaccacgctcgagcgcgctaccgtcgaggagcactacgcccatctggccgacaagcccttctttggcggtctctgcgactttatgacgagcggtccggtcgtcaagatggttgtttccggtctttccgctgtctccaagatgcgcacccttatgggctccaccaacccgcttgatgctgctcctggcaccatccgcggcgacttcgccgtcgatgtcaacgccaacgtgattcacggctccgactgcctggagaacgccgagatcgagatcaagcgcttctttggctaaaccagctttgactccttaaagctgttagcgtgtggcttgggcgccgcggaactccatccgcggcgcccttttatattccagtagatttttgggacatgcctagaaatctactaaagagcccccgcctggaatgtgcgtgcattccaggcgggggctgtcgctagcgtatggcgttgtaagtctttaggcctcgtcgacgaccttgagaccgcgggtctggtcgatctcgttgaggaggttgacgcgacgctcgtgacggccgccctcaaactcggcgtcgagccactcgtcgacgatcatcttggcgagctcggagccaacgacgcgggcgccaaaggcgagcacgttggtgttattgtgcatgcgcgagagcttggcgctgaagggctcggagcacacgacggcgcgtacgccctcgaccttgttggcagccaggctgatcccgacgccggtgccgcagatcaggatacccaggtcaacgtcgccgttggcaacggccttgcccactttgtaaccggcgatggggtagtcgaagctctcggaggtgtcggtgccaaagttcacgacctcgcagccgcgctccttcaggtgctcggaaatgatgttcttgagctcgacggcggcgtggtcgttaccgataccgatcttcatggatggttcctctctggtctgtgcggcgcaaatgctaaaggtgtttaccgcgttcgactgcatgatagcgcgacttttgcgtaaacgctcgggcgttttttggtcaaacgctttagcaggcaacaagaccggcctctcatgaataatgccgccaatttgtgcttgagcgccgtccgccggaaccgtggttgcggtttttgatgcattgttatcaaataaaggagccaacttttttgagagtccagcccgttatgcaagtaggagatacctatgcctaccgattccatccgtgatgccgcgttttgcgatgttttgaaccgcgagcttgtctgtgcactcggctgcaccgagcccattgccgttgcctatgcagcggcgctggcgagccagacgctcggttgcgaacccgatcatatggatgttgcctgctcgggcaacattatcaagaacgttaagagcgtgaccgtgcccaactcgggcggtatgcacggtattgaagccgcggccgtgctgggtgccgtgggcggcgacgctaagagcgcgctcgaggtgctcgagagcgttaacgatgaagaccgcgctcgcgtggccgagctcctcgccgacgccggctactgcgatgtgtcgcttgtcgagggtgtgcccaacctctacatcaaggtgactgcgacggccgggggccataccgcggtcgtcgagattaccgatcaccacactaatgtcacgtgccatacgctcgatggtattccggtatgcggcaagtcggcgggggagtgcgccgcctgcgccgagcgcgtggtggccgagcgtgcggcagataacgccgatacgcccatgtccattgattccatcatcgactttatcgaggacggtgacattgagggcgcccgcgctgccgttgagcgtcagattgagctgaatggcgcaatcagtgccgagggccttgcgcacgcttggggcgccgaggtgggtcgtacgctgctgggtgctcgtgccgatgacgtcgcctgccgtgcccgtgcccgtgcggccgccgggtccgacgcccgcatgaacggttgcgcgctgccggtcgccattgtgtgcggctcgggcaatcagggcattacctgcgcactgcccgtcatggagtatgccgagtacctgcgctgcgaccacgagcgcctggtgcgtgccgtgatgctgtccgatctcattgccgtgcatatcaagagctacattggtgcgctctcggcgttttgcggcgctatttgcgctgcgtgcggtgccggtgccgcgattacctggctgtgcggtggcacgcgcgagcaaatcggtgcgacggtctccaatacgctcggcaatgtgggcggcatcgtgtgcgatggcgccaaggcgagctgtgccgccaagatctcggctgccgtcgatgcagcgattctgggccatgatatggccatgcagggtcgcggcttccgcgccggcgagggcctgatccaagataccgttgagcagacaatcgccagtatgggctacgtaggccgtgtgggcatgaaagataccgacgtcgagatcctcaacatcatgatcggcaaaacccaagtgtgctaggacagttcgtcggctacttggtgttcgtagaaggcttctactacggcgttaaagtcgcgggcgaagccttccatggttccgcgccaggtgactcggttgggcttgccctggcctacataggcagtctgaatgccgcaggcggggctggggaagtcgcgtttgggatcgttgcccaccataaggacctcgtgcggttcgagccccatcacctgaagctgctctagatagtaggtggcatcaggcttgcagcgggtggcgtttcccatgtgcgtgacgagctcaaagggggcgtcggccaggtcgccccaacccatgcggcactcgatggccccctgcggaaagctggggttggtaaagagcgcgcagcgcagccctgcgtcctgtacggcctgaagcgcggcgtgtgcgcccggcatggcatgggcgttgatgaattcgtcattcttgtacggaagaacttcgcggtcgtagtaggtaaacgcctcgtagataagtgggtccgagaggcaaatcccgcatcggcgctcgacctcttcttggtaaaactcaagattggtgcggttgtccgtgccgctgcggcgattggcgttgaggtcgaccaggatggtgccgaggcgtgccatcgtgccaccgcggctgcggcgcccgatatccgcgagcatcgaagagacatccttaaaatagcgaaggatgaacgcgttgaggttgatgctaagaagcgtttcgtccatatcgaaaacgactgctttgagcacgcgggcacctttctcgaaaaatcgatctagaatcgttggctccggatactttaccccaaagccgaatgcctggctggttatcgtcaagttgcggagacgtgtgttcataagattacgaaaaagtctccacacgagtaaaaaatcgcagttcacgcttgaaatcgaactcatttccccgtaacctatacgaacgtgattgcataagcgtcacaattagtatctgtcggctcccgagtgttcctaaacgttgtgtgcttgtcgcacccttctgtaggtcctagcaatcggggccccgtagttcgaaaggggtccacctttgagtgagattcagaactcgtccattttctctcttgacgatgtcaacgaggaggagatgaacaacctcatcgacggtacgattaccgactttgatgagggcgatctcgttaacggcactgtcgttaagatcgagcatgacgaggtgctcgttgacatcggattcaagtccgagggcgttatcccggtccgcgagctgtccatccgcaaggacgctaaccctgcagacatcgttgcactcggtgatcccatcgaggctctggttctccagaaggaggacaaggacggtcgtctggtcctgtccaagaagcgtgccgagtacgagcgtgcttggaaccgcatcgaggagaagttcaactccggcgagaacgtcgagggcgaggttatcgaggttgtcaagggcggcctgatcctcgacatcggcctgcgtggcttcctgcccgcttccctcgtcgacctccgtcgcgtcaaggacctcacctcctacatgggcacccgcatcgaggcccgcgtcatcgagatggaccgcaaccgcaacaacgttgtcctctcccgtcgcgtcgtgctcgaggagtcccgtaaggccgagcgctccgagatcctgtccaagctcaagtctggcatgcgtctccagggcaccgtttcctccatcgtcgacttcggcgccttcgtcgacctcggcggtatcgacggcctcatccacatctccgagctctcctggaaccacgtcaaccatccttccgaggttgtcaaggtcggccaggaggtcgaggtcgaggttctcgacgtcgacctcaaccgcgagcgcatctccctgggtctcaagcagaccaccgaggatccgtggcgcgcactggtcaagaagtaccccgtcggcgctatcgtcgagggcactgtgaccaagcttgtcccgttcggcgctttcgttgacctgggcgagggcatcgagggcctggtgcacatctccgagatggccaacaagcacgtggaccagccttctcaggtcacccacgttggcgacaaggttcaggtcaaggtcatggagatcgacctcgatcgtcgtcgtatctccctgtccatgaagtctgctgctgagactctgggcgtcgagatcgaggttaccccgctgccttccgagaagaaggacgaggagaccgacgccgagtaaatcggtttgacgatcacttgttttaagggatccgtccgtaatggacgggtccctttttgcatttggcaccgagatgcgcaatgctgccgggctgtccacaggctattggattgtcggtgcatgaaaaaagccgacatcccgcctcggggaggaggcgggaacacaccgagtagacggaggggtgcggagcgcggtcgcgtctcgactgacgacgttgcccatcgacaggatcattgtaacgcatggcggttcttggtttatcgtgtcgagcgtttgcgttgtgccattgcctgcggtaacggtgtgttacactcttgcactgctgagtgggccagacggtcgcgcgatgtgctgcttgcagtacgcgtgaggaaagtccgggctccagagggcgggatgccggctaacggccgggcggagtgatccgacggaaagcgccgcagaaaagaagactcccacctgcgccgcaaggcgtaaagggaaaagctgaaacggtggtgtaagagaccaccagcgtcgtggcaacatggcggcttggcaagccccatccggagcaagcgcgaataggaacgctatgggccggcccggtccgcgttcgggtagcgtgcgtggagctgcacggtaacgtgcagacaagataaatgaccgttcacgacagaacccggcttatcggcccactcggcactttgttgacgctgcgaacccgtcagcgcggcaatctgcctttcaaaccttcgggcatgaccataaggtcaatgccctcggctttcaaggcaccttgctcgcgctgacgggttctcgctttcgttgacggaatcatcggcgttgccattctttttactagggttatcgtattattgaggctgtttgttgctgcgctttattttgttgaggggctttgttggacagctattttactctgcaatcgaatattgaggcttcgggcgagtttgtggaccgcaagagccggtttattgcccagctggtccatattgagtccgaggacgaggcgaatgcctttatcgagatggttcgcaagcgtcattacgacgctcgacacaatgttcccgcgtggattttggtcgatgggcgtgagcgccagagcgatgatggtgagccgagccgtacgagcggtatgccgacactcgaggtgctgcgtggcgcggggctcaaaaatgtttgctgcgtagtgacacgctattttggtggtacgttgttggggcccggtggcttggtacgcgcctataccgcggcgacgcaggcggcggtggccgcggctcaggaggccgggcagatcgtcgagatgacgagtgtcgtgcctgttgacgtgcatgtggcctatccgcagtatgagcaggtgcttcgcttggcccaggattccggtgccaaggtttcggataccgagtacgcggatgccgtgacacttcatttggtgtttaaggcgggggagcaggggtcgttttgcgctaagatgcgcgagcttatggcggggcgcgaggagattgaggtcagcactcccgaatttgccgagttctaacggcgacggtcggcgtgcttttggacggatcccaagcacaccgaccgtcgttttatgtcgctgccgtttactcggcgagctgctttagtacatcacaggcgatttcgacggcatcgtcgatgcagccggggcagctgcggagcggacccttgtccgatccgatgcccttgagcgtgccgcagacggtcgtcgtgttcttctcgccaaagcgcttggcaatctcgcgcgacagtttgtaggtctggcccttggtcttggggttttccatgccatcgctcattacaaagcccatgatggccacggcgcccgagatggcaccgcaagtttcggtcatgccgcccatgccggcgccaaagccctcggtgagggtaaaggcgacctgggggtcgagcccgacggcgggcgcgagcgtgcaggcgacggcctgcgcgcagttaaagccgcgggcgtggtattcggcagcctgagcctggcaggtggcagtgttgagctgagtggtatcaatctgcttcatcggtgtctccttgattgcggtgtacccgcctatggtacccttgctggcgcattcgcttatcgagaccgcagtgcatatctcattgtttttcgccatcgaacactttcttaagatttgggacaaataaacctgattaatttgtcccataacctatcggcgggatgggttgagaggggtgcggggtagcggtattgtgaaccgaataaaacaaaacccaagtaagggagttggatatgtgcgagcagactatcggtaccacgtgcgttcagggcggctatcatccgggcgatgcggagccgcgccaggtgcccatctaccagtccaccacgtggaagtacgacacgtccgagcacatgggcaagctgtttgacctagaggagtcgggctacttctacagccgtttgcagaaccccacgtgcgatctggttgccgccaagatctgcgagatggagggcggcaccgctgcgatgctcacgagctcgggcatggctgcgaatttcctcgcgatctttaacgtggtcggtgccggcgatcatgtggtcgcgagctctgccatttacggcggtacgtataacctgctcgcccacaccatgggccgcatgggcgtgacctgcacgttcgtcgcccccgactgcacagatgaggagctcgaggcagcctttgagcccaataccaagctcgtctttggcgagacgatcgcaaaccccgcccttgccgtgctcgatattgagcgctttgccaaggccgcgcatgaccacggcgtgccgctgatggtcgacaacaccttcccgacgcccgtgatgtgccgtccctttgagtggggcgccgacatcgttacgcactccaccaccaagtacatggatggacatgctgcctacctgggcggcgtgatcgttgaccacggccagtttgactggatggcccatgcggataagttcccgggtctcaccacgcccgacgagagctaccacggcgtgacgtatgccgagaagttcggtcgcgagggtgccttcattaccaaggccaccgcgcagctcatgcgcgacctcggccccatgcagaacccgcaggcggccttcttcctgaacagctcgctcgagagcctgcatgtacgcatgccgcgtcattgtgagaacggcctggccgttgccaagttcctgcagagccatcccaaggtacgcttcgtgagctatccgggcctggagggcgataagtactatgacatcgctcagaagtacatgcccaacggtacctgcggcgtcgtgagctttggctttaacggtggtcgcgcggcggccgagacctttatgaagagccttaaactcgcccagatcgccacgcatgtggccgatgctcgcacctgctgcctgcatcccgctaacgccacgcaccgtcagatgaacgatgaggagctcatcgcctgcggcatctccgccgacatggtgcgcctgtcgtgcggcctcgaggacacggccgatctgattgccgaccttgagcaggcgctcgagcagtgctaggctagcttctcgtatgaagcgacggagcctcttggggttccggtgacatatagttccgattccgtaggcgggaccccaatcgcgactgttcgcaggcgattggggccccgtttttgcgttgcaccactcgaaaggatggatatggagaaaactgcagagcagctgcgccgcgagcacattgcccttgagggcgatacccatggcaagaacaaatgggcgattctgtttaccgtgctcatcatgacgtttatgtcgtgtctggattcgaccgtcgtgaccgtggcgttgcccgtgatgcaaaaggagctgggcgtgggcctcgatcgcattcagctggtaagctctgtgtatctgcttgcgacgtgcgtggctatgttgccgtttggccgtctgggcgacgtgcgcggcaaggtgaatgtgtttcagctgggcgtcaccgtcttttcggtcggttcgctgctgtgcggcctttcggcctcgctcgaggttcttatcctggcacgcattgttcagggcgtcggttgcgcggcggccatggctaacaacatgggtatcatcaccgagtcgtttccggcgcgcgagcgcggtcgtgccatgggtattctcgcgaccttcgtggccctcggcatgatgtgtggccccgtgctgggcggcatgctggtggcaagctttccctgggagagcatcttcctcatcaacctgcccattggcgtcatctcgtttatcgtggggctctatacgctgccacatgttaagccggaggctggcgagcgccccatgtccctgatcgaggctgctcgtcgctgctttgcaaattcggccttcaccatcaacctcgcctgcatgctcatcgtgttcgttggtattggcgcatcagagtttatcctgccgttctattttcaggacgcccacggctttggttccgacatctctggactactctttttggcgttgccgatggtgaatgcctttatcggcccgctttcgggtacggtttcggaccgtgttggctgcgagggccccacggcggtcggcctaggcgtgtacgtatgcggtctttttgcggtaagcacgctcgacgagcactcttccatccctgtgatcgtgcgttgcgtcgcgtttatgtcgtgtggcacgtcgattttccagagtcccaacaactcgctgtacatgggttcggccccgcgcgaggcgctcggttttgcgggcagcctgggtagtctggcgcgctatgcgggtatggcgctgggtattacggcaggttcgcatatcctttatgggcagatgagcgtggcgatgggcgaggccgtgaccagttttgttacaggccgtccggatgtattcctattcggctttcgctcggtgttctacgtgcttatggctgtggccgccgtgggctttgcgcttgccatggtgcgtttggtgaagatgcgcgcccgccattagcgtgttgggaggctgtctgccacgattcgcgccgtcccaaaaagactggtttgtggtgcgatgcggcttgtggggcgggcgggggtcggtccgtggtagactatcgaacaacgtttattaatcgcgcggtatcgttgccgcgagaaggggttgcgccatgcaggagcttgaggatcgtattcgccatgacggcatcgtaaaggccggtaacgtccttaaggttgatgccttcctcaaccaccaatgcgacgttgagctgttcgaccacatgggcgccgagtgggcccgtctgttcgagggcgtcgagatcaacaagatcctgacgatcgaggcttcgggcattggcatggcttgtattgcagcccagcattttggcggcgtgccggtggtctttgccaagaaggcgcagtccatcaacctcgacggcgagcagtatgccacgaccatctactcctttaccaagcagaaggagtacccggtcatcgtcggcaagcgcttcctgtccgagggcgacaaggtcctgatcatcgacgacttcctggccaacggctgcgcgcttgagggccttattaagatctgcgaggctgcgggcgccgaagttgccggcattggcatcgccgttgagaagggcttccagggcggcggcgataagctccgtaagcgcggcttccgcgttgagagcctggcccgtatcgccgatatggactgcgagaacggcgagatcgccttcgcctaagcgcgcaacacaagcgattggtatgcgatgtgacaaagggactgtccctttgtcacatttttttgtatgaggggaggtgctgatatggacgagaacaagatggaatggcgcgagtatgcgcgctatgccgagatgtcggccgaggagttggcgcgcgattgcgaggtgcaggtgtttcgtgcgacgggtccgggcgggcagggcgtgaacacgacggactcggcggtgcgtatgaagcatgggcccacggggattgttgtgacggcgcgcgagagccgtagtcagtttcagaatcgcgcgagctgcctgcgtaagctgcgcgcagagcttgagcgtcgtggccgtccgccgcgccgtcgcgtcaagaccaaagtgccccagcgatcgcgccagcgcaggctcaacgacaagcacttcaatgcgattaaaaaggctaaccgtcgcaagccgggcggggaggaatgatcttctcaataagttgcggtgaaatagggactgtttcgcggctttaactgcataaacagtccctatttcaccgcaacttaggtggggttagcgggttgggtgccagacttggagggcgccgggtaggatgtcgacttcgatgcgcgaggcgacgatgggctcgccgtcggcctggatggggtagtcgggctcctcaaaagttagctcggcatggcggcagcggcgcatgcgaaccggtggcaacttggtatggtggccgtccttggccgaaaggaacataggcagggctaccgcgcgagggacggggccgcgggcgtagcagacgtcgagcatgccgtcgcaggggtcggcatcggggcagatgcgatagcccgagccataggtaggaccaagctgaatcgccatgatgatcgccctcacgcgctcggcgggcgcgccgtcaaagctgactgtcatggggtagctgcgatagcgcaggccaaactgctcaagtcccgaaagggtgtagagcggcgcgcccgtcaagccggtctttttgcgcagctcggtggtgccaaggccgatggcggcatcaataccgacggagagcgtctggtcgtaatactcgacgatcgcctcgccgctgccgcttgcggggttccatgagcgaatccgcccgatgtcctgacgctgcagctcgcaggtgagtagcgcgccaaaatccttgccggagaaatcttcgatatcgagcgtctgggcaaaatcgttgccggagcccacgggcaggacggcaagagcggggcgggcgtcctccttttgcgtcataagcccgttgacgacttcgtggatcacgccgtcgccgccgagtgcgataacggtgcgatagccctgagcctgtgcggcaagctccttggcgtgtcccatgtgctcggttagcaccaggtcaaactgggatgcgcgcgcggtcatatccaaaaagcgctgcaggcgctcggcaacctcgcgcgcggcgcccgactgggcggcggggttggcgatgatgagcgtgcggccaaaatcagttgcgtgcatggggcgactcccggcgtgtggcatgacggtgcggtctcgctcaggtcgaattgcccccgattgtggctgcacggcgattattacatctactctatcaggtcgttgtggcgctcgatagcatccgctaccgtaccgccctcatccacaataagcgaacggcgcttgggtgagatgatgcgctgggcagggtacacgccgcggtgtccgccggttaggtagctgataaaggccacgatgacaaagaacccggcggccgtgccgtggaacaggtcgatggccatcatgcaggtggtgatgggcacgttgaggccggcgcagaacacgccgagcatgccgagagccgccagaaaactggggtcaagcccggtaaggcaaccgatccagccaccgagtgccgcaccgatgccaaacaggggcgtgacctcgccgccttggaagcccgcgcccagggtaagcgctgtgacgaccaacttgatggctgcgtccgccagggtggtgttgcctgcaaatccggcgccggaaagccacgtggaaaggccggcgtagttccaggcgtcgaggggggcataggcggccaaaaccacgagtgcgcctatgagtgcgcggacgaggtaattggtgataaagcgactgtacaggcttttgacggttcgaaccgaccaggcaaagaggcgtgccgtcaggccgaaaataatggcgctgataacaacgatgacaaccgtccgtggtgtcatgttgggaacgctggcgatgacattcgcctcgtactcggttcccaaggcaagcgacgtaaagtagccggtaaacgaggcgaccaggcagtagatgcccgcggtgtagtcgatcttgccaataaagcacatctccatgccaaagaaagctccagcaaggggtgaaccgaatacggcgccaaaggccgacgagatgccggcgagcatgaggtcgtggtggtcatgctttttgaggtgggcgaggttcgagatgttgctggcgatggtgccgccaatctgcaccgcggctccctcgcgaccggccgatccacccgttaggtgcgtgagcgtagagcagacgaaggtgaggacggccatgcgcatatggatgaggcgtgtgcccagagcggagtcgatgaccaggttgttgcctcgtttggcagcaaggccgtggtttttgtacacccatgcggtggcaatgcccacaacggggagcaatgcgtagacccacgcgtggtgctcgcgatagtcggtcgcgatattcagcgaggccaaaaacgcccaagcggcaacgcccatggcgagcgagacgatgacgacgagcgcgagcaacttggcgctcgcgagtaggttgcgggcgttgcggcgagtgtcggcagccaagagatgctcggagcgggtgagctgttgtctgcctgtcatgatgacgtcattaagggagaaaaagccgccgtcgtcgagcgactgggaatgatcctgcgcctcgtttgcgctttcgggtttgtcggtaaaagccatacgttcctcttttgggttgcaacacgagcattatagaacgtgccatacgtgacaaaccggcaggttggttttggttttgtttcgcggcttgcggccgacagatgtatttgcgggtacaggccaagtcgcggtcgcgcgtcgagggattatactgagagaaacataaagaatcggcgcttttgttgcgcgccgcagcatgctagaggtgtatatggctgagaaactcattccgttggaggacgcgcaggcgatcgtcttgtcgcacgtgaatcgcaccgaagtcgtcgagattcccgtgtggcaggccgccggtcttcccttggcagaggatgctgtggccgatatcgacatctcgccgtttgccaacagcgctatggacggatatgccgtgcgctcggcggacttggcgcaggcatctggcgaggcgccggtgacgctcgacgttatcggacacgaggctgcgggccatgtgtttgagggcacaatcggcgcgggcgagacggtccgcatcatgacgggcgcgccggtacccgaaggtgccgatgccgtggtgaaatacgagatcgtcgacgtgctcgatggcgacggcaacgagggctcgcgtgtgaggttctcggcgcctgccaaggtaggggagaacgttcgctctgccgccgaggaggcccatgccggcgacgtcgtgatgcgtgccggcgaggttgtggccccggccggcgctggcctgctggcaagcgccggttacgcgagcgtgaaggtccatgcttctccgcgcgtgggcattatctcgctggggacggaactggtcacgccgagtaaggtaccggcgcgcggtcagattcgcgattccaactcgtcggcgttgatggccgaggcgctcgatgcaggagccgagcccgtgttctacggcattgcgcccgatgatgagcaggcgattgccgagctggtgcatcgtgccgtgcaggagtgcgattttgtcattacgagcggtggcgcctcggcgggcgattacgatttcgtgacggcgctcgtccggcgcgagggcgaggtgctgtttgaccgcatctcgatgcgtccgggcaaggccatcacgtttggcttgctcggcggcaagccgtatctggggctttcgggcaatcccgcggcggcgtatgtgggctttgagatgctcgcgcgcccggcgattcgcaagatgcgcggttttgccgagggggcgcgtcccgtgcagcaggcgacgctcacgcacggcgtgaaaaagcgacagcatcgccgcttcttcgatcgcgccacggttttgcgcgactccgagaccggtgagctgttggtgaccgaggccaagacgcagaattcggcgttgctcggcacgatgcagcgggccaactgcctgctgcgtattgacgaaggtccgtgtgagctcaaggcgggcgacgtcgtggatgtcgtgcgtgtcgacctgcctgagggcgccgtgttgtaggaggaatgctatggagctgaagatatcgatcgtgacgtgttcggatacgcgggaccttgcccaggacgaggctggagccgcactcgaggaacttatcgaggcgcagggctggacggtcgtctcacatgtggtcgtgcgcgacgacgtcagcgagatcggtgatgctattgtggaagccgccgatgagtgccacgccaatgtcgtgctcacctgcggcggcacggggctttcgatgcgcgatgtgacgcccgaggcgacgcgtgccgtctgcgatcgcgaggtgccgggtattgccgaggcgatccgtgcgtactcgatgaccaagacgcgccgcgctatgctctcgcgcgctatttgcatgcaacgaggtcatacacttgtcgtaaactttcccggttctactaaggccgcccgcgaaagctgggaggccatagcggaccagctggagcatgcggctcagatgacagcgggcggcggacataccaactaagcggtttacctgcggcggagcgacctgaacggctgctccgccttttatttgcgcccaaggggacggcattctgtaggcatgcttgaaactatattctcagacgagaataatttctcataatcattattcgcatcgaagtataatctaattacagaataaagcccgcggtggggtacccgggcacaaggtccgaaagggttgaacatgttcgatatggtttctcgccgcggattcgtctcactctccgctgtcgccgctgccggccttggtcttaccggctgctccggaaacaaggagcctgagtcgaccggttccgatgccggctccgccaagatttcgtccaagaaggctgtcgagatgcaggtctttgccgccaactcgctcgagaaggctctgcccgaggttcagaagctctacaccgaccagaccggcaccgcctttgccgacacgcagtttaaggcgtctggcgacctcgttgagcagatgcgtgctggcgccacggtcgacgtgctcatcaccgcctccaagggcaccatggacgacgccgaggccgccgagctcgtcgatgccgacacccgtgaggatatgttcgtcaacgacctcgtgatcattcgtgccgagggctccgacaccaaggtcgaggccatcgccgacgtcgcgaatctggacggcaagatcgccattggcgacgccaagaccgttcctgccggcaagtacgccaaccaggcgctggcttctgtgggcctctataccggcaccgagggcgacgacggcgagtatgcgcccgagatcgccgacaaggtcgcactggcagacaaagttggtaccgccgccgcctatgtgtccacaggcgactgcgttgccggttttgtctacagctctgacatctaccgctacaacggcatcgaggaggccttcgtgtgccccgaggactcgcacaagcccatcgtgtatccgggcgccgttgccgagagctccgagcatgccgacgaggctaaggcgttcatcgacttttgcctgtccaacaagaaggctcagaagatttgggctaagtacggctttgagctttccgcgtagtgcggcttggcgcgataattccatcgttttgtgtttcactccgtccttgtattcgcttggagcttttcgtgcttaatagattccgcatacttgtcgcttgtgctttgaccctcgcgctttgctgggtgccgggatttgcggttgctggggacgctgaggacggggctcaggttgctgcgaccgctcatgggctttcctatgggatcgagggttttgagcggttggccaaggggactgctcgtgccatggagggccagcctgagggctaccggtttcccgttgacgaggacgtggaccttgtagtggcgcctgctgccgatcgtgttgtggtgtggatatcgcccaaggcggccgagaagtatggattggatccgcaggacaacgagtgcgtatcgggtctcaaggccctcgtctgcgagctcgacagcgcaaactccatgggaggtgcgcagctaggggacgttgatcttccttggtatgttacggcggaaacaacgtttgatgccggcggttatacctatggctttgacgagcgcggtgcggatggggaccgctatgtggtgattgcatcggcctcgggtgatgccaagggcggcgcgcgttggcttgatagcgctcaaatggtagaggcatcgtctgtcgtgttgcgggatgagcaggggcccttgacctctctggcctcctatttaggcggcatcgactaccgcccgttttgggtgtctatcagaacgagcggccttgccctggtgattgcctttgcactgggcctgtttgccgcgtggaagactatgggtacctcgagtcgcatcaagggcctgctcgattcggtctttacgattcctatggtgctgccgcccacggtctgcggctttctgctcctcatgctgtttggccgctcgaccggggtgggccaatggctcatcgcgcacggcatctcgatcgtctttacctggcccgcggcggtcatttcggctgtcgttgtgtcgtttccgctggtctaccgcacggcgctgggagccttcgatagcctcgacacgcagatgctcgacgccgcgcgcacgctgggatggtccgagcgacgcatctttgccaagctcatgatgccgcttggctggccctcaatcgcggcgggcacggtgctcgccttcgctcgcgcgatgggcgagtttggctgcacgctgttctttgcgggcaactacgccggcattacgcagaccattcccattgcgatttactttgagtggatgggcggcaatacgtcggtggctctcttctgggtcgtggtcgtaatagcgttcagcttcctggtcatcctattcatcaacatgtacacggcgcattctcaaaagtatcgcgagcggggcctttcccgtgcggagcgcaagcaggccaaagagctcgccggacagggcgattcgcttgacccggtgggcggtgatgccttgcgtatcgatcgcgaggcgctggccgagcttatgcgcgatggcgcggtcgcaaagggaggtcgataagccatgtcgctcgttctggatatcaaaaagcgctatccgggctttaccctcgacattcagctcgatgccggcgaggagcgtgtggcgctgctgggcgcctcgggttgcggcaagagctgcacgttgcgctgcattgccggcgtggagacacccgacgagggcaagatcgtcgtcaacggcgtgaccttttttgactcggcggcgggtatcaacctgtcgccccaggagcgaaaatgcgccctgctgttccaaaactatcagctgtttcccaacatgacggtggccgataacgtttgcgccggtgttaaggatgcgggtgacgccgccgcgcgcaaaaagctcgccgagcgctatctgggcattttcggtctggccgattttgccgaccgctaccccgcgcgcctctcgggcggccagcagcagcgtgtggcgcttgctcgcatggtggcggcacacccgggcatttttatgttcgacgagcccatgagcgcgctcgacgcgtatctcaagagcgcgcttgagcagaacatgctcgacctgttcgacgtctgtaaccgtaccgtgctctacgtgagccacgatattgacgaggcatgccgcctgtgcgagcgcatttgcgtgatgcataacgggcatgtggaggagatcggctccgtcgaggacgtggtccgccggccgcaaaccttggctgcgctgcgcctgacgggctgcaagaatacgagctgcgcgcgcaagatcggcgacgaagaagttgaggccctcgactggggcatgaccttcaacgtgggccgtgaggttcccgataacgtggcgtacctgggtattcgtgcgagctacttccatgttgacaaccgtgctgagcggggccgcaacagctatgatttgcatgtggctcgcgtgagcgattcgcgttttgagcgcttggtgctgttggacgtgccacgtgtcgatgcgccgacgcgcctgcagtggaaggtcaacaaagtgggcatgcctgtcgacgagctgccgcaagcaggcgagacgctgcgcatgcattttgatgccagcaggatccatttggtttgtcgatagcgccgggtaatgccgtcggggatataagcctcggcggctttgtcttgccgttcgccgaatgaaggatgacaaactcttatcaatcaagataattatttattaaacgacggcacacgacgctgtcgtacgaatgtcaacggtgttcgcatggtcgatgaccgttgatatagttgacctcaacttgtaaaggagggtgcgcacatgccgcagacgacatatattcgccgcgttgccgcgcgcgccctgtatatagctcggagtcgcatatgagcaggtatgttcacggctccgggagagacgacgcacaactaaataatcgaccgcaaagcaggttccctaaaattccgggtttgagcacggtcgggcaatcgccgtccgtcgtgcatcgataccgctgttatccgtttttggttcgagaggggaaccgttatggctgaagaattcgattttcatccgatgtgggagagcctcggcatgaatcttgccgaccacgacatgctgctgggcgccgtgggccagatgtacggcgatatgttcctgacgcagaacaatcgccccaagtccacgtcctacctggattttgtcgccaccaacatccacagcggccgtattaaggagatgctcgacaagaaggaggccggcgaggccaccaagatcgtgggcagcttctgcgtctacgtgcccgaggagattgtgctcgcctgcgacggtatccccgtgggtctgtgctcgggtgccgattgggcgaccgacaaggtcgaggagcacttgccgcgcaacacttgtccgctcatcaagagctttgccggctttaagctgggtgaggtctgcccctacattgagtcgagtgacttggtggtaggcgagaacacctgcgacggcaagaagaaagcctacgagttctttgccacgcaaaagaacatgtacgtcatggatattcccaacgtacacgacgagtcgacgcttgtgacctggaaggccgaggtcaagaagctcgccgccaagattgaggaagagtgcggcgtcacgattacgcctgagcgtctgaaagccgccatccacgccgtcaatgagaagcgtcgcgccctgcagcgcctcgctgccacgcgcgctgccgacccagcgcccatcagcggtctcgacagcctgctgaccgttcaggccgcctttatggacgacacgccgcgtctgaccggggccatcaacgatatggcggctgagtgcgagcagcgtgtcgaggccggcgagggcgtggcgcccaaggggaccaagcgcatcctgtacaccggcacgcccatggccgtgcccaactggaagctgttcaacctcatcgagaaggccggcggcgttgtggtgggcgaggagtcctgcacgggttcgcgctattacaaggacttggtcgatgagtccggtgagacggttgacgagatgctcgatgctatcgccgagcgctactttaagatcaactgtgctgtctttacgcccaacgaccagcgtatgaaagacattgtccagatggccaagaacctgcatgccgacggcattgtcgacgtggccctgcagttctgcacgctctacgagatggagtcgtttgccgtggagaaggccgccgaggaggcaggcattccatttatgcacatcacgaccgactacgccggcgaggatgcaggccaactgcaaaccaggattgaggctttcttggaaaccatttaggactattcgtcccggcggcttccccgggcacccgatcttgctgttcaaaccgtcgcttgcgtaccaaagtacgcgacgctcctctttcacggcaacctcgggcacctgggaaagccgtttccttggttggttaaaaggtttgttaaggagttatatgtcggaaaatattgagcagccgttgccgtccacgtttgaggagttcaacgagcaacgcaaggcggcgtttattcgcgtcaaggattataagcaggcgggtaatcgcctggtcggctttttgtgcagctatacgccgctcgagattatcgatgccgcgggggctgcgagcgtggctctgtgcggtacgtccgatgaggtgattcccgaggccgagaaggtgctgccggcaaacctgtgcccgctcatcaagtcgacctacggttttgcctactcgcaaaagtgcccgtttacgtactttagcgacatgatcatcggcgagaccacctgcgacggcaagaagaagatgtacgagctactcaacgagctcaagcgcacgcacattctgcatcttccgcagggtcgcgatcgtgcctacgagcgtgaaggctggtacgaggagtgccgcctgctcaaggaggagctcgagggcttctacggcatcacgattaccgacgatgacctgcgcgctgccgtccgtcgtcgcaaccgcttgcgtgcggcccagctcgagatgtttgcactgcaggctaaccagccggcggccatgagcggcgtcgacctgatgagcaccatgtttgccggtacgttcagcttcgacatcgaggcctatacgcagcagctggagcaaaaggtcgccaagctgcgcgaggcctacgacgcgggcgagcgcccggtcgcggtggatgccaagcgcattctgatcaccggctgcccggtgggcggcgtgatcaacaagatcggtcgcaccatcgagtccaacggcggtgtggtcgtgtgcatggacgactgctcgggcgagcgcacggcggccatgatgatcgacccggaggctcccgacatcctgcgcgccatcgccgaccgctacctggatatcaactgctcggtcatgacgcccaacgacggtcgtatggaaaacacgctggccatgtgcgagaagtaccacgtcgatggcgtggtggagagcgtgctgcaggcctgccacacctttaacgtggagagtgcgcgaatgcaggaggttgtcgagggtgcgggtattccgtatatgaagatcgagaccgactacagcaacggtgacatgggccagatcgagacccgaatcgccgcctttatcgagaccttgtaggagaatgtgacaaagggactgtccctttgtcacatgtgagggaggatgccaaggcgcctgaacgcgccgctacctttaatgtttagattgggagagagccatgatggggatcgggatcgatatcgggtcgacggctgcgaaggctgcggtggtggatggtgagggtgccattgcgtggacttgcgttatgccgacgggctattcgtcggtcgatgcggctgagcgcctgcgcggcgagcttgctgcgtccggctacgacgtagccgccgacgacgcgcgcgtgatcgcgaccggctacggccgtgtcgccgtgccctatgcgcacaaggtcgtgaccgagatcacctgccatggcaccggcgctgtggcgctctttggcgaccacggcaccgtgatcgacgtgggcggccaggacaccaaggtcatccaacttaaaggcggccgcgtggccaagtttgccatgaacgacaagtgcgctgccggtacggggcgctttttggagatcatggccgatcgtctgggcatttctcagcagcagatggcagacctcgcccgctctggtgagccaaccaagatcagcagcatgtgtacggtgtttgccgaaagcgaggtcattagcctgatcggtcgtggcgagccgcgcgagaatatcgcgcgcggtgtgatcgaaagcgtcgtgtcgcgcgtggcgactatggccgggcaggcagcgggcgccccgtactacctgaccggcggcctgtgcgagaacgcttacgttgtggagcggctgggagcgctgctgggctcgccggtgaccacctcgccccaggctcgctttgccggtgcgatcggcgcggcgattcgcgcgcaggcactcgcgtaaggggtcgggttcatgcgcatcctcaacatctcggcgcaaaagcccgatagcacgggaagcggtacctaccttgccgcactggtggcttcgcagatcgcggcgggccacgaggcggcggtgctttgcggcgcggctcctggtgacacacaaggggagctcgatcccgccgcgcatgtgtttacggtgccgttcgagacgcccgagctgccgtttcgcatctgcggcatgtcggacgttatgccctatccctcgacacgctaccgcgatctgacgcctgcgatggcggcggcctttgagcgggcctttggcacggcaatcgatcgtgccgtcgccgccttcaatcccgatgccatcatctgccaccacttgtacctgctgtgcgccctggtgcgcgagcgcgtgcgggggattcccgtgtgcggcgtgtgccattcgaccgatattcggcagatgctgacccatggactcgcccatgatcgcattgtcacggcggtccgctgcctcgatgccgtcttttcgcttcatgccgagcaagccgaggaaatcgagcgcgtttatggcgttgaccagtcgcgtatccatgtgattggtacgggctatgaccactgggtgttttgccgtgatgcgcaggcggcaaaggttaccgggtcgcttgtctttgtgggcaaggtgtgcgttaagaagggcgtcgaatcgctcgtgcgcgcgatggggcgctttggcgaggactctgatacggcgtacaaggtgcgcccgagtcggcttttgctggtgggaggccatggcgatacggatgagtatgagcgcatcgctcgggccgcccgggattctcccgtgccggtggagctcgccggtcgtctgagtcgcgatgagctggtgcgcgcttatcgcgaggccgaggtgtttgtactgccgtccttttacgagggcctaccgctggtgccgatcgaggcgatggcctgcggatgcaaggtcgttatgaccgatctgcccggcgtgcgaccgtggatcgaggctaccttgccctgcgcgcccgtgacgtgggtgacgccgccgcgtatgacggatgtcgatacgcccgatgtgctcgattgtccgcggtttgagcatgcgctggcagatgccgtggctcggtcgctcgcggaacccatctcgtcctttgacccatctgcggtttcgtgggatgcctgctgggcgcgtatactggagcagttgtcaaacttgaaaggaggtatcgatggataaggatcagattaggctcacgtctatgaccgccgcgagcggttgagccgctaagttggctcctggagccctcgcccaggtcctgggcgacttacccaatgtgcataacgacaacctgctcgtgggattcgatgcctccgacgatgcgagtgtcttccgcgttggcgaaaacctgggactcgtgcagtccatcgacttcttcccgccgatggtcgacgacccgttcctgtttggtcagatcgccgcggcaaactcgctgtcggatatctatgccatgggcggacgtccgagccatgccatgaacctgctgtgcattcccagctgcctgggcgttgaggtcgcggggcagatcctggcgggtggcgccgacaagtgcgtcgaggccggctgttccatcgcgggcggccacaccatcaacgacgacgagcccaagtacggtctgtccgtgagcggttttgtgccgctcgatcgcatgctcgccaatagcggcgcacgcgtgggcgatgttctgctgctgaccaaggcgatcggctcgggcatcatcaccaccgccattaagggcgagctcatcgagcaggacgaggccgcagtcatgtttgactcgatgcgcaccctcaacgaggcgccgattcgtctggccgagggacttgagcttcacggctgcaccgatgtcacgggctttggcctgatcgggcacgcgtgcgagatggccgagggctcgggcgtgcaggttgagcttgcgtcgggagcggtaccgctctttgatcaggtgctcgacatggcgcgcctgggcattatccccgcgggctcctaccgcaaccaggacttctttggcccgcgtgtggctgccggcgaggacctggagccgggcatgttggatgcgctgtacgatccgcagacctcgggcggcttgctcatcgcggcgcctgctgccgatgtggatgagcttgcgcgccgtctgcatgccgaaggacgtatcgcctccgtcgtcggccgcgtgtgcgagccggtgccgggcggttctgccgttcgcgttgtgcattaaggaaaactgtttatgcgactggctactgttctgggcggtcccttttgaaaggatgtaactatgtctaccaaaattgaagtcaatgccatgggcgatgcctgcccgctgcctgtcgtcaagacgctcaaggctctgaagcagctcgacggcgagggcgccgtcgtgacctcggtcgataacgagaccgccgtcaagaacatctccaagatggcgcaggagaagggctgcgcggcctcggtcgagaaggtttctgacgccgagtggcacgtgaccgtggcgacctctggcgccgttgccgtggctgatcccgagcaggatggcgctgccttctgtgatgccagcgccggcaagggcaagctcgtcatttccgtctacaccgactgcatgggccgtggcgacgacgagctgggtcacaagctcatgaaggcgtttatcttcgccgtgacgcagcaggaggagctgcccgcgaccatgctgttctacaacggcggcgccaagctcactgtcgagggctcaccggtactcgacgacctgaagggtctggccgagcagggtgtcgagatccttacctgtggtacctgcctcgaccactatggcattaaagaccagcttgctgtgggcgaggtcaccaacatgtacgtgatcgtggagaagatggagcaggccgtgcgcgtcgtgcgcccgtagcgtattggttggagttgccatgagggagaagcgcccggcgcttgtcatcacgtttcccaccacggcggccgccatggggtgcgagaccctatgcatcgagcgcggacttcccgggcgcgcgattcccgtgcccggggaggtcgctgccggctgcggcttggcgtggaaggcgctgccttcggatgagggcctgctgcgcggcgagctttccgcggcgggcgtccccaccgagggttttacggtgatcgacatgtgggaggtcgtgcgatgatctacctggataacgcggcgacgaccatgtataagccgcaaacggtcatcgatgccgtgacgcaggctatgtgctcgctcggcaatgccgggcgcggtgccacgtcgggtgcgctcgatgcggcgcgtaccatccacggctgccgcgccaagcttgcgcgcttgttgggctgcccgcgtgctgaccatgtttgttttacgcccaactccaccgcggcgctcaacaccgtcatcaatggcgtggtgcgccccggcgaccgcgtggtcacgacggtgctcgagcacaactccgtgctgcgcccgctcaatcgtcttgcggctgagcggggcgtgaccgttgagcatgccggatgcgacgccaacggcgtgctcgactatgacgagcttgagcgcttgatgacgccgggtacgcgcgccgtcgtggtgacgcaagcatccaacgtgaccggcaatgcggtcgatatcgtgcgcgtggcggctatggcacacgccgtcggcgcgctggtgattgtcgatgcgtcgcagtctgccggtacggcgcagattgacatgcagggcatgggactcgatatcgtgtgctttaccggccacaaggggctgatgggtccccagggcaccggtggcctggctgtgacggagggcgtcgacgtagcgccgtgggccatgggcggcacgggcgtgcacagcttcgatgcgctgcagccgcatgagtggccgacgcgcctggaggcgggcacacttaacggccatggtattgccggtctttccgctggactcgattttatcgatacccagggaggggtcgaggcgattgctgcccacgagcgtgcgcttgccgatcgcttccttgccggcgtgcgcgagattccggggattaagctctacggtgcctttgaccagccgacgcactctgcgattgtgtcgctcaacgtgggcgatatcgattctgccgagatctcggatgcgctcatgcaagggtgggggattgcgacgcgccccggcgcccattgcgccccgctcatgcaccgtgcgctgggaaccgagcgccagggcgtcgtccgcttctcatttgggtatttcaacacgaccgaagaagtcgacacggctatcgatgctctgtgcgatttagcctgctaaagctgctagagcgtatatacttgcgggacgggtgtttttgcccgtcccgtttttgtttcgacccgaaaggtgtgtctatggcctcatccgcgccgcgcggtctgcgctccgaccatgtcgtcaccgtcggcatcgccctgttctcgatgctctttggcgccggcaacctcattattccaccactgctggcgctgcaggcaggttctgccacgccggtcgccatgctcggctttctcatcgccgccatcggcctgcccgtcatgggctttatcgccgtggcgcttgccggaacggcgcgcgagcttgccggccgcgtgcaccccaagttcggtgagttctttgtcgcggcggtctatttagcgatcggcccgtgcctggccattccgcgtacgagctccacggccttcgagatgctggtgccgctgctgcccgagggcgtctcgcttggcacggctcgcctggtgtttgccgttggcttctttgtcgtcgcgtttgcgctcacgctgcgtccgggcgtcatcacgcgcgtgctcggccgcattacgggccccgcgctcattgcgctcatcgtgctggttgtgggtgctgccgtaatctcgccgctgggaccggctgctgcgcctcaggctccctacgatgcgggcgctgccgtgcaaggctttttgaccgggtaccagaccatggacctgctcgcgtcgctcgcctttggcatcatcatcgccgagaccatccatgagcttggtgttaccgacgataagcgcgtggccttcgagatctcgcgctccggtgtgatcgccggcgtgctcatggccatcatctactgcggcctggcgcttgccggcatgcagctcggcacggttatgcccgacgccaccaacggcgccgccatccttgcccgttcggcctccatgcactttggcctagccggcacggtcgtggtctttgcgatcttcttcctcgcctgcatgaacgtgtgcatcggcctcatcagctgctgctcgcgttacttctgcgagacgtatgtggtcgaagggggagcggaggcttccgaggaggccatgcgccgtcccttcgcgattctcgcctttgtgttcgcggcgttttcgtgcgtgctctccaacgtgggcctcgacgtgatccttatgttctcggtgcccatgcttaatgccctgtatcccgttgccattgtgctggtacttatgggcctgatgcacggcttttgcgacgcgcatccgcaggtgtgggtctgggtcggcggtgttgtcgcggtgcagagtgtgatcacctcggtccgcgatgcgttctttgcgggcgcgtggctgccgttcgatgcgttgccgctggcagatatcggtgctgcgtgggcgccggttgctgtggtggcgtttgtgatcggtctggttcatagccagtttgtcacacattcgaggagctagggtttctgcgcttgcacaggcggggagtctcccctataatttctttcgctttgggacacgcaaggtttatgccttagctgctcaacaccttcgggacgtggcgcagtttggtagcgcgcctgctttgggagcaggatgtcgcaggttcaaatcctgtcgtcccgaccatatcttgcgggcgtagttcaatggtagaaccccagccttccaagctgatgacgcgggttcgattcccgtcgcccgctccataagatagctttaacggctctggctccatttggtgccagagccgttttcataagcgtgccgggcgacgggaatcgaacccggcagggtgcgaagctgagaaaatgcgtgagcattttccagcgcagcacgcaagggccaatggcccgcagcgaaacaagggtttgcgaagcaaacccttggacttcccgtcgcccgctccataagatagatgaatggctctagttccttttgggaccagagccattttcgtaagtgtacgaggtgcgggaatcgatgccgcctcacctaagttgcggtgaaatacgggctgtcgtttggcttttgcgaacccattgaaggccggggtagctaatttgggacggggctgttttgactactctagcgataggctggcaaatgtggtcaaaaaagccctgtccctaaatgactggtccggtgctgagccacgaaagcggcccatctactacgtttggcccgcaggggtcgaccatagcggcattttcggaaaatcagcaagccgtctaccagcggttttgatatttcggatttcggtatggtcgagggtaatcggttaaacgtagtagataggcccatttcgtggcgaacagtaggattcgcggtccaaggctgtcggtttcggatggccaacctggaagttgcggtggaatagttcctaaaaggcccgtggaagcttgaaaacaggaactatttcaccgcaacttaagaggggatgggctgaggggcgggcgatgccgttgtctgtcggttagtggcgaccgtggtggcggagcttgtcgatggtggagtcggtgcttcggctgcgggcttcggctgcggtttggcgcttgtggcggtaatcgatcatgccttggatgatgggcttgccaaagctcacgacatcatcgttgtagatggcggttcgggctgcgaggaggcagtcggtaaagtccatatgggtcttgccaaagagtttgacggcaagggcgacaacggtgggctcgtcgaccataacgtcatcgagcagccttttcatggccgcggcaatctcaacgcggggaaccttatagacgtcgcgcagcgtgaccacgacgcgcgtgatgatttcggggtagacacgagcggtgcgcgtggcgatgaccttggcggcgcgcggtgacaggacctcgtcgtcgttaagcaggtagcgcaggatgacggtctcgtcgatgatggtgctactcatggatatctacttcctcgggacccaaaatcgaatcgtcgctttctgtggcaaggtactcaatccaggcattgcgctcctcggagcggcgattggggtccccataggctttgagcgatccataggcggcggtgccatcctttgagcgcacggcgaccggctgaaaggggagcttgcgcatcaaaatgctttgcgcgacaaatagacggacagcctcggcgagcgatgtgcccatggcgtcgtagagacgctcagcatgctgcttgtcttcctcgcgaatgcgcacctgcaggatggctcgtttttgagtcgatgacatcactggcctcccttaatgagcgtgcaatttgaatagtcaaatacagcagtggctaataatagccaatcttacaaccactactttattgcactagagtaattgagtgtaaacgatattacaaacgtactacatccttcagaaatgagcgtgaaatctttcttgggcgtacgcgtgtaatacactcacctttatatcctatcgagaataattccaacctgccaaaacccctgcaatacacccgtattgcagggcctatcctcaagtttgccacctgcaactgcgtatatttaacctgtatatcgttggaggaattctatcgaagtgcctgtttcgccgcatgcgctcgatacgccgatgccggaccacgggcggtccggggcaacgtcgacagggtctctccggcatgggattcaggagggagtgaacaacatgggcaataaacgagtcgtagccgattcttcgcgctgcattgggtgccaaacctgtatggcggcgtgcatcgaggcacacgatattcccggcaacatcgccgcacctcgcttgcgcgtaacgcgcacctacgagatctccgcgccggtggcatgtcaccactgcgaggacgctccgtgcgcgaaggcctgtcctacgggcgccttgttctttgatccaaagaaccatcgtatcggcgtcaacgaggacaactgcatcggctgcaagagctgcgtcatggcatgcccctttggcgccgtgagcgtggcgaccacgcaggtccccgtcttgatgggtgacgtgcgcgtgggttcgcagaccaagagcttcgtgctcaagtgcgacctgtgcgtggaccgtcccggcggtccggcgtgtgccgaggcgtgcccgaccaagggcctcaccctggtagacgaggagcgcctggcagaactgactgccgagcgtgcccgcgccaccatcgaaaacgaggcgtaaacggccggccatacaggcccaatgattgtcaaataagaaccgagtattcggtagcagagaaaggaaggagggtgtcatggagaagcataaagtgatctgcccgtactgcggcgccggttgccagtttaacctcctggtccaaaacggccaggtcgtgggcaccgaaccgctcaacggcatcaccaaccagagcgagctgtgtcttaagggcatgagcggctacgacttcatcaacgacaccaagatcttgactcctcgcgtactgcacccgatgatccgtcgcaccaagggcgcggatcttgagcgcgtaagctgggacgaggcactggatttcaccgcatctaagatgcaggccataattgacgaatatggtcctaacgctgtcatgaccaccggctcttcgcgaggcggcggcaatgaggcgaattacgtcatgcagaagtttacgcgtgcgtgcatcggcacccacagcgtggacaactgcgcccgtacttgacacggccctactgtcctcggtctgatggacacggttggttcaggttgcatgtcatgctccatccccggtatggaggatgcgggctgcattttcctcttcggctataaccctgccgattcgcaccccatcgtcgcaaggcgtatcgtgcgagccaaagaaaagggttgcaagatcatcgtcgccgacccgcgccatatcgaaaccgcgcgtatcgccgatctctaccttccgatcaagaacggttgcaatgttgcgttcctcaacgcctttgccaactgcttggtcaacgatggcctctacgacaaggaattcgtcgccgagcacacgaacggctttgacgagtggtgggagaccatcaagaactacactcccgaatccgtacaggacatcacgggtgtcgagcccgcgttgatccaccaagctgccgagatgtacgccacggcgaagccctctgccatcattggctggggcatgggcgtatgccagcagaagcagaacctgaagacggtgcacaccatcgcctccatcgcctgcgttgccggccagatcggcaaacccaactccggcctcgcgcccgtgcgtggccagaataacgtccagggctcctgcgatatgggcatgctgcccaacctgtaccctggctaccagaaggtcaccgacccggcagtgcgtgccaagtttgccaaggcttggggcgtgcccgaggaaaagctcccgctcgaggagggctacaagctcaccgacctgggccacctggtcgacgagggcaaggtgcactgcttctacaactacggcgaggacccggtgcagaccgagcccgattcggccggaatgcgcaagacgctctccgagctggatctgttcatttgccaggacatctttatgacgcagacgaccatgctcgccgacgtcatcctgcctgccacctcttggggcgagcacgagggtgtctttaccgcatccgaccgtagcttccagcactttgacgcggccgttccgcccaagggcgagtgccgccacgactgggagatcttcgcggacctgtctacgcgcatgggctatcccatgcactacgacaacaccgagcagatctggaacgagtgcattagcctgtgccccaactttgtgggcgcaacctacgagaagatggctcccgagggcggttacgcccagtggccggtcaagagcaccgatgtgaacgaccacggtacgcccgacatgttcgctggtggcaagttcaccaccaaggacggtcgcgccaacctgatggcgcacgactgggaggcgccctccgagcttcccgacgatgagtacccgctcattctgtgcaccgtccgcgaggtcggccactacagctgccgttcgatgaccggcaactgcaagacgctggcgctgctcgccgacgagcccggctttgtccgcatgaatcccgcggacgcccaggcgcgcggcatcaagaacggcgacatcgtctcgatccacagccgccgcggccaggtatacagccgcgccgacgtgagcgaccgtatcaacaagggcacggtctatatgacctaccagtggtggatcggcaagtgcaacgagctgaccattcacaaggtcgacccggtctcgcatacgcccgaggacaagttctctgcctgccaggtcgacgctatcgccgaccaggtctgggctgagggcgaggtcgagcgtcagtacaccgagctcaagcaggctctggtggacgccgccgctcctcaggacgttgagcccggcgccgccaagttcgacgacgagacgcacgtgaatcaaatcgtgtagtcccgttctcgttggctttttgggccgggcgtcccgtacgttcgggagcccggcccgttattttgaaaggaagtggggatgaaccgcttcatcgacatcaacccggagaggtgcatcggctgcggaacatgccagtccgcctgtgccgacgcccaccggatgcagggtcttcaggatacgccgcgcctggcgctcgtgaagaccggcggtatttcggccgcccttgcctgccaccattgcgagggtgccccctgcgccgaggtctgcccggtgaatgccatcgagcacgatggcgaccgcatccacgtcaaggagcaggagtgcatcgggtgcaggctgtgcgccatcgcgtgccccttcggtgccatccatcccgatggcacgtctatcgccggtgtcgcaggcatgtgcgacccgacgccttcgtatcctaagtccctgagcagcctgcttacgtggactcctggccagtacacctgcgctgtcaagtgcgacctgtgcgccttcgatgcggacggcccgcattgtgtggcggcgtgccccaccaaggcgctgaccgtcatgggcggcgcggccgatcgcgaactcgacgaggccaagcgcctgcgctcgattgaaaacggtccggtcgtcgacgttaccgctgtggcccagggcctgtccgagaaagcagaagggagcgtaaacaatggatagcatgacgctgtttatcgcatcgcttgccgtctcgtgcatcggtgcgctcgcctcggttctgctgatcaaggccgataacgccgccaagaccgccggctgcctaatcggcgccgtcgccgcggtgctttcgtttgtggccggtatccaggccgtgctgggcgatgtcacgtcggtcgacaccatcgtgttcttcccgtttgcccatttccagctgctgctcaatcagctgtccggcctgttcgtggcgctcatctcggtgctcgcgtttgccggttcgatctacggtctcaactattttgatgagtacccgggcaaaaagggccgcgccggattcttctttaacaccttcgtggcgtccatgatgctcgtcatcaccgccgacaacgtgttttggttcctggtcgcctttgagctcatgtcgctgacctcgtacttcctcgtcgtgatcgaggagaacgagaattccatccacggcggttggctctactttgtgatcgcgcacgtcggctttgtgctcatcatggcgagcttcctcaccatgaccaacttcgccggtggctcgtttgcctttgcggatttccgcgccacgcagtttagccccgcggtcgcatccgtgtgcttcgtgctcgccttctttggctttggcgccaaggccggtatcatcccgctgcacggctggctgcctaaggcacatcccgaggcgccgtccaacgtgtcggccctcatgtccggcggcatgatcaagattggtatcttcggcattctcaaagtgggcctcgacctgctctccgcttcgggcgttcaggtttggtggggccttatggtcatggtcttcggtgcgatctcgtcggttctcggcgtggccttcgccctgcaggagcatgacatcaagcgcctgctggcctatcactccgtcgagaacatcggcatcattctgctcggcgtcggtgcctccatggccgccatggcgctcaactcggtcggtatcgccgtcctggctctgatggccgccctctaccacacgtttaaccacgcgatgtttaagggcgagctgttcttgggcgccggtgcgctgctgtactctacgggtacgcgcaatatggagaagatgggcggcctgttccgtcgtatgccggcaacggccatctgcttcctcgttggcgcgcttgccatctcggccatcccgcccttcaacggctttgtgtccgagtggtttacctaccagtcgctctttaacgccgccatgcagggcgacaaggccgtcatgatcgtggccgtgttcgctgccgtcgcgcttgccattaccggcgcactggctgtcacgtgctttgtcaaggcctatggcgtctcctttgcctccgcgcctcgctccgaggccgcggcaaatgccaaggaggttcccgcccccatggtgtttgcgcagggtctgctcgcggccatctgcgtcgttctgggcattggcgctcccgtgatcgcgcccgtgctggtcgatgtcgccgcgtccgtgctgcatccgtacggtggcgtgtttgccgccgagggcatggagctcatgaaccagtactccggcgctgccacctccacgcccgcgatcgccattgcgctcgtggtgctcgtcggccttgcctgcggttatcgcaagctcaagaccgtcggcaaggtgcagaagtcccagccgtgggcatgcggctatgctcccaacgagcatatgcccgtcatggccacgacctttgcctccgaggtgtcctggtttatgcagccgctctacacgctgcgcgaccgctgcacggccgtctgctggtccatcgcgcacttcttccagaagctcaccggtgtggccgaggctgtggagcccgtacccgacaaggttctcgtcgatgccccgcataagggtgtcgagaagctcgccgacctcgcgactaagctcgagggcggcaactacagcatctatatctgctatatcgtcgcggcactcgtggtgttcctcgtgctcgccgtgcaaatgggttaaggaggggagagcatgaacaacatcgtacttgccgttctgcagggcgtggtcgtcatggccgtcgcgccgttcttctccggtctcggccgcgtgatccgcgccaagatgcacaaccgtcgcggccccagcatcatgcaggactaccgcgacctggccaagctctttgcgcgccccgagtcccagagcgaggacgcgagctttgcgctgcgcattatgcctccgctgttcttcgccgtcgcctttatgctcgcgatgggcctgccgctctttacggcacaaagccccatcccggtctttggtgacgccatcaccatcatgtacagcctggcgctcgcgcgcttcttcttcgccctctgcggtgtggattcgtccaacgcctacgccggtatcggcggcgttcgcgagctgcttatgagcgtgctcatcgagccgtccatgctgctggcgctgtttgccgccgccctggtgtgtggctccaccgacatcgccactatgggtcagcacatcatgacgggcgccgtcgacgcgccggtcgccgtgatcctcgccggcatcgcctttgcgatcgcctgctacatggaactcggcaagctgccgtttgatcaggccgaggccgagcaggagcttcaggaaggtccgctcgccgagctttccggcccgtcgctcgccatggccaagctcgccatgtccatgaaacaggtcctggtcgtcgcttggttctgcgcaatcttcatcccttggggcgagcccgcgaccgtgggcaccgccgccgttctgggtgccgtcatcttcctggtgaagtgccttatcgactttgtcgtatgcggcgtgatcgagaactcctgctcgcgctcgcgttttaaggtactcggtaatcagacctgggctgtcgtgggcatcgccgttctggcgtttgtcttcgtggtcgtcggcgtgtaggagaagggagaaacaatgtcatttgcagtcagtctgtcccttctcggcttggtcgctatcgcggccccgatggtggcctcggtgctcgtcgccctgttcccccgtccgtacgccaagtggttcagcgttttgggtgccgccgtctcgacggtctgcaccatcgccctcgccgcgaatttcgctggcgccggcatgcccgacacgcaggtccccctgatctcgtttgggcagaccctcgtcatgggattcaccttcgatcgcatgagcacgctgctcgcgcccgcctttgtgggtatcggcctgcttgtcgtgatctattcgatcccctatatgagcgagaacaaccgtgagcatcccgacgcgccgcgtcgtcgcttctacgcgtacctcgcgaccttcatcggcgccatggccggcctcgtgtacagctcgacccttttgggccagctcgtgttctttgagatcacgggcgcgtgctcttggggcctcattagctactacatgacgcctacggccaagaaggccggcatgaaggccctgatcatcacgcatatcggtgcgctcggcctgtatctgggcgctgccatcgtgtttgcccacaccggcaccttcgccattaccgcgattgccggcctcgatgccaagctcaaggctatcgtccttttgctcgtgctgtttgcggcctgggccaagtccgcacaggttcccatgtacatgtggctgccttcggccatggaggcaccgacgcctgtttcggcctacctgcatggtgcctcgatggttaaggtcggcgtgtgcgtgttcgcgcgtgcactcgtctctgccggcgagattcccgagatcgtgggctgggtcgccattatcgacgccatggtcaccatgctctttggtttccttatgtacctgccgcaaaaggacatgaagcgtctgctggccttctccacgatcgcccagctctcctatgtgttctttggtctgggcctttcggtctttggcagccagctggcctttgatggcgccgtgtgccacatctttaaccacgctttcgccaagacgctgttcttcctgatcgccggttcgttctccttcacgctcggcacgcgtatgctgcccaagcttcgcggcatcgtaaagaagtacccgatctcgggcgtgggctttggtgtcgccgcgctcgccattgccggcgtgccgcccatgaacacgttcttctcgaagttccagatcatcgccggcggcttctctgttggtgccggcaacgttgcgatcctggtgctcgtgtgcatcatggttgccgagaccgtcgccaccttcgcctggttcctcaagtggatgggctattgcctgcccggcgagccgagcgaggaagtcgccgctggtgcaccgctccccaaggcaatggcattcgtgttcatcgtactcatcatcatggtcatcgtcagcggcccgctttcggccagctggatcggttaggaggtagaacgacatgggttattcgatcgtcaacatccttggcggccttctgatcgtcacgtccaccatggtggtcgtctcaaagaacatcaagcacgccatcagctggtatgcggtgcagtcgctggtgcttgtggggttgctcgccacgctcggtgccactaccggtgcgcaggagctgcttatgtgggccggatccgcctttatcaccaaggtcgtcctggtcccttacatcctcaaccgcgcatacaagaagatgggcgagccgagcgacgcatcgctcaaggccggccttaagcccgcgtgggccatctgcatcatcgccgtcgaggtcgcgatttgctttgccgtcgtgacgcagatcagcctgcccacggccgaggtcgcaacgcctgcgctcgctattagcttcgctcacttctttgtgggcctcacctgcatcatctcgcagcgcaacatcatgaagcagatctttggatactgcctcatggaaaacggcagccacgtgacgctcgcgcttttggcccccaccgctcccgagatcatcgagatcggtatcgccaccgacgccatctttgccgtcatcatcatgtccatcgtcgtgcgtcgcatttgggacgactcccactcgctcgatgcgcgcgacctgtccgagctgagggggtagtccatggaaacgttgattctcgccctgctcgcgactcctttggtgttctcgctgatcatggcatttttgcccaagaacacgtcctataacgtgtttgccggtctcaacctggtctccgtcgcagccgtcctggtgctgtcgattatgacggccggtgacgtccttatgagcggcgacaccgcgagcgctcttggcctgtggtttcacctcgattcgctgggcgccatctttgtgctgctcatcggctttatcggttttcttacggggctgttctcgctgccctatgtaaaggccgatatcgaggagggctccatgcccgccgagcgcgccaagcagtattttgcgctgtttagcctgttcgtgttcaccatgctgctcgcgtgcctgtccaacaacatgatcctcacgtgggccgccgtggaggcaaccacgctttccaccgtgttcctcgtgggtatctacaagaacaagacggccctcgaggcttcttggaagtatgcgatggtctgcaccgccggcgtggcctttggcctgttcggtacgctgctgatctacgccaacgccgccgacgtgattcccaacgcccacgaggccgcattcctgtcgtgcgtgctgccgtatgccgaccagttcgacccgacgctcatgcgcctcgcctttgcgtttatcgtgatcggctttggcaccaaggccggcctgttccccatgcacacttggctgcccgatgcccactcccaggccccgagccctgtttcggccctgctctcgggcgtgctgcttaagtgcgccatgcttgtgatcatgcgcttctacggctttaccatccaggccgtgggcgccgagtatccgcaacttttgctgctgatcgtcggcacgctgtccattttggtggcggcactttcgatgtttcgccaggacgacctcaagcgccgctttgcgtactcgtctgtggagaacgtgggcgttatcgccctgtgcctgggtatcggtggcccgctgggtatcgccgcggccctgctgcactgcgtgttccacggctttaccaagacgcttgccttctgcgtgtccggcaacatccagcacgcctttggcacgcgtagcctggctaagattcagggtgtcgtcgaggttgcccccgcaaccgccgcgctcgccatcctggcgctgctcggtcttggtgccttcccgccctttggcatgtttatctccgagttcctgacttttgtcgccggtgtcactgccggtcccatgtggctggtcgtcgtggtcgccctcggtcttaccgtggccatctccgcgctcacccgcatcgcactcaagtcggtgttcggccatgcgccccagggcatgggcaagcatgaggccccggcgctcatgcttatccccgaaatcatcctggccgtcatgatcttgtggtttggcatcgccaccccgctgcctctcgtgcacggtgtggagaccgcgaccggcatcgtgctcgagcagagcaccgaggaacttcacgcgacgccgatgtaccgcgctgtgttcggtaccgagaccgctcagagcgaggtggagtaacgaatgattgaaactgagaacaaggtgtatgcccgtcgctgcgagagccatgtcgaggccctgcgccgcgccgttccgggctgcatcgagaaggtcgagtggcagtgcgaggaccagctgacgattaccgtcaagcaggacaagctgcccgaggccgtccactacctgtattacgagcgctacggctggattcccgtgattatcggcaacgatgagcgcagcctgtgcggccgttacgccgtgtactacgtcatctccatggagggggaggatcccggctgggtgaccgtgcgtaccgagatcgatcccgccaagatgacgttcccgtccgtgacgccgttcgtccccgcctgcgtgtggggcgagcgcgagctgcgcgacatgttcggcctgatccccgagggcctgcccgatcgccgtcgcctggtgctgcccgatgactggcccagcggcctgtacccgctgcgtaaggactccatggactaccgcttccgtcccgctcccgcgagcgatatggaaaactacgagttcttggccgataccaagggcaaggagaccacgctcgtccccatgggcccgttgcacattacctccgacgagcccggccacttccgcctgttcgttgagggcgagacgatcgtggacgccgactatcgtctgttctacgtgcaccgcggcatggagaaggttgccgagacgcgcctgaactatgacgccgtgacgttcctcgccgaccgcatctgcggcatctgcggctgcgcccactcggtggcctacgccgaggccgtcgagcgcgcccagggtatccatgtcccgccgcgcgcccagtacatccgcgccatcatgctcgaggtcgagcgcctgcactcgcatctgctcaacattggcctggcgtcgcactacacgggcttcgactccggcttccagcagttcttccgcgtccgcgagaagtccatggacctggccgagaagctctccggtcaccgcaagacctacggcctcaacgtgatcggcggcgtgcgtcgcgacattttggccgagcagaagctctccaccctcacgaccatccaccagctgcgctccgaggttcaggagctcgtcgacgtcttgctctcgacgcccaactttattgagcgtacgagtggcatcggcatcttggaccgcaagatcgcacgcgatttctcgccggtcggcccgctcatgcgtggctcgggctatgcccgcgacgtgcgctttgaccatcccttcgacggctacgccgatccggacgtccagaagatgcacgccgccacggccgacacctgcgatgccttcggccgtaccgccgttcgcatccaggaggtctacgattcgatcgacatgatcgagaccatgctcgagaactgcccgtcgggtcccatcctcaccacggattgggagtacaccccgcacaagtacgccatcggtgccaccgaggcgccgcgcggcgaggacgtgcattgggccatgctcggcaacaaccagaagtgctaccgctggcgcgccaaggccgccacgtacagcaactggccggtcctgcgctacatgttccgcggcaacaccgtgggcgacgcggcgctgatcgtcggctcgctcgacccgtgctactcctgcaccgaccgcgtgacggtgaccgatgtcgccgccaagcgcgaccacgtgctcgataaggagcagttcgagaacgtctggcgcgacaagtcgccgcttgcgggcgagggcactatggccgctccgctcgatgaggaggcgctctaatatgctgaagctttggaaggtaaacgccaaggccggcgacgcgacggtcaagtacccgtttgcgccgttccccaccaacaaggacatgcgcggcaagcccgagcacaatgccgagctctgcatcgcctgcggtgcctgcggcgtggcgtgcccggccgatgccattcgcatggacaccgaccttgcggccgataccattacctggtcgatcgactacggccgctgcatcttctgcggccgctgcgaggaggcctgccccatggaggccatcaagctcaccgaggagtttgagctggccgtcatgagcaaggacgacctcaccagcaagagcgtctacacgctcgagcactgctcgcgttgcggcaagccgtttgccccgcacaaggagatcgactacgccaagcgcctgctgcaaaagaccggcggcatggaggccatccaggccgcccgtaccgtcggtatgtgccaggagtgcaagcgcgagctcgacgccctgcgcgccgcatcggccgtaaagaccggcaacgcgcacggcatggctgccaacgagacgcttgcgtccggtgagccccagggccccggcatggagtatctgggcggccacggcgtgaacccggagtatatcgaccgcgagctcaaccccgatgcgcccgagattcccgccggtccggcgccggtcgagggcatcatcatggattttgaaacgaaggaggagtaaccatggccgaacccacgcttttgcccgagcggctccagtaccgcccgaccaagatcgagctcgacgagagcatcgagaaggccaaggcgacccttcttaagaagatcaagcgctcggtgtacgtctaccgcgttgactgcggcggctgcaacggctgcgagatcgagatcttcggttccatcacgcccgtcttcgacgtcgagcgctttggcatcaaggtcgtgccttcgccccgtcacgccgatgtgctgctgtacaccggtgccgtgacgcgtgccatgcgcatgccggccctgcgcgcctttgaggctgcacccgatcccaagatcgtggtgtcctatggcgcgtgcggctgcaccggcggcatcttctacgacaactactgcgtctggggcggcacggataagattcttccggtcgatgtctacatccccggctgcccgcccagccccgcgcagaccatctacggctttgccatggcgctcggtctgctggaccaaaagctccatgccgagaccacggtggaggccgccggcgagcaggccgatatcctgcaccccggcgtgccgtacaagctgcgcgttgccatcgagcgcgaggctcgcgccatgagcggctaccgttacggccgcgacctggccaacgagtttatggacacgctcgagggtgcgcccaagggcgatatccgcggtgccatggcgctgctcatcgacaagcaggacgatccgcgtcgcgtcgaggtgtactcggcgctgcaggatctagtgctggccggaggtcgctagatggagctcacggaccgctctggttactttgcgggccccggcatgctcggcggctcttttggcgatgcctcgcgcgcaagcgacgaggccgccgagggcgtcgccgacccctgcctgggccatgcgcccgaccaggtggtcttctacgagctcacgcgtaagtttgtggagaccgaggaagacgttccccaggaggcctgcgacgtgctgtactacacgctcgccgtgggccaccacaccggcgtgctcgattgctttgagccgcgcctgtcggtgccggtggatgtgttctattcgctcgtcgacgctctgcctgagggggaggccaagaccaagttcgaggccatccgctcctttggcgagtgccagctcgacaaggcggcggtgccgtcgctgctcgaggcctgcgatgcgctgctcgaagaacgcggttttcgtgggtcggccaaggccggcatctcggtgttcgacgacgactttggcctgcatgcccagcaggtcgcgtttctgatgaagttccgcgatctggttgagcgcgtgcgcgatgtgtcgggcgtgtatctgacggggaggttgcagtaatgggtcgcgttgtggatggacgtgtgaacggcgccccgtttgcgggtatcgtgctcacggcgggaagcgtgctgcgtgccgacgatgccgccggccccgtgctttccaaaaagatggaggacgcgccgcttgccggttggtacaccatcgacggcggccaaacgcccgaggacgacatcatcgaggtcaagcgcgagcgtccgccgcgtctggtcttggttgatgccgccgacatggcactgcccgtcgggtccatccgtttgctcgacaagcgcgatgtggcccgcaagtcgatgttcaccacgcattcgctccctttgtcgattctgatcgaggaaatcgagcaatcgtgtgatgatatcgtcttcgttgggattcaaccgggcgacacggagttctacaaccccatgtccccggaagtctttgacgccgtcgacgccgtgtataacgccgtggctgccaacgacttttcccactttgtccgcttggggcaagagcaataggtgcgcttgtccctgctgattaggaaagaagtgattgacatggcagattccaaggtggagtatcccgctcccgattgcctggcgcccgccgcgatcgaggccaaaaccgaggccgccggcgtaaccaaggccaacctgccggtcgcaaaggcctttgttttggcgatgttcgccggcgcgttcattgccttcggtggcctgttctttaccgtgttcttgagcgatagcacgctgggctggggcgcccagcgcgtcgtgggcggcctgtgcttttgcctgggcctggtgctggtgctggtgtgtggcgccgagttgttcaccggcaactcgctcatggtctgcgcgctcaagagcaaaaagatcaccctggctcagatgctcaaggcatggctcgtcgtgtggcttggtaactttgtcggtgccctgttcatcgtctttttggtgtacatggccggcatttacaagctcaacggcgaggcggtcgccaattccatggtgagcgtcgccgccggcaaggtgacggtcgactgggtgacgatcttcttccgcggcatcctgtgcaacatctttgtgtgcctggccgtgtggatcggtaccgccggcaagaccgtggtcgataaggtcgtgggcattcttctgcccatcgccgcctttgtggcctgcggttttgagcactgcgtcgccaacatgtactttttgcccatgggtgccgtgatgcacgcgtgcggctatggtgccaaggtcgccggcgccgatgcgctcaacgccgcgggcattgcgtttaacctgtccgccgccacgctgggcaacatcgtgggcggtgcggttctgatcgcgctcggctactggtttatctacgccaagaagtccgaggcgtaaggtaccgtctgtttgacgttgggcctcccgcggggcgttgccgtgcgggaggctttttgggtccgggactcgttgccgggcttttggcctgttgtgtttggctgatgaaaggggtaatcgagatggcatctgctgtgaagcgtgacggtcgcgccgtggtgaccacatgcgggggatgctatgccgattgcgcctttgcggcccatgttgaggatggacgtgtggtggctgagctgccggttgcggggcatccgtgcgcggcgcgagccctgtgtgcccgcggacggcatcgcctggcaatgccgtttgacgagcgtgaccggattttgcatcccatgcgccgacgagctgatggctcggggttcgatgcaatttcgtgggatgaggcgttcgcgcacatcgcagcgcgccttggggagattgttgacgagcgcgggcctcgttcgctgggcatgacgctcggggtgccctcgttcgaccgctactgggcgcatcgctttatgcatgcgctgggctcgcccaacgtatacggtgccgacggtgcctgcgaggtaagccgtctcaccggctgggagcacagcctgggctatagtcccgcttccgacctggcgcataccgattgcatcatgtacctggggcgttccattgtcgattcgtcgacgatgggggccgttgatgcgctcaacgatgcccgtcgccgtggggcgaagattatcgtggtcgacccccggcgcagcggttcggctgcgcttgccgaccgctggctgcgtgtgcgcccgggttgcgacctggccttgctgttgggcattgtccacgtgttgattgccgaggatctgtacgaccgcgagtttgttgcccgctataccacaggttttgacgagttggcgcaggcagccagtgcttggacgcccgagtgggccgagtcgatgtgcgacgtgccggcggacgatatccgtgcgactgcgcgagatttggctgccgcggcgcctgctgcggtggtggacgctggctttcatggtggcatcggcattgcgtatgccaacagcacccagaccgcgcgtgctatctgcctggtcgatgtgctgctgggctgtattggacatgcgggtggcgcgctcaatccgcccacgccgcttgtgttgggcgacctcgatcccacgcgctttgcgacgccgccggtgccgcgcgagcccaagctggggtccgagcgctatccactggtcgatccggtgcgcggcctgtgtacgaccattggccagtccattcttgccggtgacctgcgcgggctcatcgtctatgccagtaaccccggtgcgggctatggcaatgcacaggcttggttgagtattttgcagcagctcgacttgctcgtgacgattgatattcgctggtccgagacggcgcgtgcttctgatttcgtgctgcctgacgtgacgtatctggaggctgaccgcggcgtgggaacggtgacaggcgccaacgatgcgcgcgtgttctaccgcaacgccgtgctgcctgtgcagcatgacgacacacgtcccggtcgggagatttttgccggtctggcgcaggcgtgtggcgtgggcgagtacttccagtttacgtccgacgatctggccgccgcccaggtggcaccgtttgggatcgatcttgccgcactcaaggagcgaggctgggccgacacgggtgttgcgttgccgtcgcgtacgggcgagccggcgattcccctggatggcggcaaaattgcgctggcaagcgacgtatgggaacgagccggtctgggtcgtgtacccaactggatcgctcccatggtggagcccgacccaggaatgtttcgcctcattagcggcaatcgaccctttgagtcgcatacctcgcgcaggcttgcggcccaaggtgccgccgaggctggatcggacctggatgccgtgcagatgaatgccgatgctgctacgcgcatgggcatcgccgacggcgagatcatcgagctcgtgagcgatatgggccgcgaccgcgtgcgcgtggagacgacgccgtatctgcatccggcgtgcatctttacatcggccgcccccggcggacgttcgtttggcgccgatgccggtggcgctcaagccttgggcgtgggcccgctcgaccatacgccattgcgttgggacccgttgacgggcgccgcgctcacccaggaaaacgccgttcgcgtggaaaagattgtcgcgcgcggggataatgacgagtaattgactcagctgatgtattcgactgatccacgtttcttttgaaaggccgcacatgagcgatagccagaagatgtccgatgaggtgcgcgcccacctgcgcgccattccttccgtcaacgagctgcttaccgagtggccggtggtgaaggcggcgggggagacctgcgacgcggtggcgcatgccgccgtcacggccgagctcgacgaggagcgcgccgcgattcgtgccggcgccgctccgcgttccaagcgcgagttagcctcggccattgagtggcgcgctcaccgttctgcgctgccgagcctgcgccccgccgtcaacgccacgggtgttgttatccataccaatctgggtcgagccccgctcgcggagtcggccgccaaggccgtggccgaggtcgcgcgcggctacagcacactcgagtacagcgtggacacctgttcgcgcgggtcgcgcaaggagcatgccgcgcagctgattcgctcgctcaccggtgccgaggacgcgctcgtggtcaacaacaacgccgccgcggtgctgctggtgctggcaacccatgccgcgggcaaagaggtcatagtcagccgcggcgagctcgtcgagatcggtggcagcttccgcatccccgacgtcatggcggcttcgggcaccaaactcgtcgaggtcggcgccaccaaccgcacgcacctggcagattatgagcaagccatcacacccgatacggccatgatcctcaaggttcatccttccaactatcgcatcgagggctttcacgaggaggtaggctctcgggagcttgccgccctggcccacaagcatggcctgctgttctacgaggaccaggggtcgggcgcgctgttgcccgacgacatcttggtgcgcggaggcgaagaaaccacgccggcttcggtcgcggcggggctcgatatcgtgtcatgctcgggcgataagctgctcggcgccgcgcaggcgggcattatcatgggtcgtcgcgacctggtccaggcctgcgggtcgcatccgcttatgcgtgccctgcgtccgggtaagcttgcactggcggcgctcgaggctacactgcgcatttacatggacggggcggatgtggcccatcgcgaggtgccggtactcaacatgctcacgcttccgcaggctcatctggagcgtcgcgcacgcaagttgcgcgatctgatggtggcgggcctcgataaggctggctgcccgtgcgccgttcaggtggagatcgtcgaggagtcgtcgactcccggtggcggctcgctgcctaccgtcgagttgcccaccatgtgcgttgccgtgcgtcttgtcgatgagcgtctttccgttgacgcactcaagcgctcgctcgtccaagatttcgacactccggtcgtcacacgaacctcgcacgatcgcattttgtttgacgtccgtacgctcgtgggcgaccgcgatatcgagacggcggcgtcgacgcttgccgcatgcgttgagaaggcgattgctcgatgagtgaggttcaagcgctggtggagtgtcccgttatcgttggcacggcgggccacgttgaccacggtaagtcggcgctgatcgaggcgctgaccggcaagaatcccgatcgtctggaggtcgagcgtcgtcgtggcatgacggtggagcttggctttggcgagctggcgctgccgagtggcaagatcgtgggcctggtcgacgtgcctgggcatgcgcactacctgcgcgccatggtgcagggtgccacgggcatcgacgttgccgtgttggtggtatcgggcgtcgagggcgtgatgccgcagacccgcgagcacgtgcacgtgctggagctgttgggcgtcacacacatggtggtcgcgctgacgatgtgcgacctggccgacgccgagatgaccgagctcgccgagctcgatgtcgatgactttttgtcgggtaccgtgtttgcggacgcgccgatcgtgcccgtgtcatccaagaccggcgcggggatcgatgacctgctggctgcgctcgacgagcaggttgccgcttgctgggattcctgccgcgaccgtgccgagcgcaccgatgccgcgccgcgtctgcccatcgaccgctgctttacgatcaagggcgccggtaccgtggtgacgggaacgttgcacgatgcgcccgtcgcggtgggggatgagctcgtcgcgttgccgtcgcgtacggtctgtcgcgtgcgcgggattcaggtgcatggcgatacgccgcgagcactgcccggacagcgcgtggcgctcaacttggtgggcgatggtgtcgccgcgctcgatcgcggtgagatgctgggcgtggcgggccactttggccagacgatgcgctttatgatgacgtttacgtatttgggtcgcgagggagctaagccgcgtgtgctcgagtcgggtgcgcgtgtgcacgtgatggcgggtacggctgaggttgtcggtcgcatcatgttcatggagggtgaggcccccatggcggtgggcgagacccgtatcgttcaggtgcgcttggaaaactcgctgccgctacgtgccggggaccatgccgtagtgctgtcctattcgcccgtgatgcttgttggcggcgggcgcgtgctgctttcgcgctgccgtcgctcgcgcgagctttctgaaggggagcgtgcgctgtatgcggcgctcgagtccggcaatatcgcgggcggtgtgggcgcttggctggcgctacagacgctgccggttacggcgattgatgttgccgcggcactggatcttgttgccggcgatgtcgacgctgcgttgcgcgagttggtggcgaagggcgctgctcgcgcgctagctggctcggatggctcgctgtatgcagatgcttccgcgctcgatgccgcgatgggtgcgctggcggcgaccctgtccgccatgcacgcggctgcccccaaggagacgggctttacgcccggcgccgtcgcccatgctgcgtggcctaccgctgatgatgccgttgccgcggcgttgattgccgagggctgcgcccgtggcgtgtgtgcctccgagggtgccgaggtgttcgacccgcactccgctgccgccgcggcgcgtgtggtgcgcgaggcctgtgaacgtatcgttgccttgctggacgaagccggcctcgatgcgccgacgttgccagaggtgggcgagcagttgcggctcgatcgcgacaccacgacgcgtgccctgcgcgagctttcgctcaaccgcgcgatcgttaaggtcgagcgcgacgttgccctgtctgctgctgccgaggcccatgcgcgtgagctcgtcgccgccgccattgaggcagccggcggcgccgccaccacgagcgtgctgcgcgaggcgctaggtgtgtcgcgcaaacgtgccatcagcatcttggagcacctggatgccgtgcgcttcacggtactcgacaaggatgccggcggcctgcgctcgctgcgctaggccggtcacccgcccccgcctcctcagttgcggtgaaatagttcctgttttcggcatctaacgccaaaccaggggcccgattttgcctcttgacaatgtcctgctcatattaaaaggaacgtccctaactgccggataaaaaacgagcgaggattttgaggtcctcgctcgtttttgttttaggtgatgcttcgaccgtgcggctacttgtcggcagcggtctttttggtagtcgacttcttcgcggtcgccttcttggcggcagtggctttcttagccgtcgtcttcttggccgtgctcgccttggtcgcagtcttgcggccgcgggcgggcttcttctccttggtcggacagtccatgttgacgcagatacgccacgggccgcgcgccgtgttgaccaccacgatgggggcgccgcactcggggcaggtctcacccgtcgcctcgagcttaccgcgcgccggtagaggatagctcacgccgcaatcgtcatagttggtgcagcggataaagcgcttgccgctcttctcgctcttgtgcgcgatcaggtcgccatggcgtccggcctcggcacacaccttgcactcgcccaccttaaggtcgggctcgtagttggtggggcatgtggggttcacgcaaatctcgaaggccttctggcggaacggctgacacttaatgcgcggcgcaccgcactcgggacacacggcggcctcgccctcgagcgggctcaccttgacgccactcggcaccggataggtcacgtcgcagtcgggccatcccatgcagccgataaagctgccgcgggtcttggcgctagtcttcataaccaggtccttgccgcacttgggacaggcgcccacgcgtgcatcggccgtgacggcgtcgctgatggcgtcgcccagctcctgcgtatgcttgagcagctcgtcgagcacgccggccagcagtgcgcgcgagtgcgtcacgacatgctcttcggtgtcctcgccgcgctcgacgcgggtcatgtcgccgtcgagctcgctggtcatatcggggctcgtgatgcgcggggcaaactgcgtcagcgcatcgatgatggcgatgcccagctgactcggctccacgggatcgtttttgaggtagcgcacggcgtacaggcgctcgatgatgctcgcgcgcgtggacttggtgcccaagccgcgcttctccatctcctgcacgagtttaccctggctgtagcgtgcgggcggctcggtctgctttgcctcgagcttaatgtcgaacacatcaaccgtatcgccctgctccagcggcggcatctgctcgtcgcgcttgagtccgtacgggtatgcctcgcggaaacccggggtcacgagcacatcgcccgaagccacgaacggctcaccgttcacgtcgagctcgagcttggtgttctcgatggtcgcgggacccataagcgtcgccaggaagcggcgggcgataagatcgtagagtttgcgttggccgccatcaagcgtggacggatcgccctcgcccgtggggtagataggcgggtggtcggtggtctcgaccttgccgcgcgcgggcttcatggggccggcgagcacctttttgcacacgggcgccagcgccgggttgatctttgccaggtcgctcaccacggcgcccagatcgagcgtcgcggggtacacggtgttgtcgacacgcgggtagctgatgaggcccgccatgtagagggactcggcgatgcgcatggtacgcgcaggcgagatgccctcggctgcggcggcagcctgcagcgaggtggtcgcaaacggcgtgggtggctgctgcttgcgtgagcgcttggtcaccgcggcgacggttgccgtcgtaacgccgtcgacatggccgtatgccgtctcggcagcatccttgtcggtaaagcgtgccgtcttgtgcgcaatcttaaagcggtcgtcctcggcagcaccctgcgcggcgcccatgccgcggatctgccaatagtcctcgggcacaaacgccatgcgctcgcgctcgcgctcgaccaccagggcaagcgtcggggtctgcacgcggccggcggaacgcacgttgccaaagccgccaaacttggcgagcgtcaggtagcgcgtgagcaccgcaccccaaatgaggtcgatgtgctggcggctctcgccggcgtcggccagattctggtcgagcgagacgagattatcgaaggcctgcgtgatctcggccttggtaaacgaagaatactgggcgcgggcgaccggcaagtccggcgcaacctcgcgcaccttgttgagggcgtccgaaccgatcagctcgccctcgcggtcgaagtccgtggcgatgatgacgctgtcggactttttagcgaggttcttgagcgaacgaatgagctccttctcggccggcagcttaatgacgggcgcccaggtgagataaggcaggctctcgagcttccagcccttgatggagataccgtcggcaaggaacggcttacgcttggtgtcgtagggcggacgagccaggccatcgggcatgtcggccggcaacatctcaccgtcctcggtgaccgaataccaacccagctttttatcgaacagcacgctgtcgcaaaaatcgggtgcaaggatgtgaccggcaagaccgatcgtcacgcactcctcgcccttccactcaaaacggtagatgacggtgttgtacaccttgtcctttttgggcttacccgtggacagccgctcggcgatctgacgcgcggcgtcgtttttctcggcgatgatgagcttcaaaagaggctcctatctcgtatctctgcggctacgcccgcccgtatggcggccgatttacgcccttgcttgctcaatctgcccgatgagccaatcgcaccaggcatccatgccctcgcccttgcgcgcgctcacggcaaaccgcggcgcctgcggattgaggtcatcgagtgtcttagtatacctatccatgtcaaaatcgaaagccggggccacgtcgaccttgttgagcagctgcgcgccggcgtgctggaagatgcccgggtacttaatgggcttgtcgtcgccctcgggcaccgagagaatcatgatggacaggttctcacccaggtcaaagtcgaccgggcagaccaggttgcccacgttttcgataaagatgacgtcgatgttctccagaccgacggcctggtcgaacgcgtcaacggcctccatgatcatgttgccctcgaggtggcacaggccacccgtgttgatctggatggcgggcatgccggcttccttcatggtgatggcgtcgacatccgaggcaatatcgccctcgatgacggcacagcgcaggccagccttgtcgcgcaggcgctcgttggtgcccaggatcgtggtggtcttgcccgaaccggggctcgacagcacattgatcacataggtgtttgtctctttgaatcgctgtcgcagctgatctgccaggcgttcgttgcgcgacagaatcggcgacgcgatatcaatcgttttctcagccatactcggcactccttactttggcccctttataccccatcaccagatggctagcgggctaatcgtcgggggtttcgatttcgatacttgcgatgtcgagctcgcggccgtgcagcagacgcacgttggcgccgccacattggggacagcggcaatggaagcgatcgtgctcaaagacctccccgcagtccagacactcgctttgtggatggacttcctccacggcaagctcgcagcctcgcgtgagcgggtcctcatcgcgaaatgtctcccacgcaaagtcgagcgcctcgcgcacaacttcggtcatatccccgatacgcagcgttaccaaaacggcgcgcgaggcccccgccccacgcgccgcgcgaatcactgtatcgagtatgccgttgacaatgccaacctcgtgcataccgatttactcctcgtcgtcctcgtcgtccgagaacaggtccagacggctcacgaacaggccctccttgccctcgcgcgcggtgatgaccacacgggcgacggcgagcgaaatctcgtagagcgagagcagggcgccgtacataaggcccagggtgacgggcgagccgtcgggcgtgatcacggccgaggccacgagcaggccaacgtacacatagcgccaggcgctgcggaaggcggcataggacacgatgtggaaaacggacaggtagaagatgatgagcggcagctcaaacgccacaccaaagccgatcataaagagcagctccatgttgatgtagtcctccagattgggcaacgccgtagcgacagccgaggtctcgccgatgagccactcaaagcctgccggaatgatgatgaagtagcagaagatagcgcccaggaagaacagcaccgtcgaggcgagcaccgtgggcacgacccatttgcgctcgttgggacgcagtgccggcaggaaaaatgccagaatctgccagatgatcatgggcgtgcacatgaccacggccatcttgatggccagcgagaagcgcaggccaaagccgccgagcgtggtggtgatgtaaaacttaccgtccggcacaaaggagcggatggggtctttcaagatgtcgagcaccacgggcgtggcgaaatacagcacgatggctgcggcaaacaccgacacaaccacgatggtcaggcggcgacgaagctctcccaggtggtcgaagagcggcatacgcgcaggtccgataggcattactcatcgcctcccttcggggcgtcgccggcagcggcttcgtcctcggcctcgagctcgcgagcgagctggtcgacgacggccttacgtttgcggggacgacgggcgtagaggtcagccgtcgtgggctctgccggctcgggctcgggctctgcagcaggctcgggctcgacggcagcagcaggctctgtaccctcggcctcatcaacagcgccttcgccctcagcagcaccctcgcttgcggccttctcggcagcaagacgggcgcgacgctcggcaaaggtctccttcttggcgggcgctgccgtctcggcggcatcctcgtccacatcggaatcgtcgtcggtcgcagcagtcttcttgggcttgaccggggccgacgcggcctcgctcaccggatcgataatctcggactgaacaacggccgtcatcttttcctgcgtctcgcggaactgacggatggcacggccgatcgtgcggcccatctgcgggagcttatccgggccaaacagcaaaaagccgaagaccacgatgatcgcgagctcaccctctccaataccaaacacacatacctccaaggctcgatgtgagtcgagcccgcaccgcgccattcggccggaactcgtctattcattcggtcaagtatagcgcccggacgccaaaacgtccgagcgcatcacaaacatatgccaaacggcacgcccttttgggggcaaagattatgcagcggtgatcgaaatctcctggtcgacgcccaacagctgaaccacgcgcatcaccgggggctgcacgttgacgcagctaaaacgcttaccatgatcagctgcgtggtgtgcggcgcccacaagcacgccaatgcctgtcgaatcgatgtagctcacctgggcaaaatcgagctcaacggcctcagtgggctgctcgagcgccaggtcgatggcattgcgcaggctatcggcgttagagatatcgatctcaccggtcaccttaatggtgtagagctctggcgtggggttggtggaaatacccaaatccatgtatacgctcctttacgtatcgaaagtgcggatagtactaggcgcggacttgcggggccctacgcgctaggcgcgctcggtacgcgcaagctcggcagcgacgagcttgacagccagcaccagcacatcgagcgcagcctccaggtcctcgaccgtgggatagctcggcgcgatgcggatgttggtgtcgcgcggatccttgccataaggccaggtggcaccagccggcgtgagcttgacgcccaggtcggcacaaagcgcggcgaccttctgggcagagccctcgggaccatcgaagctcacgaagtaaccgccgcgggggtgcgtccaagtggcgcaacccgtgttgcccaagccctcggtgagtttacgctcaacggcctcaaagcgcgggcgcaggaactcggcatgctttttcatgtgctccttgaccgcctcgatggtgggaaggaaacgcacgtgacgcagctggttgagcttgtcggcgctaataagaccggccttcaggcgcttggagaactcggcgatgaccgcggggctcgcaccgataaagccgatgccagcgcccgggaaggtgatcttggacgtcgatgcaaaggccaccacgcgatcctcggtacccgccgtgcgggcaagatcgaagatgttggcgagctcgtcggtctcgtcgtacaggtcgtgcacgcagtaagcgttgtcccagaagatgcggaaatcgggcgcggccgtgggcatctcgaccaagcggcgcacagtgtcctcgctaaaggtgatgcccgtggggttggaatacttgggcacgcaccagatacccttgatggaatcgtcggcggcaaccaggcgctcgatctcgtccatgtcggggccgttgtcggtcatcgcgacggggacgttctcgatgcccagatcggcggtgatgccaaagtggcgatcgtagccgggaacagggcacaggaacttgaccttcttgccgtcgtgcgctgcctcgtaagcctcccaagggtcgctgccgcacgagccgcaacgccagaacataccggcgatatcgtgctcgatcagcaggctcgatgagcccagtacgagcgtctgctcggcaggacaacccaggaactcccccgccagcttgcgtgccgagggaatgccctcaaagcagccgtagttggagcagtcgacgttgccgtcatgcagatcggcatcggcattgaggatatcgagcatggggcgagagatgtccacctgggagggcgacggcttgccgcgggccatgtcgagcgccaggcccttggccttgacctcggcgacctcggctttgagcgcctcgatggcggcatcgagttcggtggtttccatcttctggtagatcgtctgcatggggtgcgacctttcgcgaagcggtacgttgcagttcgtctaagtatagaccgccatcgtcgcaacgttatgaagccgtgatagattaagttcatcgcaatcaattacgaatcgccgcgcatgccggcgtggggcgcccaaggaggcactatggagtacggatcgtttcaggccgaggaattcggcgacttgcagcgcctggtcgacggactgttttacgaccgccacgccatcgaccgcctggatctgatcgtacaggccgaaatcttggacctggcgcccgacctcatggaaatcgtgaaccttttgccgcccggctactacgaccgccagtcactgtgtgatcagctcaactccgccttggccgcccacggctggggcgccgtctacggaaccgtggaataagcctcgaggccggcgatttggcccgcttcccgaccttggcgaggcttgttttagggcttgtggccaaaaaagggcaaatatgagtactgttacctttttagtagcagcgattcttggtcgaaatcggcaaaactcgacttgaaacttcctaatcaccgtcagctagcgccaaattggaagtcgatggtcactcgttaacgtacagataacaagattgtgttcattattttccacacctaaaatgaaacgccgtttgtgacagtactcacaaacggcgttttttgaccactggggtgtctggcaggcggcaaacaccgcccgaatccgcattttgaacgcgcctaaaccggttctggagccggttttgtgctcttactcgtttttgggcgcggggtgtttgcagaccacgctcatgtagatcatgccgagcacggcggcggtgaccgaaccggcaaggatggcggccttggcagccagaacctcgaactgagccgtcgggaaggcgaggccgctgatgagaatcgacatggtaaagccgatgccgcccagaatgcccacaccggcgatcatgtgccagttgacgttatgcggcagctcgcaggccttgagcttgaccagggcaaacgtcatgccaaagatgccaatcggcttacccagcagcatgccaaagtacacgccaagcgtcaccgggtcggtcagcaacgtgctcatgtccacgcccaccaggcgaacctgcgcgttgacgaacgcgaagatcggcaggatcacaaagttaaccggcgtggagatcaggcgctccatacggatgagcggcggggtcacgcggtgcatgacgcgctcgaccttggtggtcgagacggtaaagtcgtgctggcccaagatgtgcgcctcatcgtcgtagcggtcgtcgagcagcggcaggcactcgcccagccaatcggtgaggctgtcgagcttgacgccgcacttggccgggatggtaaaggccaggatgacgccggcgagcgtagcatgcacgccgctcttgaacatgcagaaccacagcagcaggcccagcaccgtatacggagccaagcggtagtgctgagtcttgttgagccacacgagtgcgcaggtcacaaccgcggcggcgcccaaccaaaacgggttggggctctgaccataaaagatggcgatggcggcgatggagatcaggtcgtcggcgatggcgagcgtcgagaagaacacgcgcacgccgttaggcacgcggttgcctaagagcgacagcacacccagcgcaaaggcgatatcagttgccatgggaatggcccagccgttatgcgcgccggcatggttaaagatgaggtagatgcaggcgggaacgacgacgccgcccacggctgccagcatggggagcatggcctggcgcgggttcttgagctcgccgaccgtcatctcgtacttaagctcaatgcccaccagcaaaaagaagatcgccatgaggaagtcgttgacgaaaagctcaacggtcaggccggccgtaaaatgccccaggcccacatacagcggagtctccaaaaagtgatggatggcctcgtaggcatcggtgttggcgcagataacggcggcgatggcggcaaacaccatgacggcggccgaaatcgtgccgttctcggcgatgcgctcccaaatgtcgtgacgctcaaaacgcttgcgctcacggacgttgaacagctgctcgggtgctgccatgggcggctcctttcacgggaaagctcccgtcttaaaaaagcacggcccgcccaagtggcggcgccgcgctctaacgtattacgcttgcatctagcctaccctgcacgacaagcacgcaggcgcggccgaaaagcggaaccacaggttgaacattatttgctcaacggcacgggcacgcctgtccaagagacgacgcggcgccgtgcacaaaaaacgaccggagcgcggggcgtccgcgatccggtcatcggtgttaggtcaaaagaacctagcaggcggccatgatgggggcagcgacctgcttcttacgggagaggacacccggcatccagacgccgtcgtgctcgtcggcaatgcccaggcccttctgagcggcctcggtctcgccctcgagcaggacctgcgagccctcctccatgatgtcggtgatgcacaggacgatgccgtcggcacccttctcggcggcgtaggcgcgcatggcctcgcgaatctcgtcgatcatgccgagcgcgcggctcttgtcgacggtctcgtactggccgatgagcagcttcttgccggcgggctcgaacatcttgatgtcgttgccgaccatctcggctgcggtgaaggagccggacggacgggtgaggaagacctccatgccaaacttgaccgggtcgacgcccacctgctcgccgagcttggcggcgacggcgcggtcgacatcggtggtggtggggctcttgagcatgagcgtgtcggtcatcatggccgagagcagcagcttggcctggacgtcggaaagctcaacgccgagcacgccggcgagcttggtgacgatggtgcagctggagccccagggcaggcagatgtagtgcagcgggccggcggtctcgaagtcgccgatgcggtgatgatcgacgacgccaaagaccgtggcgtccttaaggccggcgacggactgggcagactcgttgtggtcggtgaggacgacgagctgaccggcctcgacggaatcaatcacgcggggctcggcgatgccggcgtcggcgagcagcttggcggactcggccggaagctggcccagagcgcaagcctcgtaggtgttgccggcatactcaacctggttgagcagctgggacaggacgacggcgctcatgatggcgtcgttatcggggttctggtgaccaaagacaagaacgtttgccatgggtttcctccacttgatatgtgtacttggacgtagctatggtagcacgccgatgccgagccttcgcagacggaagggccacggcatattttggggcaggcacgggggccaaggctgtcccttttacgccatgttggtgcaaagtaacctgtcccctttgcgccaacgagcgaacttatttaccggcggcgcgcagggctacgtaggcggcgccgatgatgccggcgtcgttgccgagcgaagcgaccttgatgggcgtctcgcgtgaggcggaaagcgcgtagcgctggaagtgctcgcgaactgcgtcgaggtagacatcggccgaggcggacgcaccgccgccgatcaggaacatctcggggtcgaccacgttggcaataagcgccagggcgcggccgaggtagtcggccatggtatcggcagctgccaacgcgagcttgtcaccctcgcggcaggcctggaacacgtccttggaatcggaggggccggtgagctcaatgggctcgacgcccgctttcttgcactcagcaaggtagttgctcaccacgccggtggcgctggaatactgctccagatggccatggccgccacagccgcaggtgcgctcctcagccgggttcaggcacatgtggccaatctcgccgccggcgcccacaacgcccgataccacgtcgccgttgatgatgacgccgccgcccacgccggtaccgatggtgaccatcaccacgttctgcacgcccttggcagaaccgagccaggcctcgcccatggcagcggcgttggcgtcgttctcgtacttaacgaccgcgtcggggcagtgcttttgaatggcgatcctcagctcgggcaggttaatggcaatgttggccttgaccttggcatcgcccgatgccgggatggggcacggaacggccaggccaatacccgccacaaaggcacgcggaatctgggctttggcgaccacctggtcgatagcctcggtcaccgcggcaaagcccgcagcgtcaacgatgggaggcgtaggcacgctggccttggcaagcaggttaccgtcttcgtcgaacaggccctccttaaccgaagtgccgccgacgtcaatgccgatgtaatactgcttaggttccatgggagcccacctttctcgtttaaacattgcctgtatggtaccgctctcaagacaaaaacccgccaaaaagggacaggtttgttttggcaggttttatctggggaaacgtccccccgctcaacgagcaatgacgctcagcaactcgccaaacaaaaagcgccgggagagggagactcccggcgcctgcaaaagggactggattgtatgcgaaccgcacgatccgtcgcggcgaaaacgccagctaggccttgagtgcctgtagctgtttgtggacctcaatgagctccgtggccatgacgcgcatggtctcggtgccggccatctggtcctcggcgtgcagcagaatcagcggggcctcgccgttgcgctcgccattggcctccttcttaagaagtcccatgtgaacatcgtggccgccgttataggcctcgtcgccctgcttaatgagctcctcggcggcgtcgaaatcgccctccttggccttctgcacggcgttgatgtacatgctcttggcggtaccgacgtagctgatgatctcgaagcaggtcatctgcagttcgttcatatcctccatgcgctgcacctagcccatcacgctgacgcagtggtcgatgatgccggcggcgttcatgcggccatagtcgaccatgttgatgacctcgaccgggaaacggccggcggcctccttctcaaagtcgcccttggtgtagccgatctgcgggccgagcagcaggatgtcgcactcgtccaggtgatcgtgggcctcattcataggacgggcttcgacctcgatgtccagaccacggctcgcgacctcggactgcatcttctggaccagcagactcgtggacatgccggcattgcagcaaagcatgatcttcttcatggtttcctccttataactgcgcggcgcgcagacgacaaactggataaatccttgtggttatctttcccctgttttgcacgtttaggcaaaaaaggagatacgggtaccggtaccaagcatcggtacccgcaagggtggaatggacaaacgctaggcgttctgctcggcgagagcctcctgcttggcaagagccttctcggagatcttcatgaagggcaggtagacggccatgccgatcacgagctcgagagcctgccacacgccggcgcgccagtcaaagcccgtagcgagcagggcgttgatgacgggaggcatggtccaaggcacctgagcgatgcaggggctgatgatgccagcacaggtcaggccataggtgacgccgatgaacagatcgggaagaagaacgaacgggatcatgagcggcaggttgtacacgatggggtaaccgtagatgaccggctcgttaatgttgaacagaccaggcaggatagccatggaggcaacggtcttggaagccttgttcttggagaacaggaaggtgtcgagcaggagcatgagggtgcagcccgagccgccgatgagggcgaagctgttgacgatctgcatgttcatgtagtggtcgggctggatgacaccgccggcggcataggtagccatgttgtcgacgatgagcatggtcaggatcggctcaacggtagcgccagagatggtggactggtgaataccgacgcagaacagcaggttcgcgagggtgtagatgaggataacagcccacggaccggcgttcatgatgctcttgagcgggttagagatgcaggtggagatgatggtgcacagatcggtgccggcgcagacggcaagcagggccgcggcaacagcgaagaccgagaggttgagcagcatcgggatcatgacgttgaaggagttggagaccgcaggaggcacgccctcgcccagcttgaccttgagcttctcgacgcccgagatcttgatgaagagcgtcgtggaaagcagggcgatgatgatggcagagaacagaccgttggtgccggtgttggcagtcgaaagggcgccggtgacctcggcggaggtgatcttgtcggtgagcagcgggctcgtggcggcaagggtggcggtgatctgctgcggcatcatgatgacgaaggcagagatggcgacgaccacgcaggcaagcgggttatcgaagcgctcgttcttggcgaggctgtagccaatcagacccgccaagataatggcggacacgttgagggtgcccagggtaattgccgagccccaagtctggaggttggcaagacccgccgcatcgagcgggaacagagggaacacgacgttgttgatgagaaccgcgatacccgcaaggatatagagcggcgtgatggtcgcgaaggcatcgcgcagggaacgcaggtgaacctggtttcctaccttcgcagagacctcggcaaacttgtcgaggaagctctttccgttgtcactggccatgattgctcctaactttcaaatccggccttttcctatgcgcacggtggtctgtcgccctctgccaccagatgtgccattgtttttgcgcgtttgcgcaggggctgagcgcccgttttggggttgaacgctcggtcgctagtccaccacgtgggtcgtggcaacctgcttgagccaagcagccgacttcttaagacggcgctggtagccgtccatcaggtcgacctcgacaaagccataacggttcttgaaggcgtttgaccaggaccagttgtcgatgacggcccagtagtggtagccgcggcacttggccccctcgccgatagccttggcgacccactcaaggtgctggcgcacaaaatcgacgcgatagtcgtcctggatggtcccctcggcgtcacggttcttgtactcgtccatgatgccgataccgttctcggaaacgaaccactcaagatcgggatagttcttggcgcagtccatgccaaagtcgtagaggcccttcgggtagatctcccagccgcggctcttgttcatgacggcgtcgggccacacgtactcgtcggcaaagtgcggcagaccgtactggtcgatcttgctcgccggcgcctggacgcgcgtggggtggtagtagttgcagccgagccagtcaacgatgccctgcttgagaatctcctggtcgccggcgcggaacggaagcttgacgccgccctcggccaggctgtcgagcacatcggcgggaagctcgcccttggtaataaggtcgagccaccagcggttgttgatgccgctggtcatgcgcacggcctcgagatctgcctcgctggggttctccttggtgtagaccggggtgaagcagttgatcatgccgattttggcatcggcgcgaatgacaccctcgtcatatgccttgcgatagttggccacggccagcgcatgtgccagcgaaatgtggtactgcacggtgcgagcgcggttgaagtcgtgaagctgcgggaaccacacgccctcctggtagcgctgctcgggctcgacgatgggctcgttaaaggtgaaccaatacttgatctcctggccgaactcgcggaaagcgacgtcggcgtagtgtgcgtaggcctcgacgacctcgcggctctcccaaccaccacggttaaagaggtaggtgggcatgtcaaagtggtacaagttgacaaacggctccaagccggcttcgcgagaggcgcggaacaactcgtgataccacgcggcaccttcctcgttgaggttgccgtcggcatcgagcagacggctccactggatggaagtgcgataggtatccagacccaagtccttcaaaatgcgaaggtcttcctggtacttggccataaagtcattgccggcgtaagagccaacgcggttgtagaacgaacccagatcctggatggaccaggtgtcccacaggttctcgagcttgccgccctggttccactgaccctcagtctgcgggccggacatagcagcgccaaagaagaagtcgttgggcagctgatactgtgccatcaaagtcctcgctttcgtgttctagagcttccggttggagacgggcttgctttggcaggttatccggcgcgggcgcgcaccggccataccgatatccaacccgccaaaacaaaaccgtccccaaacggtcgatcctgttgtgcggaaggattccgttcgttgcttaaactatagcgctctaattttaaaagtaaagcgtctttttcttttttctttctcgaacttcttagataaaagtaatatggatgccctgttgagggttatacttactttttgtattcatatatgtcgggaaggaggttccatgattcccaaatacgaggcgatagctgcagatatccgtcgaagcatcgaggacggcgctcttaaaccgggcgacaagctacccaccgtcgttgagttctgcgagctctatagcgtttccaaaatcaccgtcaaacgagctatcgagcagatcaccgaggagggccttgtcaccagccggcgcggatcgggcacctacgttaaggacacggcgggtctccccgaccaggcatttttccagggcaagaatgaccgcgcccagggtttttcgtatgagcaccgcggggagaaggtgacctcggtagtctacgatttctcgattgtcaatccaccagcggacgtcgctactcagctgggaattgccgaggacgactttgcctatcacatcgtgcgcgtgcgccaggtcgacgagaagcccatcgtcatcgagtacacctacatgcctctcgagctgataccgggccttaaaaagaaggacctatacggatcggtctatagctttatccgcgagcagtgcggactcaagatctcgagtttccaccgcaccattcgcgctgtcgcggcaactgaagaagaggctgagcgcctggataccaaacccggctctcccctgctcgaactcaaccagattggctttttggatagcggcaacgcctttgagtactcgatttcgcgcaacgtcggcgaccgctttgagctgcacaacgtaacgctggcctagttttgtaatccggtgggtgctcgttttgagctgtcttacgcggcacccgcacaaccttatgggagtatgcacatgtccgatttgattaaactcacgccgatcttccacgagaagatctggggcggtcgccagctggagaccgtatttggttacgacattcccgagggtcccatcggtgagtgttgggctatctcggcccaccccaacggcgactgccagatcgcggagggcccgtacgccggtcacacgctttcgtggctgtgggccgagcaccgcgagctctttggtaactgcgagggcaaggagttcccgctgctcattaagattctagacgccaaggacgacctttcgatccagatccatcccaatgacgagtacgccgccgagcacgagaacggcagcctgggcaaaaccgagtgctggtatgtactggactgcgagcccggcgccacgatcatcgtcggacagcgcgcgcacgaccgcgccgaggccgcgcgtatgatcgaggacggccgctgggacgacatgctcaacgtgctgccgattcacaagggcgactttttccagattgattccggtaccgtccacgccatcaagaccggcacgctcattttggagacgcagcagtcgagcgacgtgacatatcgcctgtacgactacgaccgccctggcaccgacggcaagctacgcccacttcacattgagcagagcctcgactgcatcgactttgatgttcaggctccgaccgacggcaccgtgtccgcgcccgaggtcgacggcgtgaccgagctcgagtccaacccctgctacaccgtcgatcgcgtgcgcgtcgacggcagcaagaccctcaaccagcgctggcccttcatgtgcctgtcggtcatcgacggcaaaggcaccgtctgcggcgaccccgtccacaaaggcagccacctactggctccgtccactgtcagctccatcgacctcgaaggcaagatggaactgatcatcagccacctgtaatcgctcaatccccgagcgctcgccggcgcggggcgcggggtttggtcgcctgctcgagcagtcctgactcgcacggagagcacattaagtgctctccggctcgtgcggaactcccgattgcccgtacctcatcctcgatgaaccgctgaacggcctcgatccgggaaaacggaaaacctcctgcgacgcgatgcgcagcgaagtggcgcggggacgcagcgtgctcatttcaagccatctactcgacgacctggcagacctcaccaactcgttctacttcatcgaagccggcacgctcgtggaaaagatcaagtcgtcctcgcagacgctcaagcaggaatacctcgatacatacgagcgaggtgaatgacatgaaaccatttgaacagctgaagtccaatgcgtcgcgcatggctgtctacgccatcctcgtggcaacggctttatgcggaatcgcggcacccgtctatgcgctcaacggaaagaaaggcgatgtcgagcctctgtacatgagctcgacggttaaggaccggtacaaagccttctctggagacgcgttttacgtagcagagtacgacacgacctaccgtgagcttcgctacaacaagagatacgaatatctaggcgcaaaagcaatcagctatacatcgggttggtacggctcccactatggacacataacccagttcaagtgtaactaccgtgtgtacaactaaagcaacccggccgggacgaggggtgacgcaaaagcgtcgcccctcgtttttaaccatgtcaactgaacctggttcaggcttcaatgcaagaagaagcaggccgaggtccagatttcggacaagaagagggcgctcgcgcgcgaggcacacaaccacgcgctcatggtcgccggcgggctcatcgtgaaccacgcgccgggcggcaactggaaacgcatcgactgggacaggcttgcggcgtgaatcgaccgctacggatacaaaatcaccggctccacgcagcacggaatctggatccgtaacctttcgtagcccagatcaaaataccggttgtttcaagaaatcctctaggaagcgtctagatagaggatttctggaaatgcaaataacaataatttagcttccgagcgtatcgaccggagcaacaacgatgccttcgctagttacgtgagccggcataccaaacccgatgacgatgagtttcgccgcaggcggcctctccccgcgatcgaccagctttcgctcaagtcgaagcagattttccactgcctctgggacttgggggctcccgagcttaacctcaacggcaacccacgagccgtcacgacgatggacaatcgcgtcgacctctaggtcgtcagcatcgtggtagtgagatacggtcgcatcgctggccgccgcgtaaaccttgagatcgtgcagcacaagggattcgaagagcaagccaagggtcttcggatcggatgacaacgactccggatccgcaccgatgagggcgacggcgagcgatgggtcagcaaggtgccgcttcgcgccctgccgcaacttcaccggcgacctgagagccggatgccacgcggggacatcgtcgacgatattgatacggcgcagcgcgtccatgtaactggtaatcgtattctttgagacgtcaacacccaaatccctttcgatggacctcatgccggcaagagtcgattcattgcgtgcaagcgacgagagcaaggcccttaccttaaccgggtcgcgtttcactccatccgccctcgaaacgtcagactcgcaaacaccgtcaatataggcggcggctatccgcattgcgtcggcagttgtcttaccgaccgcttggggccaaccgccgcggcagagcaaatcagcgataccggcgataccgtcgatggatccgagtgacgccgcaacggaatcgccatcgagcagcgcaccaagcgagaccgctcccgacgaaataccgagctcgaaaagcgtcatggtatccatccgcaaacgggcgattcgacccacaccgctgtgcatcggctggttctcggctcgcggcgtcgcagatccggtgagaatgaactgtcctggctcccctcccctgacatcgcattcgaatcgcacggcatcccatagcttcggttcttcctgccattcgtcgacaagcctcggggtcggtccgacaattgcttgggccggatcgagacgagcgagttggagggccgcaaaaccgccagatgggtcggagagagataacgatgactcggcaaatctctgagctgtcgttgtctttccacaccatttcggcccctgaatgagcactgcaccaaaaatgccaaggtcgcgctcgaccaagcagtcaacacaacgtcctatatacctatccatcggctttccctccaatcattcatttgaaattatagcgtctatctgcgtcgttgggacaaataacgattacttattgggacgattgacggtaatttattgggacgattgacgatagctcgttgggacgatttccattttcttaaggcgctaatcaacgagacccactgtgaactatgagacggataaatttagctgacgcctctcatgagttcagcaatgctgatttgaaatccatcggcaatcttcttgagatttgagaggctgacattacgccgcccgacttcaatgctcgcgtagtaggaacgatccatttcaatcaaattggcgaactgctcctggctgcacccgagtccagcgcggagctctttgcatctcatgccgaatgatttctgaagcgtcttcgtatccatgacaaaaagagtcatggattgttgtataaaagcaaacggactatatacaacaatcccagttaatgcgcataattatctctattggaaagcactctgatgcccagtcggatagggcacggaaaaggaatggaacagcacaatgactcagggaaatcacttcgccgcactgccaaacaaaaagattcacactccgaaggggatcgcgcgtctgaccgtcaccgcggcgaccatggccgccatgaccggatcgagcctcatctcaccgttcacggcattcgcccagaccggtgacgggggcacacagcaccccgccgtgatgtcgccgatcgccgcccacgccggcgcggcatccggtaccggcgcgaaatccgccgcacagaccatcgcggacctgcagaaggcagtcaacgaggcgaaggcgaaggaggacgccgccaaggcagcctacgatgaggccgccggtccctacaacgaggcggcttccgcccgcgaccaggccaaggcatcctacgattctgcagtcagcgccggcacggcagccgaccgagcggcaatggacgagtacgcccgtcaggtcgcagagggcaaggacgccgccgatgccgccggcaaggacctcgagcaggcgaaggcgggtctcgcagacgccaaggcggatgcgtccgagaaggacgaagcgtaccagtccgccctcaaggcggctcaggatgccaagaatgccttcgataaagccaaggcagatgctgtaagcgccaccccggaggcaatcagtgccgccgagcaggccgtgcgcgacgcccaagatgccgtgagcagggcacaggccgacctcgccaacgccaacgcgacgcttgccgatgcccagtccaagctggttgcggcccagtctgcaaaggattccgcagataccgtcctcgccgcagcccagcagaacaaggacacggcggatgcgaaggccgcagccgccagcgccgcctacgagcaggcgaaagccgacctcgccgcagcggaggccggtgccagcggtccggagtacgatgcggcaaaacagaaggtcgcggacgcagaggcaaccctcgccgccgcacaagcggcacagtcccagtgcgagtccgagctcgagcaggtgcagtccgccgcggcaacggcacagaccgagctaaatgatgcccaggcatccctctctgcgaagcagcaggccgcggtcgatgccgcgtccggcgtgaacgacgcccagtccgcactcgatgccgcgaactccgacctcgatgcggccaagcaggcgaacgccgatgccatcgccaagctggacgccgcgaagcaggctgtcaaggacgctgagtccgccaaggcagccgccgacgaagagcttgcgaacgccaagaccgcaaaggataccgcagacgccgccgtgaccgccgcgcagcagaaggtcgacgaggcacaggcgaaactcgattccgccgacgcgcaactcaagcagggagccatcggcttcttccgtgccatgggtgccgatgacgcagtcaacatcatcctgaacgccaaatatgtcggaaagaccgaagtcggcaactccaaggacgccacgtcccttgataacatgctcaatgcgatcaggtggatgaagtccgtcaacgactaccgcaagtcggtcggcctgtccgagctccaggtcacctacaagctcatcgccggagccattgcggatgccaactacagtgacactgtgctcgatcatgcccgtcaatatgattttgccgaaaacctggcatggaattacggaatcgatccgagtgggcagtggatcgagcaggagaagggctttttcgacaaggcaacggaggccctttatggagtcaccggtcttgtcggcaaggatgcctatgatttctatgcaaagaacggtgtcgcaatcaaccattggattgcagacaactgccactgggagaacggcagtagcggcaccgtcggccattacatgaacatcatcaatcccgaactcgccgttatgggaatggcaacctgcaccaagggcaccatgtccgggcttcagacgcagtgctacaccgcagagatctccggctggtccggctccggttggaacacgaaccccatctccgtcgacgagtacgagcaaaagctgacctcctatatcaacggcctcaagaacgccaagagcgcactcgacgtagccaaggccgatctcgcatccaagcagcaggcagccgccggcgccgccgcaaccgtccagcagaagcaggacgcagcggatttcgcacaggcagacgtcgatgccgcgaagcaggacgtcaccgatgcccagcgtgccgtcgatgccgccaaggctgatgtcgccgccaagcagcagggcgtcaccgatgcccagaccgagcttgatgcggcgaaatcggacctcgatgccgccaacgcggcagtcgatacggcaaagtcgaccgtccagcagaagcaggttgcttttgatgctgccaacgcagccgtaacgaccgtacaatctaagttggatgccgcaaaggccgacacctctgccaagcagcagagcgttgccgatgcgaacgccgatctcgcgaagttcttccaggacgtcgccgacgccaagaaggcgctcgatacagcaaagagcgtccatgactcggcggtagccgatcagaccgagaaagcgaccgtcctcgccgccgccgagcaaaaggcggacgccaccgcacgcgccctcgcggatgcccagcgtgccgtcgatgccgcaaagaccgacaccggcgttgccgccgacaggcttaccggctcccagaccgatctcgatgacgcacagtcgaacctcgacatcctcaccggtcttgccgcgaagctcgcagaggcacagcagcgcgagcaggatgcagtaaaggccgtcaatgacaccaaggccgccctcgatgccgcgaaggcggataccgccgccgccgagtccctggtctccgccgccgaacaggcgaaggcgctggcagacgccaagctgtcgaagctgaactccatcgatgccggcgcggcgatcgcttccggccatgatgtgaacgcggatgacgccctcaacgcgcttttcgccgcagcagtcgaggcacgtgccaaggtcgcgcccgccaaggccatcctggacgagaagcaggccgcggtggacgagctccagcccggctacgatgcgacactcaccgcctacgagttggcgaagtccgaccgcatcgcaacggagcagaagctttccgatgagatcgcacgacaggaggcagaggaggtcgcaaagcagcaggcggcatacaccccgaagcacctcgccggcacggataccgctaagcccggcagcctcgcccagaccggtgaccgcgcgggactcatcggcgagacgttcgtcatcggcggtaccgtcctcgtggcagccggcgtattcctcgatcaaaagaagcgccgcgagcagatgtagtgcaaatcgcataacgactcggaaaggggaatcccgcaaaagggattcccctttttcgtctcgccagccacggttcgttgaggcagcttcagattaagggccacagattaaaccgatctacaactgtgaccatatgactgtgcgcacatgttagcatagtcatatggtcacctatttgcagctgcgattatgctgcgacaactcaaccgttagcgcttattaaacagccgaccaaatcctggtttgcccagtgtctggcgcatctgccccacctgaatctccgtctccacgccatccttgccgaagacgttgctcatatttttagcagtcgggatgaccgtcttcacctcacccgtcgttaggtcgaagcgctggcagccgacctggttctcaagatggatctgaccatcggatccaaagacattctggtacatgtctgcctcctcgcaagaaactgtcgatcccaagataacagacgggcgaatccggcgcagcagacgctcgataatacatgaccatgttaatgtagtcatatgctcacgtattacaagctgggaccttatgtattagagctcgaaccgcgccgccgcgtcaccatgaacaccgacggcgagaacatcgactacttcaaggcggaggccgcccgcacggacgccccctatcaggtcatcatcaacatgtacctgacggagtcccgcatgcagaagaggcacctcgcggtcgcgtaatacaaataggtaagatcccacgcgtgtcacgcctcgccgcaatcggagcgccgtctgcggcgcggggcggaataagaccgggcgacccgggcaatctggtcccggctctcccggtcgtattcctacgatatcgcccctaaatcaccaatgcgtcagacaaagaatgaggcaatggctatgaccacgcatacggcagatgcagcgactgcgcctttcttcctctcctttagtccgacgaatagggttgccgtaaagtaaagggcggaaatgccaactgaggaggggacgggtggatggtggggtagcttaaagagccccgtcccataatgactactttggcttattcgatgtccatgctggcgactaggttgatgttggtgtctaggaggttggggaggaccacgtcgcccatgcggatgggggcgttgacgactagacctcggatgaggtccatggcttgggcgtggagtgccagcgggatggcatcggcggtgcgcacgggcagcagggcctcatcgccgccggatacggccacggtcgtcgtgagcacgcgcatggggcaggtgagctcctgatgcgcgaacttatcgccacgcggacagctgttgccgattacggagcgcacctctaccacggcgccgtctgcgctgcgctcgacctccacggtcaggaggcactcggatgggcaggtggtgcagttgaactgcagcgtttcaatcgcgtttgtgctcatgactctacccctcctcaacggggtcgacggacaggacaatctcgttaacacccaggtcgagtgcgcgctgaattacctttaccggtagtgggaagctctccattacgctcggtttaaacgggcggaccttgcctgcaaacatctcctcgtcgcctgccagaatgcgcacgcgggcggcgtcgaccggccggcgcacgcggaagctgagcttggtgagcgccacggccgtaatgcgtcccggcagcgcgtatcccgcaatgccggcaggggagacggtgagctcgcagtccgcagcgacgcccgcgccggtttccagcgcgtgcgccgctgcagctgcgccagccctctcggactcggtcgtcacgttgtcggccaggtcgtgcacgtgcagcacgttgccgcaggcaaagatgcctggtacgcccgtctgcaggctctggtccaccacggcgcctcgcgtgcgcgggtcaagctctacacccgcggcaaccgaaagctcgttctcgggaatcaatcccaccgaaagcagcagtgtgtcacacggaacaacgcgctcggtccccggaatgggcgctaggcgctcgtcgacctggctcacctcgacggcttccacgcggtcgtgcccgatcacgcgcgtgacggtggtggacaggtgcagcggaatgccaaagtcgtccaggcagttcttaacattgcggcgcagaccgttggcgtacggcataagctcgtacacgccctcgacggaaatcccctcgagcgtgcagcggcgtgccatgatgagcccgatgtcacccgagcccaaaatgacggcgcgcgagccgggtttgaggttctcgatattgatgtatcgctgcgccaggccggccgtaaacacgccggcgggtcggctgccgggaatcttgatctcgctacgggtgcgctcgcggcaacccatggcaaggacgaccgcgcgcccggtgagccgcagcataccggtggggctcatgagcatgacggtgtgggcttcgacgtcgctcgcgcatggagcgtccgagcccctgtcaatcccgatcaccatgctgtccaagaacagcgcaatgtcggtttcgcgcacctggtcgataaaccgctgcgcgtattcggggccggtgagctcctgtttaaagtgcgacagaccaaacccggggtggatgcactggcggaggatgccgcccaggtgctgctcgcgctccacgatggccacgcgtgcgcccgccttatgcgcggccatcgcggccgccatgccggcaggtccgccgccgataacgaccacgtcgaaggcctgcgtttgcacgggcgctgcagctccgacctctgcgcgtccgtcgcgcatatcaaacgtcgccatcctagcgcacccccttcagcggaccctcgaccagccaagatccggcatcctccaacagcacctcgctggggtcgcagctcaactcgcgcgctaggattgccaccacacggctctggcaaaagccactttggcaccgacccatgccggcgcggcagcggcgcttgacgccctccaccgaaaccgcgcccggctggcgtcggatcgcggccacgatctcggcttcgggcaccgtctcgcagcggcagacaatctgtccccacgcgggatcggactcgatcagctcttccttgcacgccagcggtgcgcggtcaaagtcgtccggcgcgcggcgaattgggttccagtccgcccgctcgtgcagctccacgcccgcctcacgcatcacaagctccatgcgctcggcaatggccggcgcgcttgccgcacccggcgactgaatgcccgccgcctggaaaagccccggcaccacggccgactgtccaataaagaagtcgttcgttccctgaatgaccggacgcccgccggcaaatgcgcgcaccacgcggcgcgtatccagatcgggcaccagcttgcgcgcgccggtcagcagcgcgtttacatcgcttgcataggtctgcgtgtcgcccggctcgcgcacagcggccgtggcggtgatcacggtgttgccatgcacggtgcccgtcacgataacgcccttcgacaccggcgtcggcacggggtagagcggcatgagcgtgcgcggctccttgtccagcaccacgatgttgccctggcgccagaccatctggaacttctcggcgcccgccatatgcgagaggtgcgcggcgccgttgcctgcggcgttgattagatagcgacagcgcacgtcgccggcgggcgtcgccaacgtaaagcgcgcgtcgtcgcccgagtccgcgacttcaatcgcttccatcggcgctgaccgcataaacgtcaccccgttggccacggcgttctccagcgcggcgatggcaacctcaaacgggtcgacaaagcccgtcgaggggcaccaaagcgcgcacgtggcctgggcactcgcgcgcggctccagctcgtggatgcgctcggggcctataatcgccagctcgggcacgccgttcgccaggccattctggcgcagcttttccagatgcgcgcggtcctcgtcgttaaagcccaacaccatcgacccggtgcggcagaacagaaagcccagctcctgggcccacgcgccatatagctcgcagccacgggcgttgacctgtgcctttacggtgcccggcgccggatcgtagccagcgtgcaccaggccgccgttggccttcgacgcgcccagcgcaatatcgttagccgcctcgactacgcaaatggacaggtcaaaccgcgcgagccgcctcgcgatggcgcacccggtaatgcccgcgccaacaattgcgatatcaaacgtttctgccacggtgcctcctagacaagttgacaggctgtcaataagactatcctacggtctgcacacccccagtgcggcggcaatgcggcgaacagccccgcaacacccgccaacggcaggcgaggggagacccggtaacgtcgacaacctcgtctgccgacaactatggaaaccgttcgtctcgatctgtaacagttagacgaggatttgggttctagatgttacagattgagattgaagtcgggaagagtttcgtttgtctcgatctgtaacaccaaaccgacgattcgacccctatctgttacagattgagatgtttgtgtccgcgcccgtcccgcgcccggccgtggtcccatataaacaaaccccgtggtaaacttgaccgagctgtaactcccccgaaaggtacccctaatgtccaagtacatctccgagctcatgtcgccgcagcttatgggcgtcgtctatgccttcgttggctttatcgttgccctgtatgtgctgtcggtcgtctatgtgttcatcgacgctcgccgccgcggcgccagcgcctacgtggcatggggcatcatcgccctcatcccgtttgtaggcctcatcgcctacctggtcctgcgcccgcactcctacgcggccgaccgcgaggagcaggagctggacatggccctgcgcgagcgccagcttgcccagtacggcacctgcccgcagtgcggcgcgcccatcgagaaggactttgtcgtgtgccccgtgtgcgatacccaggttcgcaacgtatgccccagctgccatcgcccgctcgatgcgcactggaaggtctgcccctactgccgaactcgcatccagtaacgcatccatcgccgggctggccgcaagccacgggcaccgcgcgttccgcgcaagccgcacgcgcaacccgccccgcacgatgaagcatgcgtagaaaatcgcccgccgtgccattaaggtgcggcgggcgcttgtataccaaagcaacctgcctataatgatgcaagttaaaacgccgagagcattgcacgcacttgcatcaggcatccgagaggagaaaacatacccatgaaggcactctacaatgacggttcggtggccgagctcccgcaggacgaggtcacgcacgtcatccgccactccgccgcgcacatcatggcgcaggccatcaagcgcctgtaccccgaggccgactttgcctacggccccgcgaccgacaacggcttctactacgacgtcgacctgcccgagggcgtcaagatcggcgaggacgacttccctgcgatcgaggccgagatgaaaaagatcgtcaaggagaacctcaagttctccgtgtacgagaagccccgcgccgaggccatcgcccttatggaggagcgcggcgagaagtacaaggtcgagcacatcggcgacctggacgacgacgcccgcatcaccttctaccagcagggcgactacatcgacatgtgcgtcggtccccacatctgctacaccaaggcgctcaaggcctttaagctcaccggcgtctcgggcgcttactggaagggcgacaaggacaacaagatgctcacccgcatcaacggcgtcgcctttgccaccaaggaagagcttgacgagcacatgcacatgctggaggaggccaagaagcgcgaccatcgcaagatcggccgcgagatggatctctttatgatgcgcgacgaggcccccggcttcccgttcttcctgcccaacggcatgatccttaagaacacgctgctggactattggcgcgagatccaccacaaggccggctacgtggagatctccacgccgctcatcatgaacaagcagctgtggaagacctcgggccactgggatcactacaaggacaacatgtactccaccgtcatcgacgacgaagagtactgcattaagcccatgaactgcccgggcggcgtgctggtgtacgcctccaagccgcactcctaccgcgagctgcccatccgcgccggcgagatcggcctggtgcaccgtcacgagctgcgcggcgccctgcacggcctgttccgcgtgcgctgctttaaccaggacgacgcccacctgtttgtgcgtcccgaccagctgaccgacgagatcgtgggcgtggtcaacctcatcgactccgtgtaccagaagtttggctttaagtaccacgttgagctttccacccgccccgaggactccatgggttcggacgaggactgggctcgcgccgaggagggcctgcgcaccgctctggagaagctgggcatggactacgaggtcaacgagggcgacggtgccttctacggccccaagatcgacttccacctggaggactcgctcggccgtacctggcagtgcggtaccgtccagctcgacttccagatgccgctcaactttgacctggagtacgtggacgccgacggcaccaagaagcgccccatcatgctgcatcgcgtgtgctttggctccatcgagcgcttcatcggtattctgattgagcactttgcgggcaagttccccacctggctggctcccgtgcaggtcaaggcacttccggtttccgagaagagccgcgactacgcccacgaggtgtgcgccaagctggaggaggccggcatccgcgtggtctgcgacgatcgtgacgagaagatcggctataagatccgcgaggcccgcagcatcgaccgcgtgccctacatgcttatcctgggcgagaaggaggtcgaggccggtaacatttccgtccgcgatcgctccaacgagaccgttcagatgagcgttgacgagtttgttgccaaggtgaccgaggagatcaagacccgcgcctaaggcaaactacacaacaattaataaaggcgaccgttcacaaagggcggtcgctttttttagtgccgaaataagaaaagccgctggttgagcggctttttttgttcaagactttagtctgctgggcgcgcagcggccagctttaaaccaccctatgggacggggctctttaagctaccccaccatccacccgtcccctcctcagttgaggtgaaatagttcctgatttccgcccaaccccggcacccaggaactattccaccgcaacttatgtggaggcgcttgggatactatggtggcaacctagcgaaaggatgtttcatggcacatgtcgatgaccagcgtgtgacgcgcgtgctcgatgcgctcgaggctcagcaccccggcgcgcagctgctcgtaaacgaaccgtggtcgatctactacctgaccggcttttatgccgatatgttcgagcgtttttgcggcgtgctgctcgcgcgcgatgctgagccggtgattctcgtcaacgcgctgcatcagctgcccgattacgacaatgcccgcgtggcctaccacaccgataccgacgtcgtggccgacgccatcgcgcgcgagatcgatccggccaagccactcggcatcgacaccgtcatgcgctcgggctttttgatgccccttctggagcgccatgccgcgagcgagttcttcctgggcgacttcgccgtgacagctgcccgcacgtacaaggacgctgccgagcaggagctcatgcgcgtgtcctcggccgccaacgacgccgtgatggccgacgcgatcaagctcgtccacgggggcgtgacggagcgcgagattgccgaccagatgctcggcctgtatcgcaagcacggctgcgagggctttagcttcccgcccatcgtgagctttggtgccaacgccggcgacccgcatcacgagccagacgacaccgtgctcaagcgcggcgatgcagtgctgttcgacattggcgggcgccatcgcaactactgttcggacatgacgcgcacgttcttttggggcgaaccggataaggagacggcacgcatctacgacatcgtgcgtcgcgccaacgaggctgccgaggcgctcatcgcgccgggcgtgcgcatgtgcgatctggaccgcgccgcacgcgacgtgattgaggacgctggctacggcaagttctttacgcaccgcctgggccactcaatcggcctgcaggaccacgagccaggcgatgtttcgctcgccaacgagcaggttatcgagccgggtatgacgttctccatcgagccgggtatctacctccccggccgcaccggcgtccgcatcgaggacctggccctagtcaccgagacgggcgtcgagatcctcaacaactacccccacgatccagtccgcctggactagccaatgtgacaaagggactgcccctttgtcacatcccactaacgccgcgccacaaaaacggcctatctactacatttaacccgcatgggtcgaccatgcgggtcttttttgaaaatcggcaagctctctacctgcggttttgatttcacaatttcccgtgtggtcgagggtagtcggcaaaacgtagtagataagcccatttcgtggcaagcgagtcaactcggggcacagggcagctaaaaaagcctcatcccaaattgactgcttttgagttgcggtgagatacggactatttaaggcttctagccaagaaaacagtccgtatttcaccgcaactgatgaggggataggttagcgcagcaggccggctacttcgccggctagggtgatggtgccggctgctacgaagggctcgttggctgcatcgaaggcagcgagggcctcggatacgctggggtatacgcctgcgagcttgtcggcatcaacgagggcggcaagttcctccgccggcagggcgcgatcggaatcggtctgggtcacgaccacgcgggggaacgccggaaccaaaacgtcaacgatacccgccacgtccttatcggccagcgcggcgcacagcagcgtggggcgattctccacgcacggatcgatctcgtccagcgcgctcacaaagttctcgcagctctgagggttatggcaggcatcaatcagcttgagcggatcaatgcccagcacatcaaagcgacccggcgtgggacagcccataagcgacgcatcgagcttgtcgtgatcgagctcgcggcccaaatacccctcgcacagcataatcgcgcacgcggcattctgcggctgatacgccggcttaaccatgctcgaggtgtaaatcgcacgcggcgtggtgcagctgaactcgaccgtatcgcccacatgcgccggcaccttggtcgtgacatgattcaccacgagcggcacaacgccgcactcgcgacaacgcgcatccatcacgcgctgaacactcgcctcgtgcgtaccctcgcccaaaacaaccaagcgcccaggcttaataaccgcagccttctcccccgcaatggcctcgagcgtgtcgccaaggaccttcatatggtcgagtccaatgcccgtaatggcaacggccaccggatcggtcgcgctcgtagcgtcccaccgtccgcccatgccaacctcaagcacggcaacatccaccgcagcctcggcaaacatggtcagtccagccacggacaaaagatcgaagggcgtaatcgcacggagctcctcgcctgccgcctcacgacgcgcgttgagacgacgacccgcctcatacgccgcggagacaccgtgggcaaaaacctcgtccgagacgacctttccgtcaatctccatacgctcgggatagcgcacgaggtgcggcgatgtaaagagtgccgtcttaaggccctcaccacgcaaaatggcagccgagaaccgcgtcgtcgaggtctttccattagttccggcgatctggacgcaatcataaaactcgtcaggacgaccaagctcatcgagcatctcgacaacagtctcgagcaacggcgtagaataacgcgcaatcttgcccgtatcggccgcaagcgcaacagcctcatcaaaagaaagctccggaacctcaaacggcaccgaatataacccagaacgcttcgccataaccaaagtcccctcaacataaaaagaggcccgtaatcaacaacgagcccctcccattcaaaatatcagccaaacaccgcattgcagcgagatcaaggccacaacccagtggccctaacacgccagatgcttacaaccacgtaaacgacctgggagcggtttggggctttgctcgatacaagttccgcacgagccgaaggccacttaatgtggccttcgtgcgagcaggactgtccgcagtagcgagcaatgccccaaaccgcgcccccagtaccgcctacgagaagtcagcaacctgagcagtcagcgccgccaggatctccttgagctcagctgcacggtccctcttcttctggaccaccgcgggcgcggccttagccacaaagccctcgttggcgagcgtcttctcgcagccggcgagctccttctgggccgcggcgatctccttctccagacgtgccttctcagcggaaagatccaccttgccctcgagcaccacaaagacctcgacgccgctgtcgaccacggcgatgctcgcggccggcttctcaacgtcggtgcccataaccagcgaagacgtgttggccagcggctcgatggtcgagcgcaggctctcgagcttctcgatgtcctcggcaccagcgcgcacgaccacgtcgagctcggccttggggctcaagcgatagcgcgaacgcgtggcgcgggcggcggaaacgacggtgcggcacagctcaaacgcgcgctcggcgtcctcgtcgacatacttggcgtagtcggcgggctcgggccacttggcgatcatgagcgcctcggcgcggtcaacgttgccctcggcgtccagatcgagcacgctcgcaggcatgttgtcccagatctcctcggtaacaaacggcatgagcgggtgcatcaggcgaatggaggtgtcgagcacaaagatcaggttgcgctgggcctgcagacggccctcgcccttcaggcgggccttggtgacctcgacgtaccagtcgcagacctcgttccagaagaactgctgcacgccgcgagccatgtcgccaaaggtgtagttctcaataccctcggtgaccatcttgacggccttggccaggcggctgaacatccaggcgtcggccggcgtctccacgacaggctcgccgggcgtgtagccctccatgttcatgagcaggaagcggctggcgttccagatcttggtcacaaagctcttagcctggtcggtacgcgggctgtcgatgagcttcttggtcttcttgtcgatgttcgcgtcgaacttgacgtcctggttgttggtgcacagcgtgagcaggttatagcgcatggcatcggcgccgtacatgccgatgagatccatggggtcaacgccgttgcccttggacttggacatgcggctgccgttcttggccagaatcgtcggatagatgacgacatccttaaacggcacctcgtccaagaaatacagcgagctcatgaccatacgggcgacccacagcgcgatgatgtcgcgcgcggtgaccagcgccgtcgtgggatgatggccctcgagcagctccggcttttgcggccagccctgcgtggcaaaggtccacagctgcgagctaaaccaggtgtccagcacgttctcgtcctggtgcacgtgatggccgccgcacttggggcacacgtcggtatcctcggtcagggcgtcctcccagccgcagtcctcgcagtagaacacggggatgcggtggccccaccacagctggcggctgatgcaccagtccttgaggttctccatccaggtggtgtaggtctgcgtccagcgcgcggggtggaaggtgaccttgccggagttgacggcgtcgagcgccggccccttgagcttgtcgacggcgacgaaccactgctcggacagccacggctccagggcggcgtcgcagcggtagcagtgcatgacggagtggtcgtggtcctcgacgtgatcgagcaggtcatgctcctcaaaccacttgatgacggcctcgcggcactcctcgcgggtcatgccggtgaactcgccgtagccctcgacgaccaccgcgtgctcgtcgaaaatgttgatctgcggcaagtcgtgagcctgacccatggcgtagtcattggggtcgtgggccggggtgaccttaacgaagccggaaccaaagttggcgtcgacgtgccaatcctcaaaaatggggatctcgcggttgacgatcgggagcatgacggtcttacccacaaaggcagccttctcggggtccttcggggagacggcgacgcccgtgtcgccgagcatggtctcggggcgcgtggtggcgacgacgatgtagtcctggccgctgaccggctcggtcagcgggtagcgcaggtgccacaggtggcccttctcgtccttgtactcggcttcgtcgtccgagatagcggtggtgcagttggggcaccaattgacgatgcgcttgccgcggtaaatcagaccgtcgtggtaccagtcgcagaagaccttgcgcacggcctgggcatagtcctcgtccatggtgaagcgctcgttgtcgaagtcgacggagcagcccatgcgcttgatctgctcgacgatgataccgccgtactcgtgggtccagtcccagcaggcgtcgacaaacttgtcacgaccgatctccaggcggctaatgccctcgctcttgagcttcttgtcgaccttggtctgcgtggcgataccggcgtggtcggtgcccagcacccagcgcgtggacttgccgcgcatgcgggccatacggatgatggcgtcctggatggagtcatcggtggcgtggcccatgtggagcttgccggtcacgttgggaggcggaatggtgacggtgcagtcgcccacgccctcgcggcgcttatagtagccgccgtcgagccacttctgcagaatcgccggctcgttggtcgacggatcgtagttcttgggcatttcttccatatatctctccctgtcccgccggggaggaatgtaggcccgacagggcctacattcctccccttaggtatcgattacttcagtctgaatgacttcgctgaggcttaaacaaacacacagaataacacaggtagttggggttattgcgtttatataaaatagcctccgaccgcgggtggtcgaaggctatttgcaaacacgttttagacaggtctagccgtagatgcgctggggctgttcttcgccctttacggaggcttcggttacgacgaccttggaaacgccctcctcgctggggaggtcgaacatcgtctgctgcagcacatcctcgcagatggaccgcaggccgcgggcgccggtcttgcgggcaagggccatacgggcgatctcgtgcagggcggcgtcctcaaactcaagctcaacgtcctcgagctggaacatcttgcggtactggcgcaccacggcgttcttgggctcggtcaggatcgacaccaggtcgtcctcatcgagcgcctgcgtctgggtgacgacgggcgtacgtcccacgaactcggggatcatgccaaaagcgttgaggtcctgcgggagcacctggcgcagcaggtcgttctcgtcgaccgaggtgggaccggcgatctcggagttaaagcccacgcccttgttgcccacgcgatcggcaatgatcttatccaaacccacaaaggcaccgccgcagatgaacaggatgttggtcgtatcgatctgcagcagctcctgctggggatgcttgcggccgccggtgggcggaacgctggccaccgtgccctcaagaatcttaagcagtgcctgctgaacgccctcgcccgaaacatcgcgggtgatggagaggttctcggccttgcgggcgatcttgtcaatctcgtccacgtagatgatgcccacctgcgcgcgctcaatgtcgccatcggcagcgttgatgagtttgagcaggatgttctccacgtcctcgccaacgtagccagcctcggtgagcgcggtggcgtcggcgatggcaaacggcacctcgaggatgcgcgcgagcgtctgggccagcagcgtcttaccggtaccggtggggccaagcagcaaaatgttggatttggcgagctccacctcatccatatcgttgtcaaactgggcgcccatgcccgaggcctcgtcaagggcggacaccgcagcgcccccctcgatcacgcggcgatagtggttgtacacggcaaccgacatggcgcgcttggcgtcctcctggcccatgacataggccgaaagctcgtcatagatctcgtgcggcgtcggcacgtgcgtgatgacctgacggtcgtcctcgagctcaaagccctcggcctcggggtcaacggcgggctgggacgcagcctggccgtggtcgttgaggaaacccgggagattgccgttgcgggcggcgtccataaagtccgaagccagcgactcttcaaggatctcggagcaggcggcgacgcactcgtcgcagataaagatgttggtcggaccctttacaagacgacggacctggccctgctcttttccgcagaaggagcagcggatggggttgccgttctcgtcaaagttgtcctgcatgttacctgccatcctaggcgtccttcgcggcgagatcgcgcgaggtgacgatacggtcaatcaggccgtagtcgagggcctcggcagcggtcaggtaattgtcgcgctcggtatcggcctgaaccttctcgatcggctggcccgaggcgtcggacaggatttggttgagctcgcggcgggtcttcttaatctcctcggccacgatctcgatttcggtctgctggccctgggcaccgccactgggctggtgaatcatgaccttggagtgcggcaggcagaagcgcttgcccttggcgccggccgaaagcagcacggcggccatagaagcagccataccgacgcaaatggtggagacctgcggcttaatgaagttcatggtgtccagaatcgccaggccggagtagacctcgccaccgggcgaattgatgtagagcgagatatccttctcggcatcctggctctcaagatgcagcagctgggcaacgaccaggttggcgctgacggagttgatctcctcgcccaagaagatgatgcggtcgttgagcaggcgcgaatagatatcgtagctgcgctcgccgcgcggcgtctgctcgataacgtatggcacgagggcggaatcgaacttagcgatcatacgcatctccatttctcttacggaccaatagtggttctagacaaacgtacggtgcccgcatgctatgcattggctggcaccgtacgaagcaaccggataaccggcttataactttaccccatcacgggcgcatccatgcgctcgcggaaaaggtggcgagaattactcggcgtccttggcggtctcgtcgacctcggtcaccttggcgttctcgaccaggtggtcgacggccttggagcgacggatggactcacggacggcaggcatgcggccatcagcgatgaactcggccttggaagcctcgacgtccttgacgccggccttctcgaactcggcgttgatgtcgtcctcggtgacctcgatcttgagctcacgcgcgagggcgtcgagagccagggactcacgggcaacgtcgttggcctgcttgtgcaggtcgccgatgaactgctccatggtcaggccggaagcgggcagccaggtgtccagcgtcatgccgcgggcagcgaggttggacaggaagttctggccgagctcctcaaagacggactgctcgtagtcggcgtccatctcgtcgagctgcaaacgctcggcgagagcggagacgcaacggttctccttctcggccgggaggcgggaagccttgtcctgctcgatctcgatcttgatggcgtcgcgcatggcctcgatgctgtcgaagccaaagtcggacttgacgagctcgtcggtgagctcgggggtgttgcggaccttgatgcccttgacggtgacctcgacggtgtgggtctcggcctcctcgccctcctcgacctcgtcggtccaggtgacggtcttgacgtcgtcgacgttagcgccgatcagggcctcgttgaactccttggggttgctgtcgctaccggcgatgagcatacggccctcggcggcgaagttgtcggcgttctcgacggccttgaggtcgacggtaacgtagtcgtcagcctcgacggcgcgaccctcgacgtcctcgaaggtggcacggtagttgaggagcatctcgacctggttgttgatctcggactcggtgacctccgcggggggcatctcgatctcgacggcgtcgaaggaggagagctcagcggcgggacgcagggagaactcgacggtgtaggtgtagtcctcgtgatccttggcgaggtcgaggtccttgtagtcaccgttcttggtggggacgatgtccagctcgttgaggacggcgggctcgttggcggcgatcaggtcgttggtggcctgagcgagggtagcctcggcgccaagggcggagtcgatgaccggacggggagccttgccggcgcggaagcccgggaagcggtacttcttggcggtgtccttgtaggccttcttgatcgcggcgtcgacgtcggcggccgggatggtgaccgtagcggtgagcttggcgtccttgacgtcagaagcggtgatgttcaacacgttcctcctcatactgcccagcttatctgaggtgctggtacctttatgcaacaaagtgtcgcgacggccaaggccgacgcaagtgcgatggtgcgggcgaaaggactcgaaccttcacgggaatcccaccagaacctaaatctggcgcgtctaccaattccgccacgcccgcatgagcgcacagactaggaatgataacagatacgaacggcaagcgcacgcacaccttttacaggctcacgacctcaccacgagtgcccatcggagggaagggtagctaatttgggacggggctattttagctaccccggctgatagcgcgaatggttggccaattaacggctggggtagctaaaatggccccgtcccaaattagctacccccagctcgtctactcccccagcagggccttctcgggcgtgatcggcagcgagcggacctggtggccggtggcgtgtgcgacggccgaggcaactgcggcgagcggcgtgttgatgacgacctcgccgatcgacttggcgccaaacgggcccgtcggctcgtagctcggctcaaaggccacgcgaatgctgccgatatccaggcgcgtgggcagcttgtagctcataaagttgccggtgcgcaggcggccgcggtcgtcatgctcaacgatctcgtagagcgcatggccaataccctgggcaatgccgccctcggcctggacgcgcgcgagcgcctcgttgatcacggtgccgcagtccacggccgccgcataatccaccacggtcaccttgccggtggccttgtcgacctcgacctcggcaataccggccataaacggcggaggcgaaacgggcaggcaggcagaggcgtgcgaggtgagcgcgtcgccgccctcgatattcttgacgcacaagttggcaaagtcgcgcagcgtgaggtagcgaccgcgctcgcgggcggcacgctcgtcggacaggcgcacgtactggccatcgaagaccacatcggcggcgtccacgtcccacatctgggcggccttggcgcagatcttctcgcgcagctcggtcgcggcgttcttggcggccaggcccgtcacgtaggtaccggagcttgcgtacgaaccggcgtcgaacggtgacacatcggtgtccacaccgcgcaccacgataagcgagctctccacgcccagctcctcggcggcaatctgcgccaggatcgtatcgacgcccatgccgttgtcggtggcgccggtcgaaatcgtaatgaagccgtcctcttccaggcgcatgtcgatgccggcgatatccacgttggagatgcccgagccctgcatggtgagcgcgcagcccagagcacgcacgcgatcgcccaggtcgacggccagcggcttgtcgcgccaaccgatcatgtccatcgcgcgcagcaggcagcggtcgagcgcgcaggcgttgagcttctcgttgtagtactgcggcatgatctcgccctcgcgcacgatgttcttaaggcgcaggtcggcggggtccatgtgcagcatatcggcgagctcattgacggcgctctccacggcaaactggccctgggtggcaccgtagccgcgatacgcgccgccgcggttggtgttggtgtagacggcgtcccacctaaagcggctcgccttcacatggttgtagatcggcaggctcttgtggcccgaaaggccgatcgtcgtggtggcgtgctcgccgtacgctccggcgttggacagcgtatgcaggtcgatggccgtgatggtgccatcgttcatggcacccatcttgacggtcatctgcatctggtggcgcgagttacccgcggtgatggtctcctcgcgggtgtagcagcagtagctcggacggccggtctgctgggtgacgaacgccacgaagatctcgcagcagcccgtctgcttggagccaaagccgccgccgatgcgcggcttgatgacctgcacctgcgactgagggatgtcgagcgactgcgcgatcatgcgacgcacgtggaagggtacctgcgtggaggtggtcaccgagatgcggccgaacgcgtcggtcgtcgcgaaggcgcggaaggtctccatgggcgcggtctgcgtggcctggctggtgtaggtgcgctcaaagacgatgtcgctctgggcgaaggcctcgtccaggtcgccataatcgctggtaccgctgcacactaggttgcgcgggacgtcgccgccctgcgggaacataaaggtcacgtcgccctcggggtggaccacgatgtcgttatcgagcgcctgcgtaaagtcgagcaacggctcgagcacctcatagtcgaccttgatgagcttgagcgccttgtcggcggcctcctcggtctcggcggcgacgatcgccacctcctcgttttggtagcgcacgaggttctcgaggatcaagcggtcatacggcgagggctgcggatagctctgcccggcgatggtaaagcggcgctggggcacgtcctcgtaggtgtagacgcccacgacaccgggcaccttcagggcgcgcgacgtgtcgatggagcgaatcttggcgcgggcgtaggggctgcgcttgagcttgacgatgagggcaccggcgggcaccaggtcgcccgtgtagaccggacggccctcgagcagggccttcgagtccttcttgggctgcttgtgagtgatctgcttatacgagacgccatcgcagctggtgttattgaccggcagctcgggcatctcaaagcccacctgcacgccagactcgttgaggaagcgaacgatggcgcgcagctggctctcgtagccgctgcaacggcagaggttaccggcgagctggcgcgagagctcctcgcgcgtggcgacgaggctcggatcctccttggcagcgcgggcgagcgccagcacgttcatgatgaggccgggggcgcaaaaaccgcactgctcggcaccttcggctgccatcgcacgggcgagcgcctctgactcggccttgagaccctcgagcgtggtgatggtatggccctcgacgcgcgcggcgggaaccgagcagctcagcaccgggtcgccgtcgagccataccgtgcacaggccgcagttggtggtctcgcaggcgcagcgcaccgacgcgcaaccctgctcgcgcagcagcgcaaacagcatggtgtcgggggcaatctgaaccttgaccttgcggccgttgagcgtaaaggaaagatcgatgagtttggcagccattagcgcacctcgctagaatcgacgccgggcacgcggcggcaggaatactcgtccgtggcgaacttggggatctgcacggtctcgagctcgtgggcaagcgcggccgaaagctcaatgccggcggcacggcgcacggcctgcacggcaagcggggccgagatgcgacgacggtagtcggccgagccccacaggttggtgccgtaactcagcgcgcgcacggacgcggcgagggcgcgaagctcgtcctcggaaggttgctcgctggtgaggccgcacgcctcgccctgcagcaaggtcgcacgcagcgggcgggcacccacggtaacgtgccaggagttatcccaccaagcggcggtgacgttgagcgaagggaagtcggtcgcagccttgcgcacggcctcgtagctcgcgcggtagtcgtgcttgacgaccacaacatgctcgatcacgtcgcgcacgtagcccatgtcgacgaactcgacgagtggcacgcgaccggcgcccgtcagctcaacataggaatcgagcgccaagaaggccgaaagcacgtccgagaagccaaagcggccgtagatgctcccgcccaccgtggcggtgttgcgcagctggacgcccacgatatcgtgaacggcaaactcgaagacattgttgacaagcgcgttgagcccggcatgacgctcgagctggcgcagggtacacatggcaccgatgcgaaactcggtctcggtctcctcgatctgatcgagtccgcaggccgaaaggtcaatcgccgtcgctacacgacgcgaacccaggcgcatccagatgccgccgcccacaatcttgttgttgcggtttttctgcaagagctcataggcttcggccgcgtttccaacacggacgtaggtaccgaacttgagcacgttctcccccatctcttcacttgtccagtacgtttaagtgtaccaaacgaggggcacgcgccgttgcaggacaaaaacgccacgtggaaaagagaaaggctcccagccgagatgactgggagccttttgtgacgctatgaagcagaaggcttagcacacgccctgagcgagcatggcgtcggcgaccttcaggaagccggcgatgttggcgcccatgacgaagttgtcctcctcgccgtactccttggcggtgtcgtccacgttgtggaacatgccgcgcatgagctgctcgagcttgccgtcgacctcctcgaaggtccaggacaagtgctcggcgttctggctcatctccaggccggacacgagcacgccgccggcgttggcagccttgccgggcataaaggcgacgccgttctcctggaagtaggtcgtggcctcgatggtcgtgggcatgttcgcgccctcgccgaccaccttgcagccgttggcgacaagcgcctgggcgtcctcaagcagcagcgtgttctcgcgagcgcagggcagcgcgatgtcgcagggaagctgccacacgccgcggccgtcgccctcgtgccaagtagcgttgggcttctcgtcgacgtacatggcgagcgtaacgcccttgtcgtggccggagcgcttcttgttgtagacatgctcgagcacggtgtagtcgatgccgtcgggatcctcgacccagccgtgggtgtcggagcaggcgagcaccttgccgccgagctgggcgaccttctggacggcgtagatggcgacgttaccggagccgtgaacgacgacgttcttgccctcgaaggagtcgccgcggctcttgaggtactcgtccacaaagtagaccaggccgtagccggtggcctcggtacgggcgagcgaaccgccaaaggagagacccttgccggtgaggacgccggtccactcgttggtcaggcgcttgtactgaccgaacatgtaggcaacctcgcggccgccaacgcccaggtcgccggcgggaacgtcggtgttggggccgatgtggcggtaaagctcggtcatgaaggactggcagaagtgcatgatctcgttgttagacttgcccttgggatcaaagtcggagccgcccttgccgccgcccatgggaagggtggtcaggctgttcttgaggatctgctccagacccaggaacttgagcatgcccagggtgaccgtcgggttaaagcgcaggccgcccttgtagggtccgatggcagagttgaactcgacgcggtagccgcggttgacctggaccttgccctgatcgtcgacccagggaacacggaacataacgatgcgctcgggctcgacgaggcgctcaagcagggcggcctcctcgtactcgggatgggcgtcgagcgccggctggatggtgccgaggatctcggtcgcggcctggatgaactcaggctgctcgggatagcgggccttgagctcgtcgagaactttctgcgtgtagctcatgcttcctccaattgatggaaaagaaaggtgtcgttcgcggcgccccatgcgccgtgagctttatcgagtatggataatatcgcactgttgcaacaaagttacgcataagccgacgagcagatgtttcgttttgattacgatgcaggtagaagcgtttttgagagtctgacgtgcaaaacccgtgtttcaaacctgtttcgtccacgtgatccaaaccaccacaaaggggacaggcacctttgtggtggtgttggtggttacaggacgagctgatggtagtctgcgggggttatgcggccttcggtggcagcgcggaaggcggcgagggcatcgccggagaacggcatggcccagcacagcccgcagccggcggtgatggagccgggcagcggcatgatgcgcccaggcacatcggcatccaggcacagctgctcgcattccatcacatcgaaggtgctgtcgaacgacacgataatcttgcgttcgtggtcgagggcatcaccggacgggccttcgcggtgtgcctcacgatacgccgcggcggccgcttcctcttccgcagtatgtccacagccaccgcagccgcaagtacaaggctcggacccatcgcaagtgcagggttccccggtatcggggcaaatatcgtgaggcatggcatctcccatcgtctaggcgagcagctcggctgcagcaaactcctcgggtgtattgacgttttcgaagcagagcgtggagccggcaacctcgacaatctggggctcatccagatagccggcatggacctggtcgatcaaacagcggatgcgttggcggtcctggtcgagcaactcacgggcaaccggcgcgcaagtctgacggcgccacacggcgcacagcggctcaatcccccgctcctcgcgcgggacgcacacatcgagcgggccttccttgacctgatccgaaagcgcgccgatcagttctggtgagacgaacggcatatcgcaggcaacgatcgccacgagcggcagccgagccgcagccaacgagctcgcgatgccgcgcatggcgcccgccgacccttcaaggtccgctaccacgcgcggcacaagaccgccaaatgcgagctcctcaagataggcaagctcgctgggacgcgaggtcgtcacgaccaattcgccggcaactggcgccagccgacccagcacgcgttcgatgagcggctcgccgcaaaacaacatccgcgccttatcgcaacccatgcgcgacgacagcccgcccgcctggacgatgcaagaaagatcggctcgtcttacggtagtcatacggcaaatcactcccatcggcatgctcgaaacccggtgcacgaagctaaataccgccgccgaaatagcggcgctacgagaagctcgtgcaaaaacaaaacagcgcctttgcggcacgcagcaagaccgcgagcacaaaagcgctggtagcgtgtggcgggaacgtatgtgaatcgaacacatccaagacgttttgcacgcctcgcaacggttttgaggaccgcggagcccaccggagcccatccgttcccaagtgcgccggtattttaccaaaccgacaggccccatcccaaaaagacaagcaagaagttgcggtggaatagttcctggtttggcgttagatgccgaaaacaggaactatttcaccgcaactgaggaggacttgcagcgacggacctcaggacactcttacaccacgtctgcgcgcgcgaccaaatctgtaacagatagagccaacttcggcccccagatgttacagattgagacaattcccttggtgcaaaggggtggtgcaaaggggtcaggtttgtttgcaccacgttggtgcagattaacctgaccccaatgcaccaatctggcctgcctgcgctacaaggcctttttggggcagaccttcgtgcactccatacacaggatgcactccgtgccgttgcgacggtcgagcgaattgtccgtcacgtccacatccatcgggcaaatcttgcgacacttaccgcacgagatgcatttgtccttatcacaggtaacgcgcacgaccgcccgcttggacatgggctttataaacaccgtcaccgggcagatgtacttgcaaaacgcgcgattgtccttaagggcaaacgcgagcgcgatgcccaccacgtaatagatcacattgcccacgataaaggcaatccacatgacgtcggcaaggttgggaacgcccagaagaaacagcgcacccacaaatgcgagcgacgccacaaaggtcacgtagcgcagccagccaaacgaccgacgctcgtgcgttgcaggcaccttgtacgacagcaaatcgagcaccatcgccgtccaacacgcatagccgcaccaaccgcggccaaatacaagcggcccaaagatcttggccacggcgtaatgaatggtcgccgcctcaaaagagcccaggaagaggtagtaccaaaagccctcgatctgcatattctcatgacacagaaagcccaggtagacgagcatatatgtgccgacagcaaactgaacggcatgacgcgcgtacctccagttggcgatatagagcgccgtgcctgtggccagcgccgtgccaatgtaggagaaattgcccagatagaacaggttacccgtagcacgccacagaacaaccgcgaccgcctcgaagacaatccaaagcagcgcgggaaccttgtactttgcaatgcgattcatccgagggcctttctgcgtcgtaacctttcctgccattatgcgcgcggtcggctgaagtgcgggcgcagttcgatgactcggcatgtaaggattttgcagacagcatgggcgcgccgacatgtgccgcttccctcccgccgaacatctcgatctgtaacagttaaacccaatttcggtgtccagatgttacagatcgagatgttttcgagagacggttccgaatgtctcaacctgtaacacgaagagctagtttttgctgccaactgttacagatcgagacattccgtccccactcccatttggtacaagggggtcaggtaaatctgcaccaccttggtgcaaacaaacctgacctccttgcaccaatcttggctaaaaccacatttttgttagtcttggttaacttcctagcctaaaacgggtatcctttgcggcgtcaagcaaacggcacgtacaccgtgccagatcaaggaggcccctatggcgcgccaagcagaccagcagacgatgcaactcgtccttatccgtcacggagagtccgagtggaacaagctcaacttgttcaccggctggaccgatgtcgagctcaccgacacaggccgcgaagaggcgacggcaggcggtcgagccctcaaagaagcgggcttcgactttgacgtctgctacacttcgcgcctcaagcgcgcgatccacaccctcaacatcgtgctcggccaaatggatcgcgagtggttgcccgtcatcaaatcctggaagctcaacgagcgccactacggtgcgttgcagggtctcaacaaggccgatgccgccgcggagcacggcgacgaacaggtgctcatctggcgccgctccttcgatgtctgcccgccggcactcgagccggacgacgcgcgcgacccccacacccaggagcaataccgcgacatcgcgcccgaccagctgccctataccgagtgcctcaaggacacgatcgcccgcgcctggccttatttcgaagacgagattcgcccccagatgctcgccggcaagcgcgtactcatcgccgccaagatcgacgccgttgccaatcagggcaaggcgcacaagtagccccatctcgaaccatgcgcgcggcgccgtacgaccccggtgcgacgccgcgccgcccgcacgcaggagccgaccatgctcaaccatctcaaacaacactttggctcgcaccgcaccggaggccatggcggtctggacatcgcccggcacatcggccccgggctgctcgtcaccgtcggctttatcgatccaggaaactgggcctccaacatggccgcgggctcgcagtttggctacgcgctactgtgggtggtcaccctgtccacgatcatgctgatcgtcttgcagcacaacgcggcgcacctgggcatcgccacgggcgtctgccttgccgaggccacgacccgctatctcccccgcatcgtcggacgcgccgtgctcgccagtgcatacctcgcaaccgtcgccaccgccatggccgaggtcctgggcggcgcaatcgcactccagatgctctttgggctacccgtgcgcgccggctgtgtcatcgtggcggcggcatcgatggcgatgctcatgacgagctcctacaaacgtgccgagcgctggattatcgccttcgtcggcatagtgggcctgtcgtttttggccgagctcgcgctggtcaaggtcgactggccgcaagccgccacaagttggatcacgcccggcatacccaccggctcagccgccatcgtcgtcagcatcctgggtgcggtcgtcatgccccacaacctctttctacactccgaggtcatccagtccatgcacttcgaaggccaaggcgagcaggttatcgaggagcgcctgcgctacgagctcttcgacacactcttttcgatgggtgtgggctgggcaatcaactcggcaatggtcatcctagccgcgacgactttctttgcccacggcatcgtcgtagacgacctcgccgtcgcggccgccacgctctcccccatcctgggcccggcaagctcgatcatctttgccgtagcgctgctgttcgcgggcctctcgagtagtgtgacggcgggcatggcggctggcaccattacggccggcatgttcgacgaggaatacgacatccacgaccgacactcatcgattggcgtggcgctctgctttgccggcgcagtcgccgcctgcttggtcgtttcgaatccttttgagggtctcatctggagccaggcgctgctgtcgctccagctgccgatcacggtcttcgtacttatacgactcaccagctcgcgccgcgtcatgggcaaatacgccaactctcgcccacttacggtactgctcgtggcgatcggtgtggtcgtaactgtgctcgatgtcgtcctgctcatggggacgtaattggtgcaaagaaacctgaccccaatgcaccaacaaaaagggtcccggccggaataaccgaccggggcccttggacagagctctgtatggctaatcgccgtacgcctgcgagttactcctcgacgagctcaaactcatcgggaccgacgccgcacaccgggcacacgtagtcctcgggcagctcgggcgtgtcgacctcgacctcgtaaccgcaaacggtgcacacaaacttataggtcttcttctcctcagccatgatgttctcctctcgaacgtgactgctgatgtacttcgcttattagtataggttctcaataatataatgcaagtgtttttagagcatttctatccctgatacgaagatgccttgggcggcgtcttgcccttcaggaccttgtggtagtaatcgtaggtaagcggtgtctcgtcgctcaggcgctcggcgtcctcgacctcgccgataaacagcaggtgcgtacccacgtccacggtgtcaatcaaacggcagctaaacagcgctgccgcatgctcgggcacatagggcatgcccagagccgtctcgcgggtctcgtacttggcaaacttgtcgtagtcgctgctggtgcggaacccaaagttaccgatgtagagcatgtcggccgtctgatcgatcacggtcagcgcaaacgccttggccgatgcgatgacacccgaggtgacgttgtccttgtttacggcaaccgaaatgcgcggcggcatggacgtcacctgcaccgccgtgttgatgacgcagccggcgcgcagcccgtctgccgcggcgctcaccacgtacaggccgctcggcatggtaaagaacgcagttttgtccataacgatcactcccctaacccgggttggaacctcatggatgtatgtacccacaaaaaaggcggcacccctaacggatgccgcctttggggcatatgtgtcagaacagtaagaaagatgagacagctgaagtcgaggtgggacaaagttatcagtagtttttgtcccaccgtccctgcaggtcgagcgcctagcggttgcgctccttgagggcgcggtcaatctcgcgctggacatcgcgcttggccatatcctcgcgcttgtcgtagagcttcttaccgcggcccagaccaagcagcagctttacgcggccatcggtattaaagtagagctccagcggcaccagcgcatagccgcggttacgtagcttgccgtcgagaaaatcaatctccttgcggtgcagcagcagacgtcgacggcggtcgggatcgcgattccacacgccaccgtggctataggggtggatatgcaagcccacgagccagcactcaccgccacggatgagcgcaaaggtgtcggtgatctggcaggcgcgctcgcgaatcgacttgacctcggtgccgctcagttcaatgccgcactcaaaggtctcatcgataaagtactcgtgatgtgccgagcggttcttggagatgagcttgcgctcgcgcttactgggcatcgccggcctcctcggaaccgtcggcgtttttgctcgcggcctcgcgctttgctttgcgctcggcgttgagctcagcatcgctctcgcgcaccagcttgatgatcgccgcgcaggcctcctcgcccaccaggtcgcgggcgcgcaccgtcaggcgcgtcgcctcgcgcttatcaccgtcgttagcggcatcggtcgcgcacatgatcaggcagatggcaatctcggccgagggcgaggtcggcacgccctgcagggccagctcgcccatcacatgatcgtcgctctcgtcggcggcatccggataggtggtatggatcttgttgagcagacgcgtcgtatgcgcatcgttgggcgccagacgcagcgccagacgcgcgcagcccacggcagccgagacgttctcggtctcgggctccaagaagtactggcccaagttagcgtaggcgcgggcggcgcacttgccatcgctcgcacgctccaacaccgaatacgaaagcgacgcccactcctgcttgtcctcgagcgcacggaacagctcggccaaatccagacgatagttgcagttcatgggatcccaacgcacagcttgcatcagggcgttgcgagcgctcacataatcctgctggcgaatataggcaaacgccatgtcggagtacaggcggtcaaagggaacctcgacctgcacgagctcgcgcggatccttttccacgcggcgataggccagacgctcaaacttgctgtcgaagctaaagtactggcgcttctcctccgtcttgcactcggcgtcgatatattcctcggcgagctccaccagacgctccagcagcggcgtcgccgtggccaggtcaccctgcgccagatagttctcggcatacgtaatgtcttgcaagctgatgggcaggtccatggctactcctcgaacgggacgaaacgcggcaaacgccgcttgcggtcaatacacaaaacccgggtctcttacgaggcccgggcgttcatttctgggtagcccgtaccagattcgaactggtgatctccgccttgagagggcggcgtcctggaggccacttaatgtggcctccgtcgtgagcaggactgtagagcaggaaacttaacccccgccccggagcccagcgggcaacccctcccttgtactttatcaaggtagagtgtattattctgaacgttacatgactcactttatctaactaaagtgccatcaagggggataccatgaataccgatatgtctcgtcgtcagtttgttggtctagccggctcgcttgccacggtgctcggccttggcctggtaggctgtggcggcagtgccgacaagggctccgcagctggctctgccgcagccaaggacgtgaagggcgctgcggagtccaagaagctcgtggtgggctttgacaagtcctatcctccgtatggttttgtgggcgacgacggtgagtacaccggctttgacctcgaccttgctaaggctgttgccgacaagcagggctgggacgttgagtacgaggctatcgactgggacgccaaggacacactgctcaactcgggtgccatcaactgcatctggaacggctttaccatggagggccgcgaggacgactacacgttctccgagccgtatatgctcaacgagcaggtgctcgtggtcaagaaggacgcgggcattaagagctgggacgaccttgccggcaagaccgtgattacccagactgattccgctgcgcaggatgtgctcgagggcgatcagaaggatttggccgcgacgtttgccacgctcgataccatcggcgagtacaacacggcctttatgcagctcgagagcggcgcggtcgatgccgtggcttgcgacctttcgattgctcagtatcagcttgccgccaagcccgatgcctatacgcagcttgatgagccgctgtccagcgagcactatgccgtcggctttaagaagggcgacaccaagtctgccgacgccgtgaccgagtcgctcaaggcactctacgaggacggcacggtcaaggacctgtgcgacaagtatgagagctatggactctcttttgataattgggtgcttaagtaatgtcaattcaggtcatgatgcagatgcttggccaggggttcttggtcagcctgcagctatttgtgctgacgttgctggggtcgattccgctgggaattcccgtggcgtttatgcgcatgagcaaaatcgcgccgcttcgttggattgcgcgcatctacatctcggtcatgcgcggcacgccgctcatgctgcagatgtttgccatctactttgccccgtactacgtgtttggcatttcgctcactcccgattccaagtggacggcgtgcgtcgtggcgttcatcatcaactacgccggctactttgccgagatctatcgctcgggcttgcagtcgattccgcgcggtcaatatgaggccgccgaggtgctgggctactcgcgcatgcagacgtttctgtatatcgtgatgccgcaggtcgccaagcgcattttgccggcgatgggcaacgagatcatcacgctggtcaaggacacgtcgctggcgtttgccattggcgtgggtgagatgttctcgacggccaaggcgctggtcgcctcgcaggtgagcatggtgccgtttgcgatcgcggcgctaatctactgggtctttaacttcgtcgtcgagatgctgctgggcgccgccgagaaaaaattggattactaccatgattaattcggtaatgaatatatcgaacgcgcgtaaggcgtttggcggcaatgaggtgctcaaggatatctcgcttgaggtgaagcgtggcgaggtcgtggcgattatcgggccttcgggtggcggcaagtccacgctgctgcggtgtgccacgctgctcgagacactcgacggaggctcgctctcgtttggcgaccttgccgttgcgacggatgcgggttcgggcgcggtctatgcgaagggcgatgtgcccaagcaggcgcgctcgcgattcggcctggtgttccaaaattacaacctgttcccgcactataccgtgatgaaaaacatcaccgatgcgccgattcgcgtgcttaagcgtccgcgcgagcaggcggaagtccgcgctcacgagctgattgcgcaaatggggctgacgggcaacgagaacaaggtgccgtgtgagctctcgggcggtcagcagcagcgcgtgagtattgcccgcgccctagcgctcgacccggagatcctgttctttgacgagccgacctcggcgctcgaccccgagctgacggccgaggtgctgcgtgtcattaaagaccttgcggcgcagaacatgacgatggtgatcgtgacccacgcaatgcagtttgcgcgcgatgttgccgaccgcgtggtctttatggatggcggccgcattgtcgaggagggtcctgccgagcaggttatcgaccatccgcgtgagcagcgcacccgtgagttcttgagccgtatcgaggggtaggctcaggtatttactcaactattaattgaggcgaagccgccgcaggtcttacggtctgtggcggctttttgtttgcatcgacggggttcaataatcgcctcacaagcttgtctcttcctctcgccgcctgtattcatacgtgcgccgaaaggtatgcatggacagccgcccgtgagggtagggtggtggcataggacatttggagggtgagtcggctcggctgccgaccatgctgctcccgggatggcaccgaccgcgaactctccccgttggcgtcgcgcattgagcgcggccctgcaaggaggtcatcatgggtgctcccaagaccggtaacgtaaggaacgtggtgctcgtaggccaaggcggggtgggcaagacttcactcgccgaggccatgctccacctttccggcaagaccgcccgcctgggcggccacgacggcaccaagcccacgctcgactatgaccccgaagaggtcaagcgttcattctccatctcgacgaccatcgcgccaatcgactggaagggtgcccgcatcaacgtgctcgatgccccgtgctaccccgattttatcggcgacgcctttgccgcgatgagcgtctgcgagacggctctgtttgtggttgacgccgaggccggcccgcagcctacgaccgtcaagctttggtatgcggcggaggatctgcgtctggcgcgtgcggtgttcgtgaaccgcttgtcgcgctccgaggccagctttacgaccaccatggacctgctgcaggagcgctttggcacgcgcctgggcgccgtgacccttccctggggcgagggcgaggactttgacggaatcatcgacctggtgcgcatgaaggcgcgccattgcaacggcgccgaagccgttgagtcggagattcccgaggagtatcgtgcccaggcggaggaagcccatgaccatctgtgcgagctggtggccgaggctgacgacgagctgatgatgaagtacttggaaggcgaggagacgctaactcaggaggagcttgaaggcctgctgtcgaaggcgatcgccgagcgcatctttgtgccggtctttgcgggcgattgcattaaggagcagggcgtcaactcgctgatggacgacatcgcgacgtacttcccagcgccgaccgactatggcgagatgccgcttatcgacggcgattcgctcaagatttcgagcgacgatgaccgcccggtggcgtttgtgtttaagacgctggccgatccgcagcagggtcgcatcagctttatcaaggtgctgacgggcacgcttgagccgggccttgagctgatcaacgcgcgtacccgcaagagcgatcgtctggctcacctgtatgtgatgtgcggccgcgacatgaccgaggtcggtcacgcctatgccggcgacattatcgtggcgcccaaactggctgccgagacgggcgatacgctctccattaccggtaaggtcgaggctgcggcgtttaagttccccaactcgcagtaccgcattgccatcgaggccgagaatcgcggcgacgaagagaagctctacacgtttatcgagaaggcctgcagggccgatccgaccatgagcatcgaccgcgacgaggagaccggccagaccattatctccgccgttggtgaggcgcaggtttcggtgctgctcaaccgtctggaggaccgcaccaaggtcgtggccaaaagcgtgccgatccgcattccgtatcgcgagaccatccgccgcacggcgagtgcccagggccgccacaagaagcagactggcggtgccggtcagtatggcgactgctggctgcgcgttgagccgctcattgggcccgacggcacgagcgacggctacgagtttgtggacgaggtcgtgggtggccgcatcccgcgctcgctcatccccgccgtggacaagggcgtccaggagaccatgaaggacggtattattgccggctatccgctcacgggcattcgcgtggctgtgtacgacggctcgtatcacagcgtcgactccaacgagatggcgttccgcgcggcggctcgcatcggcctgcgcaaggcatgcgccgatgccgacccggtggtgctggagcccatcgaggaaatcacggtgactatccccgagagctacgccggcgccgtgatgggcgacatctcggcatcgcgcggtcgcgtgacgggcatggagaccgatgagcgcggcgacaccgtggtcatcgcccaggcgccgctggccgagttgacggattactcgacgcgcctgcgctctatcacgcgcggcacgggtgactttaccatgaagcccgctggctatgagcaggttccctatgacgttcaggccaagctggtcgagcgctatgaggagggtcgcgccaagtagcgtgcgattttgcctgcaatgtaggtgctgacgaaagggccgccttgggtaacaggggcggccctttttggtccccggtgggttgcaaatcggttcttgtcgtggcttggggctagttccccgaggcctggttgcggccggtgacgtagtcgatctgaacgtgcggctgtaggttatagcagtacacgtggaagcacagggtcttgccgtggtcttcgaccgattgcgcctcaaggcgcacaccgcggcagacaagttcctcttcgttatacatgggcgtgacgcggtagagcacatggttgcccgtgtcgcggatgtagccgagaatctgctcctcaaacggcagcatgcccgtttcgttgagatagcgcgtgccggtgaggagatttttgcggttggcgttttcgccgcagagcgaccaggcgataaggtggcagcggttgtagaggctctggcccggaataaagtcgtagcgctgctggtgccaaccggcaggatggatacgcgagatatcgccgcgctcgccttgaccgagtgattcggggcccacgcaggcgagtgctttgcgggtgcggcccaggctgtcgagcttggagaacttcttaaagcagccctcttctgtagcgcgctcgtattcatcgagcgtgaatgatggtgtgccgagcgggtgggtgctatcggcgcgaagggcaacgtaggggttgccggcgtagtcgggaatgctgctgagataaacaccgcgggcgcggttgaggttggggttttccacctcgtcgatgggggcggtggagctgtcctcggcaacgttatcgttggtgttggtcgcggcggattcagggccatcgccagagtcgtggctattttgagagtccgaggaactcgctgttcccgattcgagccgggcgaccaggtccgcctcgtcgtcggtgcggctggggctctcgttttgtttttcggccagagccgccgcctgttcatcgctttgcggcgacagcagcttgggagctccgtcgagcgatcccgtaaacagcgcaaaccccagcaccacggcggtgccgatggaaagtacttgcttgtaggtggacttgcgcgacattgaggctcctggatggacggttgggaatctaccagtctagcaggtgccgtcgcgggtcattcgatcgaacaaatacttaagatttgggacaaacacttctgataactttgccccaaataaagttgcggtggaatagttcctgtttggccgtaaaaagccgttaaacaggaactatttcaccgcaacttagggatgttgggggtgctggtgggcttgttctgtgggctagattgaggtggagtcgagccagttgagcttgcactcgagaatgcgctgctcgccgggttcgctgcttccgtcaagtagggcgagcaacatctcggctgcttcgcgaccttcttggtcgacgggctcgatgatggtggagacggtcggtgtggtgagattagtccagtcttcgcagttgagtcccaaaagaccgatttgctgcggaagtagatgggccatgggctgaagcgccttgtagacgcgggggagcgcccattggttttggacaaagacgagcgtacgcttggcgggattgaacttaaatttaaagtattcggtgagctcgttgattgacggcttgttgtgatcgatgggaatcgctttgtagagctgcccattcgctgccagtgcctcggcatacccctgaaaacgctccatgcgggtgcgcatctcggtcatgttggcggcaatggaaaagaaatcttcgtagccggcgtcgaggagtgcctgtgtggcgttgtacacgccgtcgtaaaggttggttttgatccagctggtacctgggctatagatggccgcatcgaaaaagacgaccggcttgccggcgcgtctaatgcggtcgtgcacagctttgaaatttgccgtgggttggatgataaagccatcgacgcccagcgagagcatcttgtcgacgtacatgagctcggtctcggggttaaagttgctcgtgcaaacgaccgtctggtagcccgcggggagcatgacctgctccatgccattgagaacgagccccgcccatttgttggtgttatccaaaatgatgatggcgatgacgtgggtttgtttgccggtgagcgtttgcgcctgggcattgggaacgtatccgagttccttaatgacgcgcgcaatctttgcctgcgtcttttcgctaagtttttctcgtttgtcgttgaggtaatacgagacgcttgccgtcgaggttcccgcctctcgagcgacgtctgcgatcgtaacgcgctgttttgccacagcgactccttccgacagatgagcattttccaacatgatgactttgagtcttggtgagggatacgcttcggtgagcgaccctttcctttcatatgagtatgcaacaaatgaggtatacgggtggggtcgaaatttgtgaccggcatgcgcatctgccgtctaccgagaaaatcaaatacttcttgacttttgaaatcgagggtaaaatcgcaggatttatttttggttaaacgcataaccaaattgcataaccaacgctctgacctgcgcgtttaccgaaataagctggcattaagaaaaacgagcacctatattggtcttgtcgaaaagacagcaagtccaaacggcaggggatgctccggaggcctccgcaaacggtgtcttgcgcacgcaactctatgaaaagagggaagcaatgaagatcgtaggcgttgccgcctgtactgtgggtatcgcccacacgtatatggcccagaaggcgattcaggatgaatgcgccgcccgtggcatcgagtgcaaggtcgaggctcagggtggcctgggtatcgagaatgagctcacgcaggaagacgtggactccgccgacctagtcctggagtccgtcgacgtgggtgtcgagaacgaggaccgttttgagcagaagatggccgagggcaagttcctcaaggtcggtacttccgatgtgatcgccgatccggtcaagatcatcgaccaggctgttgagattatcaaggcgacgggtggcgccgttgacgcgcccaaggccgaggccaaggcagagaagaaggccgtctccgctgccccgcaggccccgacaccggcgtccaagcagtctatctttgccgatcctggcaagacgctgctcaatgcattcaataccggcgtttcctattttatccccattgtcgttatcggtggcgtgttcctcgccttctcgttggcatccggtaccgccggcgccaacggcatggaggttacgaacccgctgatggtgagtcttaacaccatcggcatggctggcatctccatgatgatcccggtgcttgcggcatacatcgcctactcgatggctggcaagcccgcgctcgcccccggttttgtcctgggctacctggtcaacaacgccgtcgttaccccgagtggcaacagcgtctcgaccggtttcttgggcgccatgatcatggcggtcatctgcggctactttgtccgctggatgaaaacctggaaggtcaacaacaccatccagaccatcatgcccatcctgatcatcccgattctgacctcgctcgtcctgggcatggcctacatctacatcctggccacgccgcttggctttgtgatggattggctcaccaacgtgctcggtagcctgcagggcggctccgcggttgtcctgggcctggtcattggcgttatgaccgctttcgatatgggtggccccatcaacaagaccgcctcgacctttaccatggccatcatggcctctggcatctatggccccaacggcatgttccgcgtcgccgtcgccattcccccgatcgcctgcggccttgctgcgctcatcgccaagaacaagttcgatgacgccgatcgccagatgggtatctccgcgctgttcatgggctgcatcggtattaccgagggcgctattcccttcgcggtcaaggaccttggccacaccctgcccggcatctgcatcggctctgccgtgggcgcggcgcttgccgccttccagggtatcgactgctacgttccgcacggtggctttatcgtcgccctggccacgaacaatgtcgcgctgttctgcctggacatcgtgatcggctccgtggtcgccgctgcaatcctgattgccatgaagcccacgctcgataagcaggccaagtaaacctttaaggactccggttgtgcggagggatggatttgactccgcgcaaccggccctaaacaacgaaatccatacgtactgaaagggtccgaacctggaccccagggaacttttgtcaaaaatccttaggagaaggagaacaaaatgtccaacctcaccatccgccaggccgttcagggcatgctcaagctgcaggacagcggcgaccacgcaactatggtcggcattggccccatgagccccaatctgatccaggccgtgttcgagcttgcccgcgacgaggacttcccgcccatgttcatcgccagccgcaaccaggtcgatatggacgagatgggcgccggctacgtcaacggttgggaccagacgcgctttgccgccgacatcaagaaggttgccgacgaggttggctacaccggtccgtactacctgtgccgcgatcacggcggtccgtggcagcgcgacgaggagcgtaacgcccacctgcccgaggacgaggccatggagctcgcccgcaagtcctttgtcgccgacatggaggcgggctttgacctgctgatggtcgaccccaccaaggacccctatcagatcggcaaggttattccgctcgacgtggtgcttcgccgcacgattgatcttatcgactaccttgagcagtaccgtcgcgagcataacctgcccgaggttgcctatgaggtcggtaccgaggagaccaatggcggcttgacctctaccgataagtacgaggagttcatttctcagctgcagcccgagctcgagaagcgcggctgccccatgcccacctttatcgtcggccagaccggtacgctcacccgttggaccgagcaggtcggccattacaacttcaagaatgcccgcgagctcgccgacatggctaagcgctacggcgtgggcctgaaggagcacaacgccgactatctggacgacgcgacgctgctcgagcacatcccggctcacgtgacggcctccaatgtcgcccctcagtacggcaccgaggagacccgcgcctacctcaagctctgcgctaccgagcagattctggtcgacaacggcctgtgcgacgatccctccgacttgtatcacacgctgctggtcaaggctatcaagaccgagcgctggcgcaagtggatgaccggcgacgacgttaacctgcaggttgatgacatcctggctgacgacgagctcagcctgaagattctggatgtctccggccactacgccttcaacgatcccgaggtcaaggagcaggtcgagaagctttaccgcaacctcgccgctcaggacatcgacggcaagcgctttgtgatcgagcacatcaagcgcccgatcaagcagtacgtcgtcggtcttaacctcaagggcgtcacgagccgcatcgaggccgctcttgccgagtaagtagcttttcctacgcgacgccgggcctggggcatgtcccagctgcaggcccggcacatgggacaaaggggcagtccctttgtcccattcttttgagttttagcttcctttgaaggggttcaccatgaagttctttatcgataccgccaacctggacgagatcgccgaggccaagagctggggttgcctggccggtgttaccaccaacccgtccctgtacgccaagaccggcggcaagcttgccgactttgagcctcatatgctcaagatcgccgagctctgcgagggtctgcccgtttccgccgagtctaccgctaccacggccgagggcatgatcgaggagggcaagcgccttgccgccctcgcccccaacatcgtggtcaagcttcccgtgtgcgaagccggccttgccgcctgccgtgcgctggccgatgccggcgtgcgcgtcaacatgacgctcgtcttttcgccgacgcaggcccttatggccgccaacgccggcgctcgctacatcagcccgttcgtcggtcgtttcgacgacatcgccgaggacggtatctcgcagctcgacaacgtcgtgacctgcattaagaactacgactggacgggcaagaacgtcgacgacaccgtcgagatcatcaccgcttcggttcgtacgcccaaccacgtgacccaggcagcgctgcttggcgccgacatcgcgaccgtgcccatggcagcccttaagaagtgcctgcaccatcccctgaccgatcagggcctcgcgagcttcgaggccgactggcagaaggtcgtcagcgcccagtaacgatggtttcgcctgcccggcatttgtccatgctgggcaggcgcgctcaagagaggaaatccccatgaccaatcaggagctggcgaaggttgccaacgaggtcaggaagggtgtcgtgacggcggtccatgcggccaagtcgggacatccgggcggatcgcttggcgctgccgacatcatgacctacctctactttgcggagatggatgtcgacccggcggatccacaccgcgccgaccgcgatcgcttcgtgctttctaagggccactgcgcccccgccctctacgccgtgcttgccgagcgcgggttctttggcaaggaagagctcgagacgctccgccatatcggcagccgtctgcagggtcaccccaatatgaacgacactccgggcgtcgacatgtccaccggctcgctcgggcagggcatttccgctgcggttggaatggcccttgccgccaagcactggggcgacagttaccgtgtctacacgctgctgggcgacggcgagtgcgaggaagggcaggtgtgggaagcggccatgtttgccggtaaccatgcgctcgacaaccttgtggcggtcgtcgaccacaacggcttgcagattgacggaacgatcgacgaggttaactcggcaatgccgctcgcagataagttccgcgcctttaagtggcacgtgatcgagctggccgacggcaacgacatggagcaggttgcggctgctttcgccgaggctcgcgaggtgagtggcgcacctgtggccatcatcgccgagacggtgaagggcaagggcgtctcctttatggagaaccaggtgggctggcatggcaaggcgcccaatgacgagcagttcgagcaggctatggccgagctcacggcagcaggggaggagctctaatggcagaggtcaaaaaagtcgccacgcgcgtaagctacggcgaggcgcttgtcgagctgggcaacgagcgcgatgacttcgtggttctcgatgccgacctggcggccgccacgcagaccggcaagtttaaggccgcccatcctgagcgcttctatgatgccggtatcgccgagagcaacctgatgggccttgccgccggcatcgcgactacgggccgcgttgccttcgcgagcacctttgccatgtttgccgctggtcgcgcctacgagcaggttcgcaactccatcggctacccgcatctcaacgtcaagatcggcgctacccacgcgggcatttcggtgggcgaggacggcgccacgcaccagtgctgcgaagacattgcgctcatgcgcacgattccgggcatgacggtgattgttcccgccgacgatgtcgaggcccgcgcctgcgtgcgcgccgcctatgagtttgaggggccggtctacatgcgcttcggccgcctggcgacgccggtcatcaacgaccgcgaggactatgagttcaagatcggtcgcggcgtagtcgtgcgcgaggggtccgatgtgaccatcgtcgcctgcggccttatggtcgccgaggcgctcgctgccgccgaggcgctcgcggcagatggcatcgatgccgaggtcattaacatgcacacaatcaagccgctcgacgaacgcctggttgtcgccagcgtaaggaagaccggtcgcgtggtcaccgccgaggagcattcgattatcggcggtcttggcgaggccgttgcctcggtgcttgccgagcagcatccggtgccgatgcgtcgcgtcggagtgcgcgatgtgtacggcgagtccggccccgcggtcgatttgctgcacaagtacggtttggatgccgatggcatcgaagccgcggtcaggtccgtgctgtaaggagggttttccatgggatttgtatctgctaaccaagtgacgattggctacgctgccgcctcgcgcgaggacgcgttgcattatctgtccgagcaagctgttgagcttggttttgccgacgacgcgtctgctgtagaggcggcttttattgctcgcgaaaacgaggccgagactggcctcgtcgccgggtttgctgttccgcatgccaaaagcgacgcgattcatacgccgggcgtggccgtgctcaagttggccgagcctgttgagtggccaagctttgatggtgtgcccgttgatgttgcgctcgcgctgtatgttcctgcgggcgaggctggaaccacgcatctgcgtctgctttccaaggctgccgtgatgctgatggacgctggtttccgcgacaaagtgcgcgaaagcaccgaccccgcagagattgccgagcttatcaacgccggactcgagggctagaacgggttctccgttccattaatcgatccttctccaaggaaaagggccgcgacgcttcatgccgtcgcggccctgtttgcgtttgcccaaataaacctgccaaaataaacgtatgggttacgccgttttacaaacggcgtaactgcttggcgctgcgcagactccgggcacggcaatctgacgttcaacttcacgggcgcgaccaaaaggtcagcgcccgcttgtttcacgtcaccttgccgcacccggagcctgctcgctcacttatgctcaacctgaattagctgatttaggacggggcttttttgactagttgggcaactaggctggagcaaatagtcaaaaagtcccgtccaaaaagaccgatctggtgtcgcgccacaaaaacggcctatctactacgtttgacccgcaccggtcgaccatggccgtgttttctgaaaatcggtaagccgtctacctgcggttttaatttcgtgtttttcggcatggtcgagggtggccagcgaaacgtagtaaataggtccatttcgtggcgagcagttcgattcacggttcaaggcaaccggcttcgaatgatcatttggaagttgcggtggaatagttcctggttagcgcaaaaagccgttattcaggaactatttcgccgcaacttattggggcgttgcctattgattcatcgcgccgtggatgtagggggtgacctcgggggagatgtgggcgcagcccagctctcgcagcgcggattcgatggcggcgggcagcggggtcttgccttcgtcgttgaccgcggcgccgccgagggcggcaatcttggcgacgtcggacggggcggcctcgatatgcatgcagccgccgaccaggcgcgcgcggacctgcgaaaggtcaagatcgtgcaggtaatcctcgcaggcgcgaatcaagtcgaccttttcgcgcgtaagctcctcgcccgtgggaatgcgcgtggcaaggcaggcgccggcaggcagattccaaacggggtagccccatgcgcgcagcagctcgcgctcctcgttcttggtaaagccgacctccataaggggtgagcgcacgccgagctcctcggcggcgcgcatgccggggcggtaatcgccacggtcgcttgcgttgctgccgtcgatgacggtggggaaacccagtgacttggcgtggttgacgatggcggtgaagccggcgcgcttgcagtgatagcagcggtcggcgtcgttgcaggcaacctgcggaagttggagctggtcaaccgaaagattaagcaccggaagcttaaaatgcgggccctcatcggcttgtccgtcaacagatcgctcaaacgaagcctgctcgggcgtgccgatgaacggcgtggtgagatggacgagaagggtgttagcgggcatgatgcgggagcaaacggcagccaaaaagctgctgtcgacgccgccggaaaagccgatggcgacgcgtccatatgccaaaagcagctcttcgagtgctgcgagtttgttctgaagctcctctgcgggtgcggtggtgtctgaaagcatgaaacgttccttacagttaaaagctcggacgaaactataatcctaccgagccgctcgccataagacatctatctatgtaacgaaagtgcaatatgtatatacgttatatacaagtttgtaaagtgcggtagagtagcggcaatgcaagccgatggggggaccgaaatgatcaaggctgtcatttttgatatggacggaacgctcgtggacaccgagcgcttgggtattaaggcgtggaaagcgggtgccgttgagctgggactcgcgattgatgaggcgctgattcatcagtttattggtcgcacgctgcccgatgtcatgggcattctcgaggagcattacggcagccacgaaactgccgacgcgctctatgttcgccacaaggagattcgcgacgagatggtcaagaccgagctggagcttaaggccggcgctgccgagtgcctggacgatcttttggctgcgggctatcacgtgggccttgcgacgtcttcgcgccacgttaccgccgagcgcaaccttaaggcgttcggtctctttgacaagtttgagaccgtgacttgcggcgaggacgtcgtgcacggcaagcccgatcccgagatgtatctgcttgcctgcaagcgcgcgggctttgcccccgaggagtgcgccgtggtcgaggattcgcgcaacggctgcgtctcgggtatcacggcgggctgccatgtctttgccgtgcccgatatcgtcccgctgccgcaggacgtggtggacggttgcgacgccgtgctcgacacgctgttcgatctgacggcggcggtcaaggccgtgcgctagcgctggcataccatctatttcaatttcattttaaaaggcggtcgtccgcgttatgcgggcggccgcctctctgtctgtgtggaagattctgacccagaactaccgttcaccggctagaaacaaccgctcgccggactgaaattgactcatattgaaattgaaacgattcaaataataatgaaaaccgtaaatgaaccgcttcaaaaaggggaaagcacatggagagtcgcatcgagtccaagcattacgcagcggtcgatatcggtgcttcgagcggtcgtgttcttgccggctgggtcgaggacggcaagatgtcctaccaggaggtctaccgcttcgttaacgagcaaaagcgcgttaacggacacgattgctgggatgtcgaggccctgttcgaccacgttgtcgcaggcctgcgtgccgttaaggaccagaccggacaggctcctgccactatcggtatcgatacctggggcgtcgactttgtgctgctcgacgagcataacgagatcgtcggcgacacggtcgcttaccgcgacgctcgtaccgacggcatctacgaggtcgccgaccagatcatggacccggctgaggtctatgcccgcaccggtattcagcgccagcccttcaacacgctctatcagctgcttgcccttaagaatgagcattccgagcagctcgaggccgcccgcaccttcctgatgattccggattacctcaactggcgcctgaccggcatcaaggccaacgagtacaccaacgcgagcaccaccggcatgctcgatgccgagaggtgcacgtgggacaccgagattcttgcgcgctttggcattccccagggcatcttcctggagcctaccatgcccggcgcggtgctcggcgagatcacggccgacatttccgagaagatcggctactccgcaaccgtcgtgctgcccgccacgcacgacaccggttccgcctttttggccgtgccagccaaggacgacaacgccgtctatatctcgagcggcacgtggagcctgctgggcgtcgagaaccagcacgccattaccaatgagctcgcccacaagcagaacttcaccaacgagggtggctatctcaagcgctaccgcttcctcaagaacatcatgggcttgtggatgaaccagtccgtccgtcgcgaggtcaacggcgtcgactacgtcgagggcaagacctcgcacaaggcgctcatggaccacaaggtcggttttgacgagctccgcacgctctgccgcgaggccgagcccttcgagtcctacgtcgatgtcgacgacgaccgcttcttggctcccgattccatgatccaggagatcaagcgcgcttgcgccgagggcggagagcctgtcccgcacaccgtgggcgagattatgcgcaccaattactgtagcctgtcccgttcgtatgccaaggctatcgaaggcctgcgcgagctttcgggtcacgattacacgagcatcaatatcgtgggcggcggctgccaggattactacctcaaccagatgacggccgacacctgcgggcttcccgtgttcgccggccccatcgagggcacctgcatcggcaactttatcgtgcagatgatcgccggcggcgacattgccgacctggccgatgcccgtgcctgcgtcgcgcgttccttcgatgtcaagcgcatcgaccccaagggcatccaggcctaaccgagaggggagatgcgcccctcgtcacgtacctacccccagccccgcggacggcaattgactcctgctgtacacgagcggctctctccgatgacatacggcgcggaggccctacacgacaccatgctccgcgccgccgtcaatcggcttatcacgttttttcaattgggcccgcgggccccggagaggagaaaaacaatggcaatggaagatctggcgttcatcaagggcttttgccgcctgtgcgacgatggctttaagcagggctggcacgagcgcaacggtggaaacctcacctatcgcatgaccgacgaggaggtcgccgaggccaagccgttctttgaggagccccgcgagtgggtcaagatgggcgtgcgcggcgagaacctcgctggccagtacttcgtgagcaccggctcgggcaagtacatgcgcaacgtcctggaggatccgcatgccaacatcggcatcgtcgagatcaacgagaccggcgacgcgttccgcatcgtctggggccttgccaatggcgcccgtccgaccagtgagttcgagagccactacatgaaccactgcgtggctgccgcccgtaccgatggcgccgaccgcgtaatctatcacgcccacacccccggcatcatcgagatgtccttcgtggtgccgctggaggatcgcgccttcacgcgcatcctgtggcagatgatgaccgagtgcgtcgtcgtcttcccggccggcgtgggcgttgtgccctggatggtcccgggtggcccggccatcgccgaggcgagctctgagctcatgaagacctacgacaccatcgtctgggctcaccacggcctgttcgccgccggccccgacttcgatacgacctttggcctggcgcacaccgtcgagaaagccgccgagatctacctggccgcacgcgctgccaacggtggctcggacgacttcctcaacaagatcagcgacaagggcctcaaggacacctgccgcgacttcaacatcaagatcaacgacgcatttgttgactaacaagaaagtgagacggcgcattggaggaaatcatgctcgttaacactaaggccaaggttggcgtcttctcgattgccctgggtgcctatcttccgcagttcccgcagctcgttcccaattttgagcagcagtacgaggactttaaggccacgctgcccacgaccgtcgagcttatcgacggcggtatggtgaccaccaaggagcaggctcaggtcgcgggcgacaagttccgtgccgaggatgtcgacctggtcatcctgcagatgctcacctatgccacgagctacaacgtgctgccggtcgtgcgtgacctggacgtgcccgtcgtcgtggtcaacgtgcagaagaaggctcagcccgattacgccaacaccgacattcccacgtggctgggcgacctgtacgcctgcggtgcccccggcgaggtcgtggccgaccttaaccgcgccggcaagcgtcacgccgtggtgaccggcgtcgtcgagggtggcgacccggctgtggccgagcagctcgagcagtggtgccgtgccgctcaggtgcgtcgtcgcctgcgccgcaccaacatcgcccagatcggccgtccgtacccgggcatgatggacctctacatcgacgagaccaacctctacaaccgtctgggcctctacaccaagcagttcgactgggagaagatgtgggccatcgccgacagcatcgacgaccagactgccgtggacgccaaggccgccgagattctcgacacctttgacgtcgagggcggtgccaaggtttccgacgaacccatccaggagatggccaagtacgttgtcgcctttgagcagtgggtcaaggacgaggagatcggcctggtcgccagccactacgacggctatgccaagggtcaggccggcgtgctcgactccatgctcatcccggcgttctccatgcttatcaagcagggcacgagctgcgcggtcgagggcgatatgaaggtcgccatcgccatgagcatcctcaagaccatctctggcaccggccagctctccgagatgtactccatcgacttccccgaggacatcgtcatcatcggccactccggctccggcgatgccgacatctcgaccgccaagaagccggcgctcagggttgtccccgtgttccacggcaagaccggcggcggctacctcacccagttctaccccggccacggcaccatcaccttcctgggcattacgcaggatggcgacggcaactttaagttcgtggttgccgagggcgagaacgtcgacggcccgatcttcacgttcggcgacaccaacatgcgcatgaagttctcgatcggcgcccgtgagttcatggaccgctggaacgagactggcccgacccaccacatggccgcctgcctgggcagccagaccgacacgatcctcaagggcgccaagattctgaacgtgccgtgcgaagttgtctgcaggtaatggctcagccgttcgcgggctgaaaacaaccgttcgcggagtcgtttgaaacgtttcattgcaagcggcggaattcgagtatcatagcaattaagaaaagctgcgccggagacaaggcgtcagtgggattgttattccagacggaagcatgaccggcacacagtgtgacagcacgctgtgtgccggtcttttttgttttcgccgcggctattctgagtacggcgtggtgcacaacgtcgtgccgaacagggcaaaaggcagcccgaagaacaggaggagtcatgatcgagctcatcgaatgcatcgaaaccctatcgggtggcgaggccaatatcagcgccctcaaagccactgaggacggcgttcgcgtgacggtcaaggaccgcagtgcggtcaagctccaagatatccgcgctcttccgggcgttgcttcggcaatctttacgtcttctgtcctgaaatgcacgtttacccaagaaaagggagggcacatgggccagtaccatgagcttgccggcgagattctcaagaacgtcggcggtatcgagaacgtcaagagcgttcgccattgcatcacgcgtctccgcttcgtcctcaaggacgagaagatcgccaatgacgacgtcatctccaacctcgatggtgttatccaggtcatgaaggccggcggccagtatcaggtcgttatcggagccgccgtggatgatgtctacgaagagctcgtctccggctacaaggtgcccggtgtgggcgctgtcgccgcaggtgatgagcctgaggaagccgaggacggcaagaacaagaacgtcttcaacatgctgatggacaccgtctcgggtagcatggctcctacgctcatgccgctcgccgcggccggtatgatcaagggcctgcttgccctttgcatcgccatgggctggctcgccgccgacagcggtacctatatgatctggtactccatcgctgacggcttcttctacttcctgcccatcatcctgggctacaccgccgccaagaagtttggctgcaacgagtttttgggtatggctctcggcgcggcgctcgtgtatccggccatggtcaacctgagcgcctcggcagaggttatgggcacgctcttcgagggtaccgcgttccagatgagctactacaacacgttcctgggcattccagtcatccttcccgcgtccggctacacctcgagcgtcatcccgattcttatcgccgtctgggcggcttccaagctcgagcgcagtcttaacaaggtcattccgcagctcatccgttccatgtccgtgccgttcctgtgctttgccgtcatggcccccgcgacctatctgatcatcggccctgtcgcctccatgatctcgggcgtgctgaccctcatcaccgaaacgctcatcaatatccccgtcgttggcggtgccgtggtcggtatggtcgtcggtggcgcgttctccacgctcgtcatgttcggcctgcactgggccatcatccccatcatgctcaacaacatcgccatgctaggttacgacccgcttatggcggccggttccatcggtggcttcgtaggtgtgtcccagggcttggcggtcatcctccgcaccaagagcgacaagacccgcaacgtcgccatcccggctacgatctcgcagttcttcggcgtcggcgagccgctgctctacggcatccagcttcccagcaagttcctgtttgtccagaacatcgtgttctctgcaatcgccggtctggtgatgggtgcccttaacgtccacgcctacagcatgggcagcgccggactcttcggtatccccacgttcatggaccccaccggtgccgacacgagcaatatcgtgttctacctgggcacgcttgccgtgatcatggtcatcgcctttgtcttcaccatggctacctatcatgacgacggcagctacctgggcaagtcccgcaacaaagagcaggcctaagcaactgcgcttttcatagttcccagccagtgcggcgatccaacgtggcgggtcgccgcaccgtaacttcccgaaaggtcggatccatgcagcctgatttgttcgacgcccgttggatttcgggtgagccgtttgtctatgagccggcggaatcgtattacgacgagtgtcaccgcaaccatgtcgtgcgcggcacgttcgatcttgagctggtgcccgcgtcggcggtgctcacgatcgccgtcttgggctacgcgcgcgtgcgcatcaacggcgtcaggatggatgcatcggagcttttgggatggtggaccaactacaccaaggtggtctattcgcacagcctcgaggtggcggacaagctggtcgtcggcaccaatacgatcgagatcgagctgggcaacggattcttcaatccctcgccgttgacgctctttggcaagtataacctgcgcgaacgtctggtcgaggtcgggaccccgcgcgctgcgtgcgcgattgtggcggccggcggccgcgtgctcgccaagaccgacgcgtcttggacggcgcatacaggcgagctgctgttcaacaacgtgtatctgggcgaggtgcgcgacttgcggccggtgcccggggatgcgttgccggtgacggtttatgacgaggtgcgggctatcgagccctcgccggtcgcgccgtgcgtgcgcgacacggtagtggagcccaaacggattttcgagcacgaggacgccgtcatcatcgactttggcgaggtcgttgccggattcatgaagctgagtgtggaagcagacgaggggcggcgcatcgagcttgtctatgccgagacgtggcgcgacgggggtccgtatgcgggcacggcagtggcgggttatgccggcatggagacgccgcgcggcgtgtgcccgggtggccctggtgctccggagcctgcggtacagcgcgacgtcgttgtgtgtcacgcgggtgaaaacgtgtttgaaaacgagttttgttggcattcgtttagatatgtgacgttaaccggatgcgatgtcgcggcgattcgctcggccagggcgacgtatgtccataccgacctcaagcgctgcggtaagctatcgctcggcaatgacgccttcgagcgacttcacgacgccgccattcgcaccaagctcaacaataatcacggtgtgttcgaggattgtgcgcgcgagcgttttggctacggcggcgacatgatcgcgcttgcggcctcgcagatgttctcgttcgatgtctccggccttctcgataagacgctcgcggacttcaaccgcgaccagaccgagtgcggcggttttcccgaaacggctcccttcatgggtatcggatccaatggtcctgcctatggagagggtccgctcatgtggcaatttgcccatccgtacctggcgattcaagccgaccgtatctacgggcgtcgcgatttactcgagcgtgagtggccggcgatcgagcgttttggcgactatctgatgggtttcgatccggcggagctggcaccgcactgcctgggtgaccacggcagcatgattgcgaagggtttctcgaacggttctcccgataaggagtttgtcggctggtgtgcgattctctggggtttgcgtttgacgagcgaggctgcggggcgtaagggcgcggacggcgtgcgttttgagcgtgctgcggaacaactgcgcgccgagatcattcggcgctttcgacatgccgacgggtcatttggcgacggaacgcagacgtcctgggcgtttgccgcggcacttgagcttggcgatcagctcgaacttgtcgagcgactggcgcgggcggtcgatgccgagcgggtgctaacgaccggcatcttcggcacggctttcgcctttgacctgctgtcgcgctgcggccgcaacgccgtgctcgagcgctggttgctgcgtgagcaggggccgagcttgctcagtatgctcgctgacggcaacagggcgcttatcgagatgttcgacgatccgctggcctcgtacgaccacgctatgttttcgagttacgaccagtggttctacgaggggctcggcggcattcacgtgagccgtgatgcgcgggggtgcgatggcgttacggtgcgtccgtatctgtcgcatgcgaccgatacgttcttgtgctcctggcagacggtgcgcggcgagatccgcgttgcttgggagcgcacgggcgctggggtcgcgattgatgtaacggtgccggaggacatcgaagccacggtggaggcgccgctcgagggcaccttgcttgagcgtgtgaccgatggctcgacaacgcatatggttgttgagcagctcgttcgttagaaatcctggggggagggactcatgaaatacccgcatctgttttcgcccatcaaactgggtgatgtgctcgtgcaaaaccgcatcgtcgccaatcctatgagcgagcattttgaggaccgttgtctgggcggcgccggtatcgtcatctgcgggcataccatcgtggagcccgggcgctcctcgtggatgagtgccgacgagccgtacgtcttttccaaatacgctcgcgaggaggctgtccgtcgtgctcgcatggcgcgccaggcgggcgccgtcgcgagcatcgagcttgcgcatgccggactttacgcccgcacgatcgactacgccatggggccggacgcctttgtgcgtgaggatggcgttgaggttcgcgcgatgacgcccgacatgatggggcgcacggctgcctgttgggcgcaagcgtgtgtcgatgctcgccgcgccggctttgacatggtgtttttgcactttggacacggttggcttattgaccagttcttgagccccctattcaaccatcgcaccgatgcatatggcggctctatcgagaatcgtatgcggtttccgttgcaggtgttgcgggcgtgtcgcgatgctgtgggaccgcgctttcccatggagatgcgcatctcggcggatgaatgtatgccgggaggcatcgagcttacggatgtcatcgcgttttgccgtgaggctgaacggtatgtgacgagtatccaagtctcgtgcgggctcgatatcgagcatgaggccaacgtccatacctctgccaccaacctcgatccgcacttacttaacgcgcatcttgctcgtgccatcaaggcggagatttcggtaccggtgacgctcgtaggctccgtcgagacgccggaggaggccgagcgcgcgatcgccgagggcacgtgcgacatggtggcgcttgcccgcgcgctcgccgccgatccgatgtggccggctaaggcccgcgcgggccgtgcggcggatatcgtgccgtgcctgcgctgtctgcagtgctatcacatctcgaccgatcgttggaacgtggggtgcagcgtcaacccgcgttttgccaacgagaattttattccgcgtgaggtagaacccgcgtctcgacgcaaacgggtgctggtcgtgggtgcgggtcctgccggttgtatggcggcgattgtggcacgcgagcgcggccatgaggtggttctcacggaacgcagcggttccgttggcggggcagtcaggcttatcgcacaagaagcgcataaggaggatgcggctcgctacctgcagtatttgcggcatcgtattgacacgctccggcagggggatgggttcgaactcagacttggttacgctgtcgatacggatatggtgcgcgcgatggcgcccgacgcccttatcgtagctatcggtgccgagcctttcgtgccgcctgtttccgggcttgatcgggctaccggcttcgcgagcgccatcgagcacccggacgcgttgggccagcgcgtggtgattgtgggcggtggcacgatcggtgcagagctcgcgctcgaactagccgagacgggccgcgatgtcacggtcgtcgagatgggcgatacgctggcagcgcagggtaactcgctctttcgcatcgtcttgcgccagatgttcgaaaagcacggtgagaacctccatgttatgcttaacacgatgtgtctcgctgctggggaaggtgtcgtgtgggtgtcggggcctgatggcggaaagcgcgagcttgcgtgcgatgacgtggtcgtggcgtcgggtgtacgctcgcggacggtggaggccgagtcgtttgtggggctcgcgccccagacgttcatcgtcggtgactgtcgccgtgcgcgcattatcaaagacgccgtgttcgagggctatagtgccgctgcgcatctgtagctgtcatagagcgcttctattaggaaggttgtttggcgatgtgggtcttaaagaagatcaacaacaactgcgcgcttgcccgcgatgcggatggacaggatcttgtcgtctttggcaaaggtatcgcataccgccgaccgccctacgagctcaaggacctgtcggtggtcgagcgtacgttctacggcgtgggcggtgcgtcgatcgctgcgctcaaagatatccccgaggatgtcctgttgcttgcggcggatatcatcgactatgcaagcgagcggcttgatgtcgagttcaatcccaacgcccctgtgacgctggccgatcatataaactttgccgtgcagcgcgtgagacaaagcgtggtgatcgagacgccgctttcgtttgacgtgatgcgcttgtatccgcatgaggttgcagtggccaagcgtgcggtgacacttaccaaaagcaggctgggcgtggagctgcctccggcggaagttaccaatatcgcgctgcacttgattgacggtgaggccgaacagagcaacatgcaggcgacggtcgaggcgacgcgtgtgctcgaggaggtcacgcgaatcgtctgcgagcatatcggagacgttgatacgggctctttcacctacgcgcgtttcgcaatgcacgtgcggtttctgctcgatcgcgtcaaagccggcggtgaggtggacgagggttttggcacgatgctccctgtgatgaaggatgcctatcccgaagcttatgcgtgtgcggcggacatccttgcgtatttcctagggtcgcacggttgggaatgcagcgagaacgaaacgctgtatctgcttatgcatgtacagcgcctgcgcgctagtatcgatggctaaaaaggtgtcggtctacctgcgcatacacgatatggggagttatatcggttcccgtttacacgaaatgggaagttacggattgggcactcgtcttcgtcgaagttcaactttgtacgaggctcgtctgacgtttgttagcaaaaccgctggcggaaagcccggcagaccgatcggtctgccgggctttccgcataaagtcgaaccgcagcgggcacagtcacgctacaagtacgcgccgaggttgatcgcggtagcgtcggtttgggtgtttgcctgggtgctggcgcgctccagcaggaacgggcgtacgagctcttggcggttgatgtcctcgacggctgtgaccgcggtgacggtgcgcgcggcggatccgatgcggatgtgcttggtttttgccggcgccttgttttcgatctgctccatgagcagttgaacgcccttgcggccgatttcgtagcccgggggcgccacggtggtgagcggaaccgctccactccaggcgagcgggttgccgtcgcagccggccacgcggacctgcccggggacggaaatgcccttgtcgaccagcgccgagatgacgcccgaggccaacacatcggtcagaccgacgacaaaatcggggcgctcggcggcggggcgctcggcgatttggctgccgatgccatagccgtctgccgcggtattccattcgccggcgtcgatgacttcgatcttgatatcggggcgcaaggcaagggccttgtgaatgccaagcacgcgtagggtgagctgcataaatgctgctcgacccacaacgacaatatggcgtgcgccgcgggcgatggcgagctcggcgatgatgcggccctgggcttcgttatcggccgccacgtagtagccgggctcggagcagtggatgtccaggtggacgatgggcacgggcatcttggccatggccgggcgccagtcgggggatgccatgggctgaaccatgacgccggacatctgcgtgcccataaagtagcgcaggtaatgatcctcgagaatatcgtcgttgtcggcattggcgatgagcagatcgtagccgtgcttgcgggcctcgttgtgggcgccgctggcaatttggagtgagaagccgtggtcgaggcgggggaggaccaggccaaaggacttggtggtgccgccggccagctgacgggcgctttggttgggcaggtagcccagacgattgatggtctcgttgatgagtttgagggtctcggggcgcagcttttcgggatggttgagcgcgttggaaaccgtgcccaacgaaaccccggcctcgcgcgcgacgtcgctgattttaacctttgccatagcggcccctttgatgcgtttcaagtacaagcctgattgtagcatcgtccgcccccggggcgtcaaaacctgccaattagggacaggtttattttggcaggttttatctggggaaacgccgccgtccaaaccaccacgaaggggacaggcacctttgtggtggtttggacgtgtgtgcatcgggtggtatctaagttgagataccacttctggtatatcagcttgcgtttgcgtgagtacaatactcgaacgttgtacgtctcagcgccccttgtgcgtggacgtcttgcagtcacgcggacgaagggatttatcctatgtgcggaattgtcggctacaccggctctgatattgcaaagaacatcctggtcacgggtcttaagcgtatggagtatcgcggctatgactcctcgggtgtcgcgctcgaggtgggcgagggcgccgcggcgcacctcgacgtcattcgccgcgtgggcaaagttgcgggcctggagagtgagctttccaacatcgacagcgacgctgcctgcggcatcggccacacccgctgggccactcatggcaagccttcggtcgttaacgcccatccccacaccagctgcgacggtcgtatcgccatcgttcacaacggcatcatcgagaacttcgccgagctgcgcgaagagctggagggccgcggccaccactttaagagcgagaccgataccgaggtcttcgcgcatctgatcgaagaggcttatgccgagacgcacgacctgatggcctccgtgcgcgaggcctgcacccacgtggtcggtgcctatggtctggccgccgtgtgcgctgacgagcccggcgtgatcgccgtggcccgcaaggattccccgatcgtagtcggcgtgggcgaaaccggctcctatgttgcttccgatgtcatcgcgctcatcgacgccacccgcgatgtcgtggtgctcgaggacggtcagtttgctaagctcacgcccgcaggcgtcgagtacaccgacgaggccggcaacgttatcgagcccaaggtcacccacatcgactgggacctggacatggcagaaaagggcggttatcccgactttatgctcaaggagattcacgagcagccgcgcgtcgtgcgcgacacgctggttggtcgcatgacgccggccggcgagctcgatatcgacgagctgggcctttcgctcgaggaactcaacgacatcgaccgcgtctacgtgatcgcttgcggcaccagctatcacgctggcctcattgccaagaatctcattgagggctgggctcgcatccccaccgaggtggaggcggccagcgagttccgctatcgcaaccccatcatcacgccgacgacgctcgtcgtggccgtgtcccagtcgggcgagacggccgacactctcgccgctatccgcgacgcgcgcatcaagggcgccaaggtcttcggcatcaccaacgtggtgggcagccccgtggcgcgtgagagcgacggcgtcatctacaccaaggccaacaaggagatcgcggtcgcctcgaccaagagcttcatcggccaggttgtgagcctgacgctgctggccctgctgctggcgcaggtcaagtaccgcctgaccaccaaacaggcacgcatgctgttccgcgagctttccgatactgccgagcagatccagtggattttggacacgcagaccgatgccgtgcatgaggctgccctgctgtgcaaggatgcgcagtcggcgctgttcgtgggccgcggcatgggtgccgctatttcctacgagggtgcgctcaagctcaaggaggtcagctacctgcacgccgaggcctacgccgccggcgagatgaagcacggccccattgccctgatcgacccgggcttccctgtcatcgctgtggccaccaagagtgccacctacgacaagaccgtgtcgaaccttatggagtgcaaggcgcgcggtgccaaggtcatcgtcgttgccaccgagggcgacgaggagatcaacaagattgccgactgcatcatccgcgtgccggcagtccgcgacgtgttcagccccatcacggcgagtgtcccgctgcagctgctcgcccgcgaggtcgccatcctgcgcggctgcgacgtcgaccagccccgcaacctggcgaaaagcgttactgtcgagtaatcgagttccgtcatcctaacaactaaggcccggctccgttgcagcggagccgggccttgttgcatttgcccagataaaatctgccaaaatgaacctgtccctttttggcaggttagcggagcttgctggtctcgaagtactcggggaactggtccagaacctcggtttggttgcggaacatcatgtgcaggtgcttgctgaccaaaaagctcgcttcgatggggtcgcgaccggcgatggcgcggcgaatctgcttgtgctcgttcacgatgtcctgattgtcgagaacctgcgtggcggcgcgcagccagcggaagcgctccaggtcggcattggtctcttcgagccacgaccacacggtgctgcgacatgcgatgctaaaaatcatgtgatgcatgaggttgtcgctcaaaaagaagccgatgcgatcctcttcggccatggctttttcctgcagcacgatggcgcggtcgagctgctcgatgccggccgacgtggctcgcgcacagcactccacgatcacctgcttttccagatgctcgcggatgtaacaggcactctcggcaagggtgaggttgatgggcgagacataggtgccgctctggggcacggtgcgcaccagaccttcctgcgccaaacgaaccaaagcctcgcgcacaggggtgcgccccatatctaggtcgtcgcaaagttgcttgacgcccagcttttcgcccggcttgtagtccaggtagacgattttgcgtcgaatggtgtggtaggactggtcctgtaggctcgtttcctgctcgccgacgtgcatcgattcttccatagcgcctcgcaactgttctatcaaactcatatgtcagttgttaattatgccgcgaatcagctctccgcggtgggcaattcggctgttgcctgagaactattgcggcatcttagtctgtgtttgcgcaaggctgtgctcaatgttgccgtatcataagccgtcgcaaacgtgaaatagaaagaaggaatcccatatgcaactggcaaatatcgttcgcgagcgctggaaaggcgtcttgttctgcctgatcattgccattcccgcgacgttgctcggcaaacaaattgaggtggtcggcggtccggtatttgccatcctctttggcatggtcctggcgctcgtctttcccaggaagcgtcgcgaacagctcgccgccggcgtcacctatacgtccaaaaaagtcttgcagtacgcggttatcctgcttggctttggcatgaacctctcccagattctgtccaagggcgcccagtcgctgccgattatcgtggcgacgatctcgacctcgcttgtcatcgcctttgtgctctgccgcgtcatgaacgtaccgggtaagatcgcgacgcttgtgggtgtgggttcgtcgatttgcggcggttcggccatcgctgcgaccgcgcccgtcatcgatgccgacgatcgcgagattgcccaggccatttcggtcatcttcctgtttaacgttatcgcggcgctcgtgtttccgacgctcggcggcatgctcgggctgaccaacgagggctttggcctgtttgccggcaccgccatcaacgacacctcgtcggtaacggctgcggcgagcgcctgggacagcatgcatcccggcgccaatgtgctcgagagcgccacagtggtcaagctcaccaggacgctggccattattcccatcacgctggtcctcgcatgctggcagatgcatctggcacgcaaggccggcggtgacgccaaaagcacgttctcgcttaaacgtgcgtttcccatgtttgtgctgttctttgtgctggcgagcgtgatcaccacggtgcttcagcttcccgcgtccatcacggcgcccatcaaggagctgtcgaagttctttattgtgatggccatggcggctattggttttaataccgatatcgtcgagctggtcaaaaagggcggcaagcccatcgcgttgggcttttgctgctggattggcattgcgtgcatgagtttgggaatgcagcacgtgctgggaatctggtagagaagtagcttattcgcgtgctggctgccggtgagcgcaagccttcggtggagcgataggagctcttgcgggtatggcttgtccgcaggtttataagtcccgaagagctcttatcgccccgccaggatggcgatgcggggcaacacctatactcgcaggacggcgctttctgccctatagtgtttggtgagcaatatcgttcaattttgaaacactcggtcgtgcgaccgtcggcggttgcacgtcgccgcggacaggggcaaatcatggatagcaatgctaagctgaacatcttgaccgatgccctagctgctgccggggcctcggcattggcaatcgatgcgcgtggggacgtcgcgatctcgaccatgaatgacgcggcgcttgagcgggatgtggcggcttttgtcgctgagcgtctcgaccgtataggagacggcgcgcgtctggttatggggcgtgagggtacgcgcctgagcctgaccgttcgccccaccgacaaagagggcgggaggctttgggtcgttgtggtccgcgaggtgcgcggtgccgcggcgcatgcgggcatcgagtggctcaacgccgacgaagttgaggtccgctatgaatcgagcgcgtacggcatcgttgagggggcggcctcggtggctgtaccggttaccgagagctatgcgcgcggcgtgccccttatgctcgagggcgagctgggagcgggtcaggtcgagattgccaagcgcctctatctggatggcccttttgtcgatcagccctttgtttccgtcgcgctcgatgaactcaccgatcgcggttggcgccatgtgctcaaaagctccgaatcgccgctgttccaaacggggctgaccctttgcattgagggctggaatgcggttggcccccagcgcctccgcgagctggtctccacgatgaccgacaccgcgttggcgacgcgctgccatgtggtgctgacggcgaatgacatgccgggcggcggcgaaagtgatcaagccgcctttgtgaccgagcgcttcgcctgtgcggtgagcgtcgcgccggcaatcgccgagcagggagccgcgtcgacgaaggtcgcgcgctatttggaatatctcgctgatgcatttgggacggcagcgcccacgctgtctgccgcggcgacgaagacgctcgatgcttaccgctggccgcgcaactatctgcagctccgcgaggtctcggaacgactgtatatattggtggggacgggcacggtggaccgcgctgtggcggaggaagtgttcgcccaagaggacgtgattaagaccgcaacctttggcgccccgacgcttgaaagtgacctgtatatcctgcgaccgctggccgataccgagcgagatatcgcgcatctggttgtagaccatctccacggcaaccgaacccgtgcggcggaggtgctgggcataagccgtacaacgctgtggcgcttgctgaaggacgatgaccgttgagcgaggcgcccgtgaccgcacgcgacgcgtgtgctacagtccaaagcgttattgtttcgatttggttacggcgtgcgagggcatatggctgagacttcaaaaccgagccgcagaaggcggagtgccgcgccggtcaaccgacgcacaacatcggtgacgtggggcaaacacgcctcggggtttgatagctcgttcaagcgcactaaatacggctatccttcggcaagcgcccgcttggcaatgcaggcagagtcctcgctgtggggccgcaaacgcgtggtgggctcaaagctcaagcacgacggaacgctcggctacatcagccgcggggcggctcgccgcagcgggctcaatcccgccggctggcatcgctacgtgccgatcgtggccgccgttgcagtgatcgtcatcgcgctcgctgcgctcggatatgccggcggtggcgccaacttggacgcaatgtttaaatcgcccgagctcgcgcatgtaggtacagaagttgtcgagggcgctcaggcccagacgagcgtcgcgccccagcgcggtatcgttgcggcggcctccaccatcgccgatgtgcaaaaggacgaagacaagcaaggcgacgacgtcgatgcgaatcagacgagcgaaacggcaataactccatcggcgggataagttgcgagtggggcagctaatttgggacggggcttttttagctgcccaagacagtggctcattcgatgtcagtcgccaaaagcgagcgagccgcatttgcgccaaggtgacgtgaaatgagagggcgctgaccttctggtcgcgccctcgaaattgaacgtcagattggcgtgaatgcggcccgcgcagcgtcaacgagcccgccgttcggtagaatggcggaactaattaccttacgtagaccacgttgtcgcggcggggtttgggctcgggcagcgtgtcctcggcatagcccagaatgcagtgaccgacaccgcgcaggctgccgtcggcgggtagaccccaactggccagtagctccaggccctcgggcgaatcgaaaacctcgtgggcgcgatgaatccagcacgaatcaacgcccagcgcataggcagcgttgagcaggttgcccatggcgagcgagccgtcttccagatgtgtgggcacgctgcggtcaaccagcaccaccacaacggtcttggcgccatagaaggggtcgctgttgctgcccatgacttgcgcgttgagctgcgagagacgctcgacggtcgcggggtcggtgacggcgacaaacgtcaccggctggcggcccatgccgctcggtgcatattggccggcttcgataatacgtgcaagtttttcggcctcgacgggacgatcgctgtagttgcggcagctgcggcggtgaatgagtgcttcgatagtctccatggtgtctccttgcggtggcgttgcagatgccccgttcatacccgtcgggctcaaacgatagacggtcaattgcccggccaaaaggatagattccaattgggaaagtaggtttgcataaaagtaccttcagaatgtgacaaacaaatgggatggttaaacgttttatcccgtctaccctgcggttttttaccacttgcctaaatgacgaacgcataacctctgataagggttttactaaaggagtaccaacgtttatcaatgcgccgtggtggcgccgggccaggaggtaacatcatgttccaggctggagatgtcgtcgagaccgatttcgtaggatttctgaagctgctgcgttccaagacgcgcgctttcgtgtcgatcaacgatcacgagtactacatcacgcacaccgatggctattggcgtgttcaggattgcgaggccctcaacgacaagggccactttactgactgttctgagttggtcaacacggtctgcgaggtcgtcgagctgccgtggattgccggcaagagcctgcatgacagcttctcgggcgctacggtctatgaggccgtcgccgcttaacaggcaataaaacccgattttcacgtgaccgctggcgccgcccccgcgccggcggtctttttctgccgataggccataaaaatgcacgcatttgcggagagcctgttgacgatagtcaaaactcggactaatctagagacacataattggtcaaaaatcggacaattgaatggtgggatagatgaatagtgcggttacgctggtcgacttcgatcggttgctcaatggactcgaccatatctattcggagttctcgcgcgcctgcggcctttcggactgcgcctactggatgctcgtcgacacgagtgcagcgggcggaagcgttgccgtgagtcggctgacgagtgaatggttctacagcaaacagaccatcaattcggcgattaaaacgcttagggcgcgagggcttgcgacgttggagtttgccgagggcagtcgtaaaaacaaggttgtacgactgaccgaagaaggcgtgcggtttgccaagcgctacgcgttgccggcgcaaaaagccgagcaacaggcattcgaggcgctcgagccgtgggaacagtgcgagatcatgcgcttggtcggtaagttctcccatgttcttaacgaagagtgcgaggcatttaaacggcaagtggccgccgagaacgagactgacgataagggcgagggggacgcatgcgactcttaatgaggtttatgaggccgtaccgcggtctgattgcggtgacgctgtttgcggtgctgatagataacgtcggtacgctgttggttcccacgatgctggcgaacatggtcaacaccggtattaccacgggtgatgtcgactatatattacgcaacggcctgtacatgcttatcgcgaccggcatggccagcggcggcacggtgctgggctgctatctttcggcgcgcctggccgccaacgtggcctgcgatatccgcaatgccgtgtacgacaagtcgctcgagctgtccgccagcgactttgagcgctttggcacgggttcgatgatcacgcgctcgctcaacgacatcaacgtgattcagcaagctgtccttcagacgattcagctggtgctgccggtgccgttcttggccgtggcaggcatcatttttgcttggttcatcgatcccgccatgggtacgctgctgggcgtgatggttgcgatcgtgctggtggcggcggtctttaccgttgccaacgccgcgccgatctttatgcgcctgcagagctttatcgaccgcatgaacgtggtgctgcgcgagaacatcgtgggcgtgcgcgtcatccgcgcatttaacaaggagcgccacgaggagcagcgcctggacgaggtgtttagcgattacgcggccaatgccatcaaggtcaaccacctgtttgtgggtctcgacagctccagcttctttttgatgaatatcgccgaggtggcggtgctgtgggtgggcggcgaccgcgtgggcgtccacgccatgcaaatcggtagcatctcggccgtgctggagtacgcgatcctgatcctgttctttgtgatgacggcgcagatggtgattctgacgctcccacgcgccgccgcatgcctgaaccgtgcgcagcaggtgttggagattgagccgagcatcgtggacggcaagcgcacgctggacacgtgcgcggcggagtctgttgacggtgccgacgcggtggccgtgttcgaccacatgtcgttccgttttgacgatgccgacgaggataccctgtgcgacctgagctttgcctgtcgccgtagccagaccacggcgattgtaggctcgacgggttcgggcaagtcgacggtggccaagctcttgcttcgcttccacgatgccacgaagggcgccattcgcctgaatggcatcgatctgcgcgacctttcgcaagacgacatccgcgggcgtatcgcctatgtgccgcagaaggcatggctgttctcgggtacggtggcgagcaacctgcgctttggcaacgaagacgcgactgaggctgacatgctccatgcgctggaggttgcccagagcacctttgtgctcgaccagccccaggggctcgatacgccggtggcccagggcggcacgaacttctcgggtggtcagcgccagcgcctggcgattgcccgcgcactcatgaagcatgccgatctatatatcttcgacgacagtttttcggccctggactttaagaccgatgcggcactgcgccatgcgctgcaggacgagacgtgcgatgccgcggtgctcatcatcgcccagcgcatctcgactattttgcatgccgatcagatcgtggtgctcaaagacggcgagatcgtgggcctaggcacgcacgacgagctcatggaaacctgcgaggtgtaccgcgcaatcgcggaatcgcagatgaagggaggtgagtagcatgaccgaggagctcaagaagcagggcatcgtcgatggcgctgcggttgtagagacagtcgaggagacgggcgtcgcgcccgacctggacgaagccgccaaggcggcggagcgcgaggctcgccgccaagcgctctacgaggaaaacgaacgtgccgaggacgagcgcgcccgcgccgaggcagagcgtatgcgcgacgtggacgacgaagacgaggacgagacgcctcgggatacctgggcgacggtgcgccgcctgtggagtgaggctgccggcgaccattggcgcttctatatcgtgttcgcgagcattgtgttctatgtcatctttaacaccgccgcgccggcatatagcgcccgcgtgatcgatgagctgtggggccacattcaggtggcgtttgccaacgacaccactttcagcatcacctgggagaactgcggcaagaccattttcgtctactttatgatctggactgccgctgcctcgttctatgcgctccagagctttttgatgtcgagcgtcgctgagcgtctcaatctgcgcctgcgcaaccgcatcgcgcaaaagctcaaccgtctgccgctcgcctattttgacgcgcatcgtcccggcgaggtcgtcagccgcgcgaccaacgacctggacaagatgtccgagagcatgcagcgcggattgctgcagctgctcgtgtcgatcggcacggttgttggtgctgtgagcgtgatgttcgtgttcagcgtgcagcttacgctcgtctttctgttctttacggcactgtcgctgctggtgacgaaggtcgtctcgcgccgcacacacgatgtgacgggcgagcgccaggagtgggtgtccaagattacgagtgcggtcgaggaaggctattcgggccgtctggtgatccgcgcgtttaaccgcgaacgccaaagttctgccgaggtgcaccaggcctcgggcgagctggcacgcgtgagtgccaaggccgactttatgatcaatgccgtcggccctgcggtgcgctttatcggccgtttggcgcagatcgtgatcgcgctggtgggctgcagcatgctggttgccggtcacatgaccgtcggcgtgttccaggcgttcttccagtttatctacgaggcgtccgaacccatgacgcagctgtcgtttaccttcaactcgctgcagagcgcgttggcgagtgcggagcgcgtgttcgacctgctcgatgagcccgagatggaggccgatccgctgccggacgaggccgccaagctgccgggtcgcgttgagggtcgcgtctcctttgagcacgtgcgctttggttattcgcccgacaagccgcttatgcacgacgtgtcgtttaccgccgagccgggccagaagattgccgtggtgggaaccacgggcgcgggcaagacgacgctcatcaacctgctcatgcgcttctacgagattgacggcgggcgtattacgctcgacggcgtggatacgagccgcatggaccgcggcgagctacggcagcagtttggcatggtgctgcaggacgcctggctgttcgatggcacgattgccgaaaacatcgcctacggctgtcccgaggcgacgcgtgaggagatcgtggcggctgcgcgcgccgcgcaggtcgacttctttgtgcgcaccatgccgcagggctatgacacgcgcgtggccaacgatgccgaaagcatcagccagggccagcgtcagctgctgaccatcgcacgcgtgctgctcaataacccggcgattctcatcctggacgaggcgacctcaagcgtggatacgcgtaccgagcttgccatcggtcgtgccatggacgcgctcatgcgcgggcgcacgagctttgtgatcgcgcaccgcctgtcgacgatcgtggacgccgacctgatcttggtcatggatcacggcaacattatcgagcagggcacgcataaggagctgctggctgccgagggtgcctacgccgacctctatctgagccagttcgcataatgtgacaaagggacagtctctttgccacatcacaaataaggcgcgccggggatgaattccctggcgcgcctttgcgttgatgccgatgtcgttttgtgccgcttgcgttcctagcgttcgtccacgagcttggcgacgagggccttgagctcggccacctctcgctcgagttccttgacgcggcgggcattctcggtgatgccctggcggttgagggcggactgctcggcggcgtcatcgggcatgtactcgcgatgctgcttggcgtcgaaactctcctcgaacacacggcagccgttgcgcttgatgatgcgtcccggcacgcccacgacggtgcagttgtcggggacgtccttaacgacgaccgagttgccgccgatcttgacgttgttgccgatgcagatgttgccgagcaccttggcgcccgtgcccacggtgacgttatcgccgagcgttgggtggcgtttgccggtctcgttgccggtaccgccgagcgtgacgccctggtagagcacgcagttgtcgcccacgatggtggtctcgccgatgacgacgcccatggcatggtcgataaagaagtgcttgccgatctgtgcggcgggatgaatctcgacgccggtgatgtggcgggtgatttgcgagagcacgcgggcgagcgagcgatgaccgtgctcccagagccagtgctcgggtacgtggttccacttggcgtgaagaccggggtacgaaaggaaaatgaccaggccgttttgcgcggcggggtcctgcgcctggacggtcttgatgtcctcgcgaatggtattgataaagctcaccggccgccctcccttagcgccatggcaatgcgattcaataaagtatagcgattcgctagggattaggaagagcaatctttcacggctttgcgtgacaggtgtcagttatgcaaacttgctggtaatggagtcatgcttttgtgcggtcgtgtgcatggtcgcgccacaaccgtatactggtcaacttggacgtgtccgcgcccacaactgagaggttttacttcatgggtttcatcaattttatcgccgagctgctcaaagacccgcgcaccgcgattgctagctggattgccgccggcccgcttatggcctacggctgcgtgttcctgattatctttatcgagacgggcgtggtgttcttcccgttccttcccggcgattcgctgctgttcgcctcgggcttttttgcccacaacggcggctttaacatcgtggctttgctggccgttgcatgggccgctgccatcttgggcgatcagtgcaactttatgatcggccatttctttggcaaaaagattatcgcttcgggcaaggtcaaggccatgacgcccgagcgcatcaaaaagtccgaggacttcttggataagtggggccacctggccatcttcctgggccgcttctttccgtttatccgcacctttgtgccctttatcgccggcatgggcggcatgcactggcgcaactttgtcatttttaacgtgctgggcggcattacctggtcgacgctctttacgctgctgggctacttctttggcggcattccctttgtgcaggagcactttgagctgctaatcgttggcatcgttgccgtgtcgatcatcccgaccgtggtcggtttggttaaggctaagctgggcaaaaagaacgcgtagatcgagccggcgcgtaagccgtgcagttgaggcccgtcaccgcttacggtggcgggcctttttgcttcggtcaaatgaaaatactttagttagttaaagaaaagcgttttatccgacgcgcgtgcggagtacaatctcgtgcatgcgaatcgacgtgccattggctttgatgtcgcccgcgtgtcccgtccggctctacgctccgggcgtgcgacgttgcgacgcggtcggcctcggtccttgcgtgcgggttcgcgagtatgcaactgtgtatgtaaggagcgacatatgactgtcgagaagaaggatatcgattggggtagcctcggctttggctacatgaagaccgattacagctacgaggcccattggaaggatggcgagtgggacgagggcggcctgaccaccgaccacaccctgcatgtctccgagtgcggtggcatcttccattactgccaggaggtctttgagggcctgaaggcctacaccgccgaggatggcagcatcgtctgcttccgtcccgacatgaacgccgagcgtatgtacaactctgcgcagcgcctcgagatgcccccgttccccaaggacaagttcgttgaggccgtcaagcaggtcgtttctgccaacgccgcctgggttccgcccttcggttccggcgcaaccctgtacgtgcgtccgtttatgatcggctccggtgacgtgatcggcgtggctcccgctcctgagtacacgttccgtattctcgtgaccccggtcggtccgtactttaagggtggtctcaagcccgtcaagctgcgcgtttccgagtacgaccgcgccgcaccgcacggcaccggcaacatcaaggccggcctgaactacgccatgtccctcaagcccacgatggaggcccatcgcgagggctatgccgagaacctgtatctcgactccgagtcccgcacctatgtcgaggagaccggtggcgctaacgtcctgttcgtgaaggaggatggcaccctcgtcgttccgcagtcgcacaccgactccatcctgccctccatcacccgtcgctcgctcgttcaggttgctcaggacctgggcataaccgtcgaccagcgccccgtcgagtgggccgaggtcaaggccggcacctttgtggagtgcggcctgtgcggcaccgccgccgtcatctccccggtgggcgagatcgacaataaggtttatggtgccgatgagatcgtgaccttcccggctggctacaccgagatcggccctgtgatgaagaagctccgcgagaccctgactggtatccagtctggtgctgtcgaggataagcacaactgggtttacaccgtggcgtaagctgccatagctgttcggcccgagggcaaccttcctttccggcgcgtcctcgggcctgtgtcaccctggcgctgccgtacgggcaatgattaatctgaacaaagatggtgcgcggccttttaggctgcgcatttgtttcaagactttagtctgctggccgcgcagcggccagctttaaaccacccgctacgcgggtggagacaaacggctttatcctgctcgcacggagagcacattaagtgctctccggctcgtgcggaactcgcgacggagcaaagtcctccgtccgcctcctatggttacttgcttgccgggtgctcaacctcacgctgcttggtacaagtgatctatctgaaatatctacctgtaggtaaacccttgtagaaaggttgactgttatgactaaagaactcgattttgatgccattaaggctgctgctgagtcccatcgtgctgatatgactcgcttcctgcgcgctatgatctctcacccctctgagtcctgcgaggagggtgaggttgttgcctgcatcaaggccgagatggagagccttggttatgacgaggtcaaggtcgacggcctgggcaacgttatgggctttatgggcgagggcgacaagatcatcgccatcgactcccacatcgacaccgtcggtatcggcaacatcgagaactgggatgccgatccctatgagggctacgagaccgacgagatcatctacggccgcggcggctccgaccaggagggtggcatggcttctgctacctacgctgccaagatgatgaaggacatgggcctcatccccgagggctacaagatcatggtcgtcggcaccgtccaggaagaggactgcgacggcatgtgctggcagtacatctacaacaaggacggcattaagcccgagttcgtcatttccaccgagcccaccgacggcggcatctatcgtggtcaccgcggccgtatggagatccgcgtcgacgttcacggcacctcctgccacggctccgctcccgaccgcggcgacaacgccatttacaaaatggccgacatcatcgccgacgtccgcgccctcaacaacaacggctgcgacgagtcgaccgacatcaagggcctcgtcaagatgctcgaccccaagtacaaccccgagcacttcgaggatgcccgcttcctgggccgcggcacctgcaccgtcagccagatcttctacaccagccccagccgctgcgctgtcgctgactcctgcgccatctccatcgaccgtcgcatgaccgccggcgagacctgggagtcctgcctggacgagatccgcaacctgccggccgccaagaagtacggcgacgacgtgaaggtctccatgtacatgtacgaccgtccgtcctggaccggcgaggtttacgagaccgaggcttacttccccacgtggatcaacaaggagaccgctccgcacgtcaaggccctcgtcgacgcccacaaggccatgttcggtgacgagcgcatcggctgcgagcccagcatggataagcgcaccggtcgtccgctgtgcgacaagtggaccttctccacgaactgcgtttccatccagggccgctatggcatcccctgcgtcggctttggcccgggtgccgagtctcaggctcacgctcccaacgaggtcacctacaaggacgacctggtcaccgctgccgccatgtatgtggctgccctgaacctctacgatccgagccaggccgatggcgacgccaccgtgttccgcgccggtctgaccaacaacaagatcgattagtcccattcctcgatcttgttgagccggggacagctcgtgtccccggcaccccctgttgacttggggcccgcggtcgttatctcccatgcttcctcaacggtagcgggtcctcgttatagtgctctgcatgttctagccacacgcgcatgccggagcacatctactcattgcaatcgtttcatctttggaaaggatatttacatggacgccaagtttaccgagctcgtcgagcagctgaacggcctcgattttaagggcatgtacggcagcgacttcctgcacacctgggataagaccaccgatgagctcaaggcgctctacatcgtcgccgacgccctgcgcgagctgcgcgagaacaacgtttcgtccaagatcttcgattcgggtctggccgtctccctgttccgtgacaactccacccgtacgcgcttctccttctctaaggcagccaacctgctcggtcttgagctgcaggacctggacgagaagaagtcccagatcgctcacggcgagaccgtccgcgagaccgctaccatgatctccttcatggccgacgtcatcggcatccgcgacgacatgtacatcggcaagggcgacgcctacatggctgaggtctccgagtctgtccagcaggcctacgaggacggcgttctggatcaccgtcccacgctcatctccctgcagtccgactccgatcaccccacgcagtcctctgccgacatgctctacctcatcaacgagtttggcggtcttgagaacctcaagggcaagaaggttgccgtcacctgggcctactcgccctcttacggcaagccgctgtcctgcccgcagtcgctgatcagcctgctgccccgttttggcatggacgtcaccttggcccaccccgagggctacgacctcatgcccgaggtcgtcgagcgcgccaagggttatgccgccgagtccggcaccacctttaagcaggtcaacaccatggccgaggccttcgagggcgccgacatcgtgatcccgaagagctgggctccgtttgccgccatggagaagcgcaccaacctgtacgccgagggcgacgacgccggcatcgctgcactcgagaaggagctgctcgctcagaacgccacgcatcaggattggtgctccacgaccgagctcatggagaagaccgccaacggccaggacaccatctttatgcatccgctgcccgccgacatctccggtgtctcttgcgagcacggcgaggtcaacgccgacgtcttcgacatgcaccgcgtgggcatgtacaaggaggccagctacaagccgtacgccatcgcagccatgatgttcctgcagaaggttgccgatcccgccgctaccctcaaggccctcgacgagcgcaacaccgcccgttggttccaggcctaaagctgggttgaggtaagccatgtaaagggggcgctctgccaaccggcggggtgcccctttttgcatcgtgggcgtgcgggataagcgctttcgatgtagatgccccgcgacgcgagttatgggtacgatggtttcaggggaggtatcgccatgaaacttggttgcgtcattatggcttcgggcgagggcaagcgatttggctccaacaagatgctcgccgatatctatggcgagccgctgattgcccggaccattgattcggttccccggggctttgacgttgtggtttcgacgcgttggcccgaggtcgctcagatttgtgatgacaagcattgcccgtgcgtgctgcacgatggcgagctgcgcagcgaaagcgtccgtgcgggcctttcgtggggagtcgaacgtaactggaaaggttgcctcttttttccgggcgaccagccgctcgtgagttcggattcttttgaggctatggttcgtgcatttgacgagcgtggccgcaagcatccggtgcgtcttgcgtgcaacggtgagccttcgagcccggtgctctttccggcggaactgttcgatgcacttatgtgtcttgagggtaaggacggcggcggttcgatcctcaaggaccgtaccgacgtggtgctggtcgaggcgcgtgcctacgagctgtgggacgtcgataccgtcaagggacagcgacgcataacggagcatatcgccgcctgctcgtattttgatcgcgtggccaactgcatcaatcaataaggagcaattatgatcatcatcaaaaacggcgcactcgtgacgccccaggggcttcgccgcgccgatcttgccatggatggcgataagatcgtgcggattgccgcggcgattgagccggccgagggcgataccgtcgaggatgctgcgggctgctgggtgttcccgggctttatcgatgggcacacgcacatgcagtgctggaccggcatggattggacagccgatagctttgagaccggcacgcgcgcggctgcctgcggcggcacgacgaccattgtggactacgcgacggccgatcgcggcgtgaccatgcccgatgccttggtcgagtggcatcatcgcgccgacggcacctgcaccgccaactatgccttccatatggcgcttgccgagtggaatgagcgcaaccgcgccgatctttcggccatgcgcgaggcgggcgtgtcgtcgtttaagacctactttgcctacgaccatctgcgcctggacgatgccgagacgctcgaggtgctggaggagctcaagcgcgtgggcggtatcctgtgcgtgcattgcgagaacggcacgttggtcaacgcgctgcagaagcgcgtgtttgagcagggtatccacgggcccgagggccatgcgctcagccgtccggacgtgtgtgaggccgaggccgtgagccgcctgctgtatctggcgcacttggccggggacgctccggtcaacgtggtgcacctttcgaccaagctggggctcgaggccattcgcgctgccaaagcgcgcgggcagaagaacatctatgtcgagacatgccctcagtatctgatgctcgacgatacgtgctacttggagcagggcgaggacggctttgcgggtgccaagtatgtgatgagtccgccgctgcgccatgccggcgaccgtttggccctacgcgaggcgcttgtggccggcgagatcgatactatcgccaccgaccactgcagctttaatctgcacgggcaaaaggaccgcgggcgcgacgacttccgcgcgattcccaacggcgggcccggcgtggagcatcgtcccgtcgcgattgccacgagctttgaggggcagctgggccccgaggatctgtgccgcttgatgagcgagaacccggcgcgcgtctttggcatgtacccgcgcaagggctgtcttgccgagggctccgatgccgacgtgtgcgtgtgggatccccgggcgcgctggacgatcagtgccgcgacgcagcaccaggctgtggactacacgccgctcgagggctttgaggcgcatggtcgcgccaaggccgtctacgtcaacggcgtgctggccgcgcgcgacggcgagcccaccggagcccagcccggtcgctacgtgccccgctaacaggaaggccgccggatttccctccgcagttgcggtggaatagttcctgtttagccgccaaataggccgtttcaggaactattccaccgcaacttataggcctgctggggcagcgccagctacttgaggctggtgacgacgatggggcggtcgagagctgcctcaaagcggtcggccatcgtggggtcgctgagcgtgtcgacttggttgagcatgatacgggcattgtttaggttcagcatctgcatctcggcattgagcacctgggcgacgcgctcgggcgtggcgatgtcggtaggctcgcagccgcagcgctcgcagaagagctcggggcggtggacaacctcggcgacgggcttgcccagccccgaggcgccgacgacccagacaacgtttgccgtggcggcgggaattaccggctcccaggcggcatgcgccttgagcgggagtcgcttgctgccatctgcctcggccaacacatggttaaagcgccgtgccagctcgccgagcggctcggcgggggcggagagcttgcctgtctccgggtccaagacgcctgcctggcagatgcttccgtgcacaaggcccgtgcaggcctcgcaggtgcaaccggggacatgcgcggcgcccggcttccaaggcgcggcgtccaggcgacgattcgacccgtcccatggcacgccggcgacgggaaacatatgcgtggtggtgcagaggagcacgcggccgccagcgcgcatgagctcaagacccaacgtcttcagcaacgtcgacttgccgccgctgccgataatcgcggtaatgcccggctcgatcctgagcgccgagacaagattgccgctaaccgtttccatctgttcaccgccgtataatactgtgataataaataatcatcagagtagcggtcgaaccgcttttgctctgctcaaaccgtaacacagggaggtgccccgggaatgctcgtttatgttcgcggcgccggcgatatcgccacgggcgtcgccgctcgcttggtgcgctccggcgtgtcggtcgttatggccgatatcgcggttcccacgtgcatccgtcgcacaatctgtttttgcgaggccattcgcctgggcgaggtcgaggtcgaaggcattcgcgctcgcttggcacagacgccggctgaggcgcttgcgattaccgaggctggagacgtcgccgttgtggtggacccccaggccaagatgctcggcgagttgaaacccgcggctgtggtcgacgcgattttggctaagcgcaacttgggcaccacgcgcgacatggcgcctgccgtcatcgccgtggggccgggctttaccgcgccggttgactgcgacgccgtggtcgagaccatgcgcgggcattttctcggccgtgtcattacccaaggttcgccccagcccaacacgggcgtgccgggcatgatcgccggctatggcaaggagcgcgttatccacagccccgccgccggcatgtttcggtccgaccgcaccatcggcgacatcgtgagcgccggagacgtgatcgggtatgcgggtgatactcccatggtcacgcagatcgatggctgtctgcgcgggcttttggcgaacggcgtgcaggtgactgagggctttaaatgcgccgacgtcgatccgcgcggcgatgccagctatatcaactatatttcggacaaggcgacgtcggtcggcggcggcgtgctcgaggcactcgctatgctcaccgatgtctttagaggatagaaggcggcaatggaaaagctcgatgtggtgaatgcggcgcttgccgccctgcgtgctggcgagacgtgcgagctcgtggtcgtggccggcacggcggggtcatcgccgcgcggcgtgggcgcctggatggccgtctttgccgatggcagccaagcgggcaccatcggcggcggcaagattgagctctttgcgctggacgaggcgcgcgagctgctgggcgcagggcaatcgcgtctggtccgctacaccatgggcggcgagaactccgataccggcatgatctgcggcggagccatctgcctgtgctatctgcacctggatgtatcgcaggcgccgttgttccagtcgattgccgacgtcttggcgtatcgacgcatcggcgacttcgtcatcgactttgaaccgtttgtcgcaaacgcactcgagggcgatgtggccgagtaccatggcgagacgtcgcgccataccattgccggctgccccgagctttcgctggtggaggaggggagtaaggtcacctacaccaacgctgcctccgagattcccccggcgcacatcgagacgctctgccccgagggcctgacctacatctttggctgtggacacgtgggcgccgcgacggctcgcgtgctcacgacggcgggctttgccgtcgtggcctgcgacgatcgcccgggcacgttgacgcccgaatgggtgcccggtgtctacgaccgtcgtttggtcgactacaagaatctgagcgagctgtgtcccatcggtccgcgcgacttggtggttgtggccacagcaggccacaagtccgatatcgacgtggtaatccaggccatgcgcgccaaacccgcctatctgggctgcttgggctcgcgccgcaagacggcctttgtgcgcgcccgcctggagcaggagggctttacgcaggaccagatcgacgggctgcacctgccgatcggcgttgccatcgaggccgaggatcccgaggagattgccatctccatcgctgccgagatgatccacctgcgccgtaccaagctcgtcccccgcaagcgctagtcgcatccccatcaataagttgcggtgaaatacgggctgtttaagccagttaagccgtcaaacggtccctatttcaccgcaactgccattttcctccgtcgcatgcggatcggtttgtgcgggggagttgtggagttgtgcaggcagacgaggtttttctggaaatacgcccctaatgcgcgtatagtaccgattgttttgtcggctcctgctgcgtcgagtccaaaccgcgaaatgccatgagcggcgcggatgcagccaggaggcacgaggacaacccaccgtggccacgccccgtgcttaaaaccccaagaaggagtgaacaatggcagaagagaagtatgtgccgcgtctgaagaccaagtacaacaacgaggtcaagcagcagcttcaggacaagttccagtacgagaacgtcatgatgatccccaagtttgagaagatcgtcgtgaacatgggtgtcggcgaggccgctaccgattccaaggccatcgacggtgccgtgcgcgacctgcgtgccatcaccggccagcagccgatgatcacccgtgcccgcaagtccatcgctaccttccgcctgcgcgctggtatgccgatcggctgcaaggttaccctgcgtggcgaccgtatgtgggagttcttcgatcgtctgacctccgtcgcgatcccccgtatccgcgacttccgcggcatctccgccaagagcttcgacggccgtggtaacttctccatgggcgtcaccgagcagctcatcttccccgagatcgacttcgactccgtcgatcaccagcgtggtatggacatcactttcgtgaccaccgccaacaccgatgaggaggccaaggcccttctggacgccttcggtttcccgttcaagaaataggttcacctgccctataagcgccgtttccacaagggggcggcgcttggggcgaacaatactctatgtgaggaggatataagtggctaagacatcgatgatcgtcaagtgcaatcgcaagcagaagttctctactcgtgagtacacgcgctgccagcgctgcggccgtccgcactctgtgtaccgcaagttcggcctgtgccgtgtctgcttccgtgagcttgcactcaagggcgagcttcccggcgttaagaaggccagctggtaagtcactaccagcgtttcaagcatccgtttggaacagggaaaacgcgctaaataggctttgccgttaagggcggcgaagaaccaagagcacgtgttcatcaagaacgaaggagaatctgtatgaaccttacagacccgatcgcagatatgcttacgcgcatccgtaacgctaactctgtgaacaaggccacggtctccatgccgagcagcaagaagctcgtcgagatcgctcgtgttctgcacgaggagggctacatcgagggctacgatgtcgaggacaccgtgccccagaagactctgcacatcacgcttaagtatggtcccaagaaggctaaggtcatcaacggcatccgccgcatttccaagccgggcctgcgtaagtacaccggcgttgccgacatgccccgcgtccgcggtggccttggtaccgccattatttccaccagccatggcgtcatgaccgaccgcgatgctcgcaagcacaacgtcggcggcgagatcatcgcttacgtctggtaattcggtcggtaggtagaaggaaaggagatcaccgtgtctcgtatcggtaataagcctgtccagattcccgccggagtcgaagtggcagtcaacggcaacaacgttgtcgtcaagggccccaagggccagctcgagctcgatgtttttgagaagctcaccatcaacgtcgaggacaacgtcctcaccgtttcccgtcccgacgacgagcgtgagacccgtgcccgccacggcctcacccgcgccctcatccacaacatggttgttggcgtttccgagggcttcgagaagaagctcgagctcgccggcgtcggttaccgcgtgcagcagaagggcaagaacctcgagttctccctgggcttctcgcaccccgtgatcgtcgaggctcccgagggcatcaccttcgaggttcccgacaacacccacgtgaacgtcaagggtatcaacaagcagcaggtcggtcagatcgccgctgagatccgcggccatcgtcctcccgagccttacaagggcaagggtatccactatgttggcgagcacatccgccgcaagctgggtaaggccgccaagtagtcgtaaccgacttactcgcataagaccagcaccccgttaggtgctggcaagatcaacctttttaggagtttacgtatgaacaagcataaggcgaagctggaaggcctcaagcgtcgtcagcgtcgtgttcgcggcaaggtctcgggtaccgccgagcgtccgcgtcttcgcgtgacccgtactaacgccaacatctatgcccagatcatcgacgacagcaagggctccagcctgacgctcgtctccgcctcgaccctcgaggccgagttcaagggcacccacacctcgaacaaggaggctgcggagaaggtcggtcagctcgttggcaagcgtgccatcgaggccggcatcaccaaggtcgctttcgatcgtggtggccgtatctaccatggccgcgtcaaggccctcgccgacggtgctcgtgccgccggtctcgagttctaggaggtatgtagcacatggctcgtaatcagaagcagcagcgcgaggcctccgagttcgaggagcgcgtcgtttacatcaaccgcgtgtcgaagaccgtcaagggcggtcgtcgcatgagcctcgtcgctctcgtcgtcgttggcgacggcaagggcaacgtcggcgttggcatgggcaagtccgctgaggtgcccatggccatctccaaggcgtctctcgatgccaagaagaacatgttccacgtgccggtgaccgagcagggcaccattccgcacgaggttctcggccactttggtgccggccgcatcatcatcaagcccgctgtcgagggtaccggcgttatcgccggcggcgctgtgcgtcccctcttcgagcttgccggcatcaagaacgtcctgtccaagtccctcggtaccgacaacggcctcaacatcatcaaggctgccgtcgagggcctcaaggagctctccagccctgaggacgtcgcggctcgccgtggcctgacggtctccgagatgttcgtcggtaaggagaactaagcatggctgacaccatcaagatcaagcaggtccgcagcaccaacggttgcaagcaggaccaggtccgtactgtccgtgccctcggtctccacaggatccgcgaggttcgcgagattgctgacaacgagtccgtccgcggcatgatcttcaaggtcaagcaccttgtcgagattgtagaggagtagcaaatgcagcttcacgatcttactcccgcgcccggttccaccaagaaccgcaagcgcgtcggccgtggcaattcttcgggtcacggcaccacttctggccgcggtcagaagggccagggctctcgctctggcggcaccaagggtgccggcttcgagggtggccagactccgctggctatgcgcctgcccaagcttccgggcttccgcaacccccgtcgtatcgagtacaccgccgttaacgttgagcgtctcgagcgcaagttcgaggacggcgctgtgatcgacggtgccgctcttaaggccgctcgcatcaccaagagcgagttcgagcccgtcaaggtgctcggcaatggtgagctcaccaagaagttcacggtcaaggtcgacaaggtcagcgcttctgcgcaggccaagatcgaggccgccggcggaaaggtcgagctgccgtgctaaatggtcttaagaatgctttccgcatcaaagaattgcgcgaaaagattctttttaccatagctatgctcgtcgtgtaccgcattggtgcgcacgttcctgtgcccggcattcccttccaggggatgctgggccttttctcgaccgataacaattcggtcgccgcaggtgctatggccctcctgaatcttttctctggtggcgcgttgagctatgtttcggtgttctccctgggcatcatgccttacatcaccagctcgatcatcctccagatgctccaggccgttgtgccttccctgcatgagcttgcccgcgagggcgaggtcggtcagaccaagattacgcagtattcgcgttacctcaccctggctctggcaatcctcaactccgtgggttacctctttctctttaagagcttcggcatcagctttactggcgccggcgctcccgagatcatctttgacctcatgatcgtcggcacgctcaccgcgggcgccatgctgatcatgtggattggtgagctcatcacccagcgcggtatcggcaatggcatgtcgctgatcatctttgcgaacatcatggccggtctgccgcaggcgatcttctccagcaccgagggcaatgccggtggcatcatcaccatggtgatcatctgcgccatcatcctgctggtcatcccgctgatcgttttccttgagcgcggccagcgccgcattccggtctcctacgccaagcgcgtcgtgggccgtcgcatgatgggtggccagaccacctacctgcccatcaaggtcaacaccgcgggcgtcgtgccgatcatcttcgcttcggcgctgctgtacttcccggctcagattgccgtgttcttccccggcatcggctggattcaggcagttgcctctgcgctttcgaccggttggctcaactgggtgcttaatgttgtcctcatcgtgttcttcgcgtacttctacacctccatggtgttcaaccccgatgacacggccgacaaccttaagaagcagggcggctttattccgggcgtccgtccgggtagggctaccgcggcctacatcaagaacgcgctcaacaagatcacgcttcccagcgctgtctttttggcgctcatcgccatcgtgccttcgatcatcttctccttcacgggtaaccatctgatccaggcatttggcggcacgtccatcctcatcatggtcggcgtcgtgctcgacacggtcgataagctcgaaggccagatcaagatgtatgattacgatggattctttaaataggctagaggaggattgctcatgaacctcgtattgctcggagctccgggtgccggtaagggcaccgtcgcacaggagctcgtcgccgagtttggcgtcgctcacatttccacgggcgacctgctgcgtgctgccgttaagggtggcaccgagcttggtattcaggctaagaagtacatggacgctggcgagctcgttcccgaccagctcgtgatcgaccttgtcaaggagcgccttgccgccgatgacgcccagcagggcttcatcctcgacggcttcccgcgcaacaccgcccaggccgtaacgctcgattccgagctctccgctatgggtcgcgagatcgactgcgcccttctggtcgatgtggcccccgaggtcatcatcgatcgcctgtcttctcgtcgcacctgccgcgcctgcggttacaccggcaccgctgccgatgccacctgccccaagtgcggcggcgagatgtatcagcgcgacgacgacaagccggagaccatcaagaaccgtctcgacgtctacgagaagtccacgagcccgctcgtcgactactatcgtggccagggtctgctcaagtcggtcaacggtgaccaggctcgcgagaccgtgtacggggatgtcaaagaggctctcggtctatgatcaagattaagtctgcaacgcaaattgagcagatgaagaaggcaggagcgctatctaagatggcgctccgccacgttggagccatggttcgccccggcgtgtcgaccttcgaactcgatcagcttgcggagcagattatccgcatgcatggcggcacccctgcctttaagggttacggcgggttcccggggaccatttgcgcatcgatcaacgatgccgtggttcacggtattcccaaccctgacatgatcctgcgcgatggcgatatcatctccatcgatacgggagccgtcgttgacggttgggttggcgataatgcttggacgtttttcgtcggcacccccacgcccgaggccaaggccctgtgcgagattacgcgcgattgcctaaaggctgccatcgagcaggctgttcccggtaaccatatcggggacgtcggctatgccgttcagtccctcgccgagtctcacggttacggcgtgcttcgcgattacgtggggcatggtattggccgcgtgatgcacgaggaccccaacgttccaaattatggaaagaaggggagaggcgttcgccttcaggccggtatggtcatcgccatcgagccgatggttacgatgggttccaatcatgtgagcacgggctccgatggttggatcgttacgaccaacgaccacctgcccgccgcgcattatgagaacaccgtcgccattaccaatgacggtccggtgattcttaccacggatgcccaaggtgcttggtgctccctccaaggcggagaaatgtaaaagtcgccgccccctgatgcccaacctcgcctttcaatttcgaaggtatgaccctaaggtctattccttctcatttcaaggcgatcttgggcatcagggaacggctttgttttacatttcaaatgtaacaagttccacgtagatgtggagccattacgaagatattacgatacgtgcatgcgtattgtagaatactcaatcgctgtcgttttctagagaaagatgattgcttgtgaagaaggaagacgcaattgagctcgagggtacggtaaaggagccgctgcccaacgccatgtttaaggttgagctcgagaacggtcattcggttctgtgcaacatttctggcaagatccgaatgaattacatccgcattctccccggtgacagggttgtcgtggagctttccccgtacgacctgacccgcggtcgcatcacctatcgctataaatagcgacacgcatacacgctcttttccgactgcaggcttagctcaacctacggtcggtttgcgtgtgaagaccagccatagttttaaacgcctgcggctgggcgagtagatagtagggaagtagtttgagcgctaccgaaaggaagaacgatgaaggtacgtccttcggtcaagaagatgtgcgataagtgcaaaatcattaggcgccatggcaaggtcctcgtcatttgcgagaacccccgtcataagcagcgtcagggttaagagaggagactacgttggcccgtattaatggtgtcgacctcccgcgtgagaagcgcgttgagatcggtctgacctacatttacggcatcggccgcaccactgcgacgaagatttgcgtcgagtgcaacgttaacgtggatacgcgcgttaaggacctcaccgaggatgaggttaacgccatccgcgattatatcgataagaatcagatcatggttgagggcgacctccgccgtgagcgcaaccagaacgtcaagcgccttatggacatcggctgcaaccgcggccttcgtcaccgcaagggcctcccggtccgcggccagcgcacccacactaacgctcgtacccgcaagggcccgaagcgtcagatcggtgctaagaagaagaaataaggagcgctagatagatggctactgctaagaagaacgttcgcgctgcccgtctgaagcgcgcggaccgtaagaacatttccgtgggccaggctcacattcgttctacgttcaacaacacgatcgtttcgatcaccgatccccagggcaacgtcatttcctggaagtcggctggccaggtgggcttcaagggctcccgtaagtccacgccgttcgctgcccagatggctgccgaggctgctgccaagcaggccatggagcacggcatgaagaaggtttccgtcttcgtcaagggccccggctccggtcgtgagaccgccatccgctccctccaggctgctggcctcgaggtctcgagcatccaggacaagacccccattccgcacaacggctgccgccccaagaagcgtcgccgcgtgtaactgaaaggatcgtatcaatatggcaatcgacaggactcctgttcttaagcgctgccgtcagctcgggatcgatcccgctgagctcggttacagcagcaagaaggaatctatccgtcagcccaagcgccgtcgcaaggaatctgagtacggcatgcagctgcgtgagaagcagaaggtcaagttcatctatggcgttctggagaagcagttccacggctacttcaacaaggcccgtaagatgaacggcgtcaccggtgagaacctcatgattatccttgagtctcgcctcgacaacgtcgtcttccgtcttggcttcgcccgcacccgcaaagaggctcgtcagtccgtccgtcacggtcacttcaccgtgaacggcaagcgcgtggacatcccgtcctaccgcgtcaaggccggcgacgtcgtcgctgtcggcgagaagttccgtgacctcctccccatcaaggaggccctgatttcctccgagcgctttgaggtccctggctggctcgaggtcgatatcgagaagctgtctggtaacgtgctcgctctgccgacgcgtgagcagatcagcggtgatatcaacgagcagctcatcgtcgagctctactctaagtagtccatccgggctgctgaggctggaggtaatacatgtcagaattcattaggcctcaggttcaggtcgaagagatcaacgagacctctgctcgtgtctccgtcgagccgctcgagcgtggctacggcgatacgctgggcaactcgcttcgtcgtgttcttctgtcctcgctcgagggtgccgccgtcgaggccattcagatcgatggtgcgcagcacgagttcatgaccatccctaacatggtcgaggatgtcaccgatatcgtcctgaatgtcaagggtcttgtcttcagggctctcggcacgaccgacgaggcaaccgccaccatctcggttgacggcccttgcgaggtcaccggtgcggacttctttattccgtccgagtttgagctggtcaaccccgagcagcacattgctacgctcaccgagggcggccatctcaccatgagcatgcgcatcggctatggccgtggctatgtttctggcgaggccaacaagcgcgacaacgatcccatcggtgtgatccacgtcgactcgctgtactcgccggtttcccgttgcgccaagctcgttgaggcttgccgtgtcggccagcacaccgactacgaccgccttgtcctcgagatcgagaccaacggctccatcgccccgcgcgacgccgtggtccaggctgccaatatcatcaaccagcatatggccgcctttatgaaccttgccgagacccccgaggtcgaggaggaggcttcgatcttcgctcccgaggttaccaacgacaacgccgagctggacaagcagatcgaggatctggacctttccgttcgttcctacaactgccttaagcgcgccagcattcactcggtccgtcagctcgttgagttctcggagaacgatctgctcaacatccgtaacttcggtgttaagtcgatcgaggaagtgaaggacaagcttgagtccatgggcctgagcctgaaggcttaatgcttcgcatatttgaggagaaactagaccatgcgtcacaacgttaagaagggcctgaagctcggcaccgatgcgagccacaccaaggccatgaagaagagccttgctaaggccctcttcgagaacgaccgcatcaagaccaccgagacccgcgctaaggcgctgcgttcggtcgtcgatccgatcatcacctgggccaagaagggcgacctgcactctcgtcgtctggctatcgccaagctcggcgataagcagctcgttgccgagatcttcgacaaggctgctcagggcatgtggcaggaccgcaacggcggttacacccgcatcatgaagctcggtaaccgcaagggcgacaacgctcccatcgttatcatggagctcgtcaccgagccttgcacgcctaaggccaagaaggctgctccggcccccaagaaggccgctgctcccaagaaggtcgaggctgtcgaggaggctcctgccgaggagaccgctgagtagacattccgtctgcataggctatattcgaggggtacgttcgcgtacccctcttttttgtcgcaataccgttgctagtttgttgggagcgcccatgactgcgccgtctgatttcaatttgagccccgagctcgacgccacccttgtatttcgtgtggcctacgacggctcctcctatagcggatttgccgagcagccgggccagacgacggttgcgggtgagttacgccgtgcaatcgagacgttgctgcgccgcccaatcgatctgacgtgcgcgggacgtaccgatgccggcgtgcatgcggtggcccaatacatcagcgtgcccgtaacggacgctgagcttgcgtgtacgcgccgtaggtggctgagggctatggatgccctgctgcccaaagatatcgccatcaacgaggtctacaaggcgcgtaagggcttttctgcgcgctttgatgcgcgttctcgcacttacacctatcgcattgccggccgtgacgcgcgccccgtgctgtcacgcggtgctgtgtggtggcatcgctatcccctcgacgtcgatgcgatggcggccgcctgccctgcgcttttgggcgagcaggactttaagagcttttgcaaggtcgcctctgccgtgggcaaacctacgcaccgttgtgtaatgcgtgccgagtttggccatgaggtcgcctttggcgaggacatcctcacgtttaccatcgagggcaacgcgtttttacattcgatggtgcgaaccattgtgggcaccctcgtcgagatcggcatgcatcgccgcgatcccgagtggatgcgcgaggtaattgatgcctgcgatcgctccgttgctggtcctacggcgcctgcatgcggtcttacctttatgggcgtggactacgaccccaccgagcttgtggtgctcgattagggaagtggctgcctgacggcaatctttgtgtgcggtgcctgtgggcggggcgtgtgcaacatctgttcttgacgtgcatcgcgacgggcgaccgcccgcattaattgacggggtgtaccatgaacggcagtttgttactagctgtcgagaggacggaaaacttggttcgacgtggttcgcatccgcgactttcggtgatcctgattgttgagggttcgcccagctatgcgatgcgcgctctcgagagtgtccagaaccaagacctctacgatttgcaaattgtcgtcgtttgccgcggtgtggcagctggtgtgcaccattcgctcgaagttgctgccggcagagacattcatattgatttgattgatgttgaggacccagcgcctggcgcctgcctgcgtgccggctttgcggcttcgcgcggctcccagatcattgcgatgaatgccaatgagtggtttgcgccgcagtccctttcgcagatggtcgaaagctcctgcgacgattcggctgacatcgtgtttccctctgtttcgcttgatcactacgatgttcaccgcgagcgtcattcccgagttttggacgcgacatccgtttctgaagatgaggaccgagcggcttgcctgaccctattggtctcctgtggtttaatccgacagacctctggcgtgctgtatgatcgcgccctctttgaggcgtgccttgcgcatggcgatgcgtttcgcacggtgtcttttttgacgttcgcgctttcgcgggcaaagcgcgtttcgggatgtggccgtgctcgttttcatgcagtggcgccgtcgattacggagacatttgaccccacgatgtttgccaggctttctgatgatatcggggcgctcgacaggcttgccgactcgcttgccgtcgcgggcggtagcgatcagttgaaactggtctgccagcagtattactacgccggtctggttgcctgcatcgataatttgtgtctgagcccccatggggtgtcttcaatagagcgttcggcccgtttgcatgatatgctcgaagcgcagcgtacccgtcagatggttgcggcccttaagggcaatcatcgtggtctaggtctgctctatggttcgatagccagcgccaagcccacgcggtgtgcgttgtatacgcatctggcggcctttttcaatcgttcgagcgccaagacagtctagtagcgtgattttcgaaataaattgcatggaattgtttcgaaatgcgttcttattcactaaaaccctcaaatagcgctaaactattcaatcactaagtgattgtctccgcaatcttttggagtgaggttttgtatggccaaaaaacgcaatgggcgccaggatgccatcagagatattgttcgcaataaggacgtacgcacgcagcgcgttttggtagacgagcttcgcgccatgggtttcgattgcacgcaggcgaccgtttcgcgcgatatcgcggacatgggactgcgtaagctccccgagggcatctatgtccttgccgaggacctgcatctgcagcgcatggtgtccgagttggttaccggcgtactgcgcaccgataatctggttatgatcaaggcacagcccggtacggcttctggtattgccgcagctgtcgatgctgcggagctgcccgacgtgctcggctcgcttgccggcaacgacacgatcttggtcattgcgcagacggccgaggacggcgagcgccttgaggcgctcatcaacaagctgagtaactctcacaagtaggggagtagcggcactgctgctgtgccgattgttgctataggtaattgccgagggcgttgacgaaggtcagcgccctttttgcatgtcagtgcctgttgccctatcggtcctgtagccggagccgtcgtggcatcttgtggtatctgccgaaataaagaagcgcccgagcagcgtacgtgctgctcgggcgccttggtgtcagtcgtcctttgcgcttactggcccgtagaggggtcgggcgtgggcgtaggatcgggcgtgggcgtaggatcgggtgtgggcgtcggcgtgccaccgtcgccacccgtgcccccgtcgccacctgtcgtaccgctatcgccggtggtgtcgccgcccggggtttcagtggtcgtggttgtcgttgtggtggttgtggtggttgtggtggtctcttccttttcctcttctttttccttgtcttcgtcctctttgtcttcctttttattgtttgtgccgtagaacttccagacgttattgttcttgtacgtgggagccgttccggtcgcgaactcctcgcgctcggttccggccaaaacggtgttcatgaactttttaaagacgggcaggttggtgctgtctcccagcaggtccgtgccgtacttttggatgggaatctcgcctgcggaataaccggtccacagggcgcatgccagttgcggcgtgtagccgcagaaccacaggttggtggtgttgtcggtggtgcccgtcttgccggcatagggctggttgacgctcagcgcgccggcggcacccgtgccgctgccctgcatgacaccggatagaacgtcggtaaccgcggcagcctcgccttcggtgagtacctgcgtgggattgtcggtgtgctggtacagaaccgagccggtacgcgagtcgatctcggtgatggcgatcggctggcgataatagccgccgttggcaaaagtggcgtaggctgatgccatctcgagcggcgagatggacccggtgccgagcgtcatgacgggaacgtcctcgatattgtccttggcgggatcgatgccgagctttttgacgagcgacatgatcttgttgttgccgatggcttctgccacctgaatgtagccggtgttggatgagtatgccgttgcctgcttaagcgtgatgttgccatagctctggttggcatagttttgcaccttggtcgtggtgcccttggctgtaagaggcgagttgcagttgagggtgacgttggggttcatgccgttttggatggcagttgccagcgtaaaggccttaaacgtggagcccacggggcgctttgccgtagcgtggttcacatgattctcgtcggcgttgtagtcgtagccgcccaccatgcacttgatgtagccggtcttggggtcaacgacgaccatgcccatgtccaggccgtcgagcgaaagcgtgtcgagctgcgcgcgcacagcctcctcggctacctgctgcatggtggggtcgatggtggtcttgacggtcagaccgcccttaaagagcacgtcggtggagaactcctgctcaagcagctgcttaacgtaggagacaaagtagggttgagagtacacatcgacgccactgcccgaaatctcggtcacgttaagcgtgatgggctcggcctgcgcggcatcgtgctcttcctgcgtgatgtggcccagacgcagcatgttgtccagaaccttgttgcggcgggacagcgccaggtcgggattaaccgtggggtcgtactgcgagggcgagttgggaaggccgatgagcagcgcggcctcgctcagggtgaggtcggcggcggtcttggacagataggtctcggcggcggcctcgataccatatgctccatggccgtagtagatggtgttgaggtacatcatgaggatctcgtccttggagtacatatcctccatcttgatggcgatataggcctcgcgcaccttacgctcgatggtcgagtcgaattgttcctcctgcaagatggtgttgcgaaccagctgctgggtgatggtcgatgcgccctcgtggccgccggtgagggtcgccaccgatgcgcgcgcaatgccccaaaggtcgatgccgccatgctcgtagaagcgttcgtcctcaacgtcgacagtgccctgcagcacgtacggggacacctggtccttggtgatggacttgcggttttgagtgtagaagctcgcgatcttgttgccgttgcagtcgacgatttcggtgggctcactgaccagataagcgttggcgtcggtgtagtcgggcaggtcggacagccagcggttgacgttgccgatcatgccgatgccaaacgctacgcccgcgataagcagaaagcccaaaaacgagagcaagatcatgggaaggacatgtgtcttggagcgactgcgtccctgtcgttggcgaggacccatatattgacctccgggtatgtcgtgccaggcggcaggtatgctgcctggcaggatggacataagttattacacgataaaccaatcggggcgcacgaagcctcgtgtatgctggttggcagcaattttcagagtgaaagcacaccttggcaaggagtttaccgatggcgattcggcagatggaaccgagcggacaatgcgaaagcgagttggcggcggctggagcggcgctgcccgaactgctggcgcctgctggcgggctcgaccagatgctcgcggcgattgcggcgggtgccgatgccatctatgcggggctggacggattcaacgctcgagtgagcgcgcatggctttagcgatgatgagttcgcgcgcggttgtgccgtggcccatgcccatggcgtgcgtgtgtatgtgacgctcaacgtgttcgtgttcgatgatgagcttgccgatgccgtggcgttgggggcgcatgcgcacgcgttgggtgccgatgcgctgatcgtggcagataccgggctggcttgcgcgcttcgtgcggcgattccgggggtcgagattcacctgtccacccaagcgggcgcccatagcgagggtgctgtgcagttggctgccaaggagttgggagttgagcgcgtgacgacggcgcgcgagctgagcgtggcggagatcgggacgctttgcgctaccggcgtgcccatcgaggtgttctgtcacggcgctatttgcattggatactcgggtgcgtgcgggttctctgcccttcgacgtggccgctctgcgatgcgcggcgactgcacgcaaccgtgccgcctgtcctatgacttggtggacgaggcggggcagagtgttgtcgctgtcgaaggggatcgcctgctttgtccgcgtgactatctgggtatcgcgcatctgcccgagcttgttgccgccggcgtggcatcgctcaagatcgagggccgcatgaagaatcccgactacgtctttaacgtggtgagggtgtggcgtcgggcgctcgatatgctgcgcgacggcacatgggatgccgatgcggtgccggcgcttgagcgcgagctgggaaggtcgttcaaccgcggctttaccgatgcgtatctgcggggccgttcgggcgccgagctcatgagctttgagcgcgcgatcaaccagggtgtgcgcgtgggccacttggtggcggtgggtcacgaagaggtgacggttgagcttgatgccgccgtggcggcgggtgatacgctcgagatccgattttacccgggtgccgacgcgcgtcccgatgtgcccaagcgctggccgcaggtgccttgccccgtggatgccgttgcgggagagcgcatcgtcgtgcattgcaaacgcaaggtggacgcgggctgcgaggtctatttgattcgtagcgccggcgtgctggggcagacgacaacggtgttggagcgcatgcgggccgaggcagatgcggtcacgcctgttgagcggtccgttgaggtgttgccgtttgagggcgttctggcagatggcgacgtgccgacggagttggcggggccggcaaagcgtgaggcttttgctcgtatggtctttgcctgggagctgatggatgtggatccgcgcgatgagtgtggtctgtccgatgcgacggtggtgcttgacgaagtgtgccgcgcaggcgacgccgagcggactcgggcgcttatgcaacgtgccgggcgcgtcgtctgccgcaatctgggacaggtggcgatcgcccgcgagctgggcacggcgtttgacgtggcggcgccggtgttctgtgccaatcgggccacgcttgcttggatgcggagccttggcgcggggtgggtatacttgcctgccgagttgctcggcaatgacagggagcgtattgccgagctggctgctgaacccggcgtcttgggtccggtcgacgccgaccgtcccgagcttatggtatgcgaacgctgcctgttgaccgccgagggcatctgcgccaccgatgcgacggggcaggtccgttgccgagactgcttgcgtcgcaggcaggtgcgctatctggtcgagcgtgacggcacgcgcctgccggtcgctgttgacgcatgcggcaggacgaggattttcctgtcgtaggtgctgcgtcgcgtcagtttgttatcataagagagtttatggacttccagcaccgccgttttcggcgagggtgctatagcaaaaggaggatacccaatgctgtctgttgacgagcaaatgcgtatcatcacctcgggcgccgcgcagatcgtccccgaggccgaccttcgcaagaagcttgagaagggcgagcccctcaacatcaagctcggcgtcgaccccaccagccccgacctgcacctgggccacgccgtgccgctgcgcaagatgcgccaattccaggacctgggccacaacgtcaccctcatcatcggcaacggtaccgcgctgattggcgacccctcgggcaagaactccacccgcccgcagctttcgcaggagcagatcgaggccaacgccgagacctacgtgagccaggccatgaagatcctggatcccgagaagaccaccatcgtgcacaacggtgactggatcctgtcgatggatctggccggtctgctgcaggtgtgctccaagttcaccgtcgcccgtattcttgagcgcgatgactttaccaagcgctaccagtctcagacgccgatcgccctgcacgagttcctgtatcccgtgatgcaggcatacgattcggtcatgattaaggctgacgtggagatgggcggcaccgatcagctcttcaacctgctcgccggccgtgagctcatggagaagatgggcatggagccccagatcgcgctcaccatgccgctgctcgagggcaccgatggcgtccgtaagatgtccaagtcctacggtaactacatcggcctgaccgacgcgcccaaggatatgttcggcaagaccatgtccatccccgacgagatgattggcaagtactaccgcctggcaagctcactcaccccggccgaggtcgacaagatcgacgctgctctggccgacggctctgccgatccctatgagctcaagcgcgctctgggccgcgacctgtgcgacacctaccacggcgccggcgccggcgacgaggcccaggccgagttcgatcgcgtgttcaaggagggccagctcgccgacttccctgagaagcatgttgagctgaccgtcaacgacgagggccagatctacctcgccggcttgctcaaggacctggggctttcggcgagcgccggtcaggcccgtcgcgacatcgacggcggcggcgtcaagatcaacggcaaggccgtggctcccaagagctacaacatcgaccccagcgccctcaagctgggtgacaccctctccgtaggcaagcgcaagggcttcaagcttatttagttacgcggttttaccaaaccgcgtaacagctcgacgctgcgcgggctccagagcgacaacttgtcattcaaagagggcggcatgaccagaaggtctatgccgtcctcttttcatgccaaccggttccgtggcggcggcatcgcgcgcagccgaccgagggcgtccggaagtgagcggggcacccgtctagcgaccgatttccagccaattgcacagcacgttggctcgtaactccatttccgccgtcttttgtgccctggttttgcacctatagcgcaattccaaacgcgagcaaagacttcgcacgatcgcatcaagctgctcggcatcgttaagcatgtcgtgtgtaaccaggaagacgtcataccccatactttgcagcgccgtcatgcgtttggcatcgtggtcgagcgcggcgcctgatccatggatgacctctccctgaatctccacgatgcctgccttcattatggttggattcacgatcgcgatatccccgtagcagactttttgccctgcaatgctctgtgccgatgcggtaagcggcgtaagatcgttgacgtaaacgtttctaaagccggcaccgccgcgagagcgaggaagcgatagcaataaaattcctgcaacttcaagcggagaagcggctatacccgtcaccagttgcgcggcgttgtaaaatttcgtaccccactttcgatttttcatcctactggcgtactcatgaagctcgtgtaattcgatgagcggcttcctcatccagagcgaagtgccttttagctttgtgacctcattcattttcctttgtccgttgggccccttcgcatttacctgttctttgacttttatgcgcgaataaacgcgtttccattgtggttcttcttggctttcatcaaggtcaaagagggattcggttgttgcattctcggcagcgtctttggctttgtctagttccgcttctgctgcggcggtgggctcaaagactgagaaccatccgcagaattcgtacatggcaaggacaagatctgttggagacacaaagcgcgccatggtaaatagcgtcggaagtggattggtaactctaaagctcatcgcggtttccagcgtgctgtccaccccagaaacatcatcacagtgaatggttgtccgtaatcccgaatggtagttaacgccaccgggcactgttgtggtaataatcggggtcttgaggacgtcggttacgaaaggggcttgggatagagctcgccagccgtcttcggagttgggaaggcgcgggtagaggtcgcgcacctgcggcgggcagcgccagtagcggaatgcggtgtttgcgcagacgatttcgtccatttgcgcctcccctggtttcggctgcgggccgtgtggattacgggcaaggtcgattatctaccggggcatcatgcgggtaagtaccggaagctgaccaaacgctgacaaaaagcttgacgagttctgccgaaaaagcgttgtgtgatagaaatccgctggaaggagctctgggcgtgtggtccctgtcttcacatttgcgtatgaatcacatggggaattcaatgaaaatacgcatgcgttttatgcaaaatgtgcaatgacgtcagcaaaaaagggtgcgataaaaaatgacgccttagacgactacgattaatttttggtgtcagttttggtgtcacccttggtgtcaaaaagacgatatgagaaagccattggggccgcctcccccgcggcgcagcttctttctcgcacggagagcacattaagtgctctccggctcgtgcggaactcgcgatcgacttcgtatgccgccgggcagccggggccgacgcgaggttcaagattgtcaaaaaagcggtcggcgcgcagtgcgccgaccgccgatgtaaggggtctgatgatttttaccagctagggcctcttactcgtctaggagatcctctggcatgtcgttgccgtcgcctaggtcgactggggcctcttcggcgtcggttgcggcctcggcgccttcgccttcgggcttctccttggcggccgtcatgcgggctacggcgcagatgcggtcgttgtcgtcgacggtcatcatcttgacgccctgggtagcgcggccagtctggctgatctcgtcggtcttgacgcgaatgaccgtcgcgccctccgtcacgatgaacagctcgtgctgcgggcccaccgtcttcatggccgcgaggttacccttacgctcggtcatttggatggtgtagacgccctggccgccgcgattctgctccgggtagtccgcgaccggcgtgcgcttgccgtagccgcgctcggtgatgacgaatagatcgccgttgccgttagtgacttccatgcccagaacgctcacgccgtccttcataccgataccgcgaacgccgctggtatcgcggccggtggcgcgcacctgctcctcggagaacatgatcgccttgcccgcggtggtggccaggataatcttgtcgccctcgcgcacgcggcgcacgttcagcagcgcgtcgtcgtcacgcaggttgatagcgatcaggccgtcgcgacggctgcggtcatatgcgctcatcacggtcttcttgaccatgccgctcttggtggcaaacatcaggtactcgtcggcagggaactcgcggcagctgatgacgctcgcgatcttctcgccctcctcgaagggcagcaggttgacgattgcggtaccgcgcgcctggcgcgtacccaccggcagctcgtgcaccttcaggcgatagaccttacccttgctcgagaagaacagcacgtactcgtgcgtggacgcgatgaacatctcgtcgatgacgtcgtcctctttgaggttgacgcccgacacgcccttgccgccgcgcttctgggcgcggtaggcggccaccgggatgcgcttgacatagccggtgtgggtgatggtcacgaccatgtcctcatcggcaatgaggtcctcgacgtccaggtccttctcgacatggctgatctcggtgcggcgcttatcgccgaacttcttggagatctcgcgcatctcttccttaatgacgcccaggatcttctcctcgtgcgccagcaggtcctcgtagtaggcgatggcgcggcgcaggccgtccagctcttcctggatcttgtcgcgctccaggccggtcaggcggcgcagcttcatctcgaggatggccgtggtctgctcgggcgtaaagccaaagcgctcgatcaggcggctgctggcctcggagtcggtctgcgaggagcggatgatgctgatgacctcgtcgatatggtcaagggccatcaggtagccctcaaggatatgcgcgcgggcctgggccttcttaaggtcgaagcgggtgcggcgggtgacgacgtcgacctggtggtcgatgtagtgctgcagcatctcgcgcaggctcaggcatttgggaacgccgttgacaagcgccaggttgttggcgccaaaggtcgtctgcagcgaggtgtacttgtacaggttgttgagcacgacctgcgggatgacgcccttcttgagttcgatgaccagacggatacccttctggttggactcatcgcgcatatccgagataccctcgatgcgcttgtcgttgacgagctgggcgatcttctcctgcagggtgcccttgttgaccatgtagggaatctcggtaaagaccaggcggctgcggccggtcttggtggactccacgtgagccttggcgcgcacggtaatggagccacggccggtctcgtagctctgcttaataccggcactgcccatgatgatggcgccggtggggaagtccggaccgggcatgatctgcatgagctcgtcgacagtggcgtcgggattatcgatcaggtagcaggttgcctcgatcgcctcggtgaggttatgcggggcgatattggtggccatgccgacggcgatgccctggctgccgttgaccagcaggttggggaagcgcgcaggcagcgcctgaggctcggcgagcgattcgtcgtagttgggctgccagtcgacggtatccttctgcaagtcacgcagcaattccatggcgggctttgccaggcggctctcggtgtaacgcatggccgccgcgccgtcgccgtcgatgttgccgaagttgccgtgaccgtcgatgagcggcgtgcgcatggagaaccactgcgccaggcggaccatggcctcatagaccgcgtagtcgccatgcgggtggtacttaccgataacttcgccgaccgtccaggccgacttcttgtgcgggcggttggggtagatgccgctctcgttcatcgcgtacaggatgcggcggtgcaccggctttaagccgtcgcgcacgtccggcagggcgcgcgccgtaatgaccgacatcgaatactcgataaatgactgcttcatctcgcggccaaactccgaaatctggagctggccgccgttgatatcctcgccggccgaggcgccacggtcgacttcgccaaagctctcctcgagctcaccgtcgtcatcctcatcatcttcatcctcggcgtcggggttataggaatccggatcgccgtcctcgccctgctcggcgcgggcgagtaggcgcttcagatcatcgggcatgccggcgtcgccggcctcgtccataccctcattgttgttgatatcgtctgccacgttacctcctcatggtttgcgtggtccattagttccccaccacggagacggattaccgggaacaccggataaccctcctaggttttccaggtgccccaggttgccctgaaggatgagggcgcacgccttgcgtgcggcgcccgaaatcctgaagggcaagatggggtgcctgggaaagctaggcgtctaagaatcgtgcgtcatgtgcgtgcttctcgatgtactcgcggcgatagccgacctcggaacccatgagctcgcgcacggcacggtccgccaccacggcgtcctcgatcgacacgcgctgcaagatgcgggtcttgggatccatcgtcgtcgaggcaagctgcttggggtccatctcgcccaggcccttgtagcgctggacggtatagcccttgcgcttcttggtgatcttgccgtccttggccttgccgtcctcgtcgttgtcgtcggggttcaggcccagactctggatggtgtcgcgcaggatctcgtcttcgggctggcggccgttgggatacacgtagtggatcttgttgcgcaccttaatgccaaagatgggcgggcaggcaacatagacgtagccggcatcgatcagcggacgcatgtacttgtagaagaacgtcagcagcaggatgcggatatgcgcaccgtcgacgtctgcatcggtcatgatgatgatcttgtggtagcgcgccttggtgatatcgaagtcgccgccgtcgccggcactcgtcgtgacaccgcagccgatcgcggtaatcagcgactggatggtgtcactcgagaatgcacgatggtcaccaacgcgttcgacgttcagaatcttgccgcgcaggggcagaatcgcctggatgtctcggcgacggccgtccttggccgaaccgcctgccgagtcaccctctacgatgaagagctcggtcagctcggcatcgcgcaccgagcagtcagcgagcttgccgggcagggacgccgtctcgagcaggctcttgcggcgggtcgcctcgcgcgccttgcgggcggcgttgcgcgccttgcaggcctgttgcgccttcttgacaatctcgcgggcgggcttgggatgctcctccaagtaatcggcgaggccgtcggtcacgatcttgagcgtgagcgcgcgcatataggagctgccgagctttgccttggtctggccctcaaactgaggatcgggcagcttgaccgagataacggccgaaaggccctcgcgcacatcgtcgccggtcaggttggcgtctttttccttgagcaggttctgcttgcgcgcgtaatcgttgattacgcgggtgagcgcggtgcggaagccctcaaggtgcatgccgccctcgggggtgtagatgtcgttggcgaacgacatgacgttctcgccgtagccgctattccactgcagggaaacctcgacctcgcccatcttggccacgggagcgtccgggtccgatttgccctcgatgtagatgggctccttaaaggcctcggggacgtccttgccctcgttgaggaacttgacgaagtcaatgatgccgccctcatagcaaaactcctccacgtggggagtcgcctcgcgctcgtcggtcagcacaatcttaaggttcttattgaggaacgccgtctcctgcagacggttgtgcagcgtatcgaaatcgtagatgcaggtctcgaagatctcgtcgtcgggccagaaggtgacggtggtgcctgtcgaattcgaggtgcccacgacctccatcttcttgacggtcttgccgcgcgagaactccatctcgtaggtgttgccatcgcgacgaacctgaacgaccacgcgcttggacagcgcgttgacgacggagatgcccacgccgtgcaggccacccgagaccttataggccgagttatcgaacttaccgccggcgtgcaggatcgtcatgacgacctcgagcgtcgggatctttttaacagggtgctcgtcgacggggatgccgcgcccgttgtcgacgaccgtgatggagttgtcggcgtggaccgtcacctggatctcggtgcagaaaccggccatggcctcgtcgacggagttgtcaacgatctcccacaccaggtgatgcagaccgctggcgctcgtcgagccgatatacatgcccgggcgcttacgaacggcctcgagaccttcgaggatcttaatctcgccgccatcgtaatcgttttcgtttgccacacgtcctccttcagtcaagaaaatgtgtacagccttactagtttatcgtaaaaaaataccctcgggaacgagggtatttggctctacaaggccaccagatgcgatttaaggctcttttttgctttgcacgcccttggcccactcggcactggctctcatggcattctcgagggcctcgcgcagtttttggtcttcgatgggcgccacttggcgctcgatctcggtacgctcggcctcacttaggtcggcgtgcggggccggcggtcgctcggtcgtcgccgggcgcaggcgctccttggcggcgggcggcgtgtgaccgggcgcggtggttttgaacaccaggccgtccacatgcgcaccggcgcgctccatgcgcgcgcggatgatctcgcgcaacagcgtcatttcctgcgtccacgagggcgagtcgagatacaccagcagctcattggactcgggcaggtagcgcagtcccgtcacatgccgtccctcgcgcgtgcccgagcacaccgcgttccatgcgcgatagaccgcgcgcgactcctcggcggcctccatctgcgcacggcgctcgggggtcgcggacgccaggatgcgctggcgctctgcgttcaaaaacccgctgaaggcgaccgtctcgctctcgcgctcgtaattagcacgtctcacccatgctcaccaccttggctcgatcaagcaggtcatcggtaaagtaccccaggttggtcgtagttatgaccgtctggatatcatcgccgatcagccgcaggaaagcgccgcgacgctcgccgtcgagctcgctcatcacgtcgtccagaagcagcagcggggcagtgcccaggacatcgcgagccacggcgacctcggccaccttccaggacagcaccagcgtgcgctgctgtccttggctggcaaatgaacgggcggagcgacccgccacggtgaactcaatctcgtcgcgatgcggtcccaccaacgtcacgccgcggcgaatttcctcgtcggcatgctcgtcaagggcagccagcatgcgctcgtacgcccaacccttcagctcttcgcgatcctcgacctggggcaaatcccccagcgtggacgcataggtcacgttggcggcctcacctgacgccacttgcccgtaggcagtgtgcacatggcccgccagccggtcgagcagggccaaccggtgcacgagcagggccgagcccgcgcgggcaatcgaatcgttccacgcgccgagcatctcgcggcagcaccaggtctccttgagcaaggcgttacgctgggtcacgcagcgcccataggtgctcgcaagatcggcatagcgtgcgctcagctgcatgccaaagtcatcgagggcggcgcggcgcacactggcgcctcgcttaaccatgtccagatggtcggggcaaaacagcacactcggcagaaccccgcgcacaccagcggcagagcatctcttgccgttgcggctaaacgagcgcctaccgtcctccgcgctcaatcccatatcaagcacgcggccgtcgccctcgagcctcagctcgatcttgcacgagcccacgccgtcatggacgagctcggctgcggtcggatgcctaaacgaggcgccgctcgtcagcagctgcagcgcctctatgagattggtctttcccgccgcgttgggtcccgcaagtatcgtcacgccctcgtccagggcaaggcgatagctatcgaagctgcggtagtgcgcgacggaaagatcgcgggcgaacatggtcatggcgcagcgctagatgcggaccggcatgaccaggtacaggtagttaatcctgtcgtaggacttaaagatgcccgcctgcgagtagctcttgagctccagcgtgatctccttctccttggacagggcattgaggcagccgaagatgtagtggtagttgaaggcgatggtgcccgactcgccctcggcctcgacatcgatcgtctcctgcgcaaggtcctggtcattggaaatggaggacaggcccatctgaccgttctcgacatcgatctcgaacttgacggcggggttggcgctcgcgataacggccacgcgcttgagggcggcgttaaaggcggcgacgtcgatcttgacgctcgtcacgcacgaatcggggatgagctgcttgtagttggggtacacgccctcgatacgacgcgacacgtaggtggtgttgccggcctcgaagacgacctgggtgtcggtagccccgatcatgatggtcgcctggctggccatgatgttcagcgcgtcgttaaaggcgtcagccggaacgttgagttcaaaggagccctcgagggtcgaggtctcgacctgcgtatcgcacacggccaagcggaaggaatcggtcgccaccaagcgtacggtgttgttctcgaccttcatgtgcacgccgcccaggatggggcgagccttgtcggtcgaggtgacgcgccacacgcggccgaccatttcggacaagatatcggtcggcagctccacggcactctcgatggcataggccggaaactcggggaagtcattggcatcgagcgtgttcagcctaaaagagctcttctcgcaaccaatcagcacctggcgctcggacagctcaaaggtgaccggggcatcggggagggtcttggtgatattggagagcatcttacaggggataaccatctcgccctcttcttcgacatgcgccgcgatgcgatgacggatcgagatggtgtagttagaggtctggaattccaagatgccgtcttgggccttaacgagcacgcccgacaggatgggaagggtggatgccgaagcgacacccttcataacgacgccgatggcttgtgtaagcgagctctggctgacggtgaacttcatcttttaatacctttctatagatataaatatcttaataatagtaatagcactgacgaaactgttgattactcccaaagacgcaggtcagacccagaaagagaatcgacagcaacctgtgtgcaacaggggtggttttccacgttcaaaacctgcgcaaaacttttcatcgccgcgggttgggttttagacaccttatgcccgtggtttcgacaagttttcaacaggtgtctctatttccctacgagcgcagtgtaattttatcgcgcagcgacttgaggtcttcggtgacggtgcggtcttcctggatcatcttctggacctttttgtaactcgtgctgacggtcgagtggttgcggttgccaaattcggcgcccaccgccgtggtcgtcatctcgcacatctcgatggccagatagatggcaatatggcgtgctttggcgatattggcgttgcgacgcgggccgatgagctcctcgtgcgtcacgccgtactgctcttcgatgacggactgaaccgtctggacgttgatctttttggccgatgtgtcgaagtactggctggcgatggcgtcgatatcgtcaaaggtgagctccccgccctcgcgctcgcggtcgcccgcctcgccggcgcagcgctcgcagaagctctcgagttcgcggatgttggtgcccgagacctcggccatgtgtttaaagtgctcgtcggtcaggtgcccgccgtcgcccccataggccgccagcagcgagtcgtcgcctgcctcgggagcggcgacgatggtgttctcgtaatagcgctgcaagatcttgtatttcatctcgtagctgggctctgcgaccaagcagagcatgccggcgttgaagcggctggtcagacgctcgtccatgctcaggtccttgggggcgcggtctgccgcgatgacgaccttcttgttgttgcggatgaactcgtccatgagctggaaaaagtagtccacgctcgcgcgcttgccgatgatgttttggatgtcatcgatgatgagcacgtccacgccgtggtatgcctgcatgataggggcgttgctcttcttttggcggtcgaactcggtcatcaggtcgtccagatatgcctgggagttggcatacttgaccttgatctcgggcgacttctcggcgagctcgtttttgatggcaagcagcaggtgcgtcttgcccaggcccgatttgccgtagatgaacagtgatgtgcacgtgccacgctcgtccgcgagggcggcaaacttgagtgccgagcgataggcatggctgttctcggggccgtagacaaagttctcaaaggtaaattttgagttcgcggcgagcggggctccatccgcattctgctcggccggtacggtcggtgccggcatgggtgaagcgggggtcgcagcttgcgtggacttagtcggcgctccgcccttcatctggttcatcatgcgacgaaaatcatcggccgagagcgtgttcttgattgcaatgcccgaatccgcgcccgccgctgcgtcgtgagcgataggcatgtgcgtgacgggtgcgttcgttgacgtcgccgccgcggtcggcaacggtgccatggtttcacgggaaacatcgccgtgctggtgctcgattgtcggcacgtcgcctgcggaggccggcaccgccggggaggcagcgggagccgcggcgggcgccgtcgcagcagcggattccgccacggctccttgcggtgccacgatgtcgagcgcaatcggtgcaaaggcgatttcttccagataggcctcaatagtcggctgatgctttttgagctgcgcgatggcaaagcgcgagggggcctcgatcgtgagcgtatcttcggtcaggcttatggcgcgcgattgccccagcatgttgatgaggcgtgcatcttggccgtcgcgctggcaaaaggcgatggcatcccccaggatgatgcttgcttcctcgtccactgtctctcccgttctttagctctgagctcgcacgcgagcggcgccgagttcggtcagatggtatttctggccatgcttgatgaccaagccggcctgcgccaagtcattgagcgtgcgtgaccaagtgggggccgagtttccaaacgccctcgccagatcggtagcaccgcacgcttgattttgcgccagatagcccagcgcggcgttgccgcgatcgcttacgaacacgtccggttgtggctgcgcatactgatttgctgcattaggatacatcatttgagctgctggttgttgagaactctgcatcggcggcatttgctgttgaaaactttgaggccactgttggtaaggctgcggagtcatctgctgggcccaggggttgtactgctgctgcggcatctgctggtacggctgctgatatccctgctggtactgctgcgggaactgctggccataccccagtggcggcatctgctgatatggatatccctgttggtacggctgatagcccatttgctggccacccggtgcccccgtcgcctgctgcattgctgttgcatcctgatccgccagcggcatggcctctggcgcgtttggcggcatcgacatcgatgccgcctggggctcttgtgtaggaagcattccgggctgctgcatctgtcccacggggggctgcatctgttgcgttgccatgggctgctgcgcaaaagctcccggcaggggatatgtgggctgctccgtctcgggccgcacggcagcaccgcgtccgccggcacgctctatttcctgcacgcgtttagggtccaggcttaccgtaaccacggtgccgttgcccatgttgtcctcgatggacacggccccgccggcgttttccaaatactcctgcaccatgggaaaccctgctccggttccacggatgtagcgcttcatcttgctgtttgcgctggtaacgccaaagtcgaaagcacgctccttgtcgtcgatgccgggtccttgatcagcgaagcggatggtgtctccgccgtccagaatcgagatgatgggctcggcaaagtgcgcgtggataaagttttcgacaatctcgcggatgaccatgagcgagatatggccaccttgttctttcatgcactggtagacggtgttggtcgtctcttccaaatacgtgcggacatcttgcggatcaatgacgatcacacgcggtgtcgacagcatatcgtcatagacggcgatgcgcgcggcgtacatggcttttggcgcctgcgtggtcgtctgctcgccttcctcacgctcttcgcgcacgccggtgatgtgctcgttgtcgggtgccgggtctccggaatcgaccatggtgtaaaagtcgtcagacatgccgctcgcaatctttcaaaaggtttcgaacaaatagtagctcaccgtgcaatgtttctcatctttcgacaacttttcaaaacctgttgaaaactttggaaaacggacgaaaagttctcaacattgccaacatgacctgttgaaaactcgatgaaatatcgtgaaaagttgccatgcaccgctaaatcgagctcggcttatgggggaaccgtgtgaactgcgcaaccttttacctttgatttcttgacatttgaacattgatttccctacaatcttcaagctcacgtgtctatatctgcgtccgcgcccccgcggacactcgaaatgcagcaggaggaacttaagatgaagcgtacgtatcagcctaataagcgtaagcgtgccaagacccatggcttccgtgcccgtatggccactaagggtggtcgtgccgtgctcgcccgtcgtcgcgccaagggccgcaagcgtctcactgtctagcagcgatacacacatctcgcatgaagactattaagtctcggcaagatttcgagcatgtgttcagtcaggggcgtcgtttcaatcaccctctgattcgaatgaccatatgtgaatcggttggcgaaggcgactccggaagggtcgccttcgttggtgctaaacggctcggttgtgctgtcgtgcgcaaccgttctaagcgtgtgatgcgcgaggccgcccgcagctgtggatttcccgttgcgggttatgacatcatcttgttcgcaactcccaagacgagggtttcttcgcctcaggagatggacaatgcattgcgttcgcttatgaaacgcgccggcgttgccggggaggagcgatgagcaatcacgttttgcgacgtgttgccatcgctcctattcgcatatatcaacaggttatttcgcccttattgcctgacgcctgcatttattacccaacgtgctcgcaatacgccgtccaggcgattgagaagtacggtgttttgagaggctgctggcttgccgtgaggcgcatcgctcgctgcaatcccctgcacgtcggcggttatgaccctgtgccctagcgggcactcgctatcggaggaaaacttacatgtgggattggatcgttaacatccttttcgagctgctcaagctcatccagacctttgcggtcgactggggcctgtccatcatcatcctggtggtcatcatccgtctgctactgacgccgcttatgctcaagtcgactaagtcgacggcacgcatgcaggtgctgcagcccaagatgctcgagatccaggagcgctatgccgacgatccccagcgtcaggccgaggaaatgcagaagttctacagcgagaacaagttcaacccgatggctggttgtctgccgctgttgattcagatgcctgtcctgttcgccctatttacgctgctgcgtaacctgccggactactttaacgacggcgcgttctcgttctttaatattctgcccgacctgaccaccacgccgagtgcctcctttgccgatggctttatggtcgcgctgcctgcgctggtctgcctgatcctgttcgctgtcctgaccctgattccgcagctctatatgtcgcgcaaccagaccggccagcaggctcagagcatgcgtatgatggccgttgtcatgacggtcatgatgctttggatgggctggagccttcccgttggtgttctgctgtactacgacgtctcgtctgcttggcaggttatccagcagatttttgtgacgcagaaggtcatcgacaaggcgaaggccgatgaggaggagcgccttaagaacgcgccgctgcaggttgaggtcactcgtcgcgagaagaagccgcgcccgcacaagaagaagtagcgggatatcaatcttatttaggtacctaacttttggagtacgttatgtctgaagagatcatcgaggatatgcttgaggaggttgccccgcaggtcgcgggcgattatcccgagattgcacagcgctacaaggccggtgaagagctgaccgacgaggagctcgacaccattgccgatgtcgcgatttccatcctgcgttccatcctttcgcacttcgatgccgccaactctcctatcgatgagtatgagggcgacgagggtgagctgattctggatgtaacggctcccgaccttgctgttctcattggccgtcatggtcgcacccttgatgcccttcaggttatgttctcgcttctggtgagccgtaagcttggctttaggtacccggttgtggtggacattgaggggtacaagagccgccgccaggataaggttgcctccatggctcagtcggctgccgagcgtgctatccgcactcacaagagtatttcgcttccgcccatgaatgcctatgagcgccgactggttcatatcgcacttcgtggcaatgatgcagtcgatacccattccgagggttctgacccagatcgtcacgtagtgattgttgctcgataatctactcgagcttatgctaaggggacgtggtttccacgtcccctttttttgtcaaaagttctcgatacactgatttttgtcagaaaggagcttctgttgtttgtgcttactgatcagcaggctgaccagatgttgagccgacttagttcatattgcaaggagtattccttgaaagtcacagatcgtgatttaaaggaatgtatcaagcatctagatttggttcttgaaactaataagactactaacctgacgcgcattttaaatgttgatgatgcagccgtcctccatatcctagactcgcttgtcttactcccttatatcaataaggctccagagggagctttgcttgatatgggaacgggagctggttttcctggcatcccgctgactattgcgagtcatcgcaaggcaacatatattgactcggttggaaagaaagttgatgccgttaattcgttcattactgctctggggcttaaacatactcatgcagttcatgatcgacttgaggagtacgctcgttctcacaagaaacagtattctgttgttaccgctcgtgctctcgctcctctgcccgttctagtcgaatatgctgccccttttctcaaagatggaggactctttgtcatcacaaagggaagtccttctgatgaggaattgaattccggaatgtcagctgcaaagatttgcggcttctctacgctactgactgatgcaattgacttgcctgatggtcttggacatcgcgaatttatcgttcttaagaagactcatacggcttcaattgctttacctcgtgcaaatggcatggcaaagaagaatccgcttgcctagatgtttcacgtgaaacataatggttagtatcgactcgagatgtttcacgtgaaacatctcgagtttgatatcgaatcggaatgtttcacgtgaaacatcctccgtttaacagcattaatacacaccaggagggaccgtgggatttcgcgacgttaagcgttctaagagcgcaaaagacacgcgtatcattgcaatcatcaaccaaaaaggcggcgttggtaagtcgacgacggctgtaaatctcgctgcagcacttggtgagcaaggtcgaaagacactcattgtcgattttgacccacaaggtaacagcaccagtggttttggaatcgaaaaagaggatcttgatcactgtatttatgatgcattgttgaatgatgtacctgcagaatcgctcgttcttgatacgaactgcaaaaaggtattcgtaattcccgcaacaattcagcttgcaggtgcagaaattgagcttgtgagtgcgattgcgcgcgaaacacgtctaaaagatctacttgagccgattcaggatgagtttgacttcatcttcattgactgcccgccttcgcttggacttctaactatcaacgctttgacggctgcagatagcgttttgattccaattcagtgtgagtactacgcgcttgagggtgttacgaagctacttgagtcgatgaagatggttaaatcgcgcttgaataagggccttgatacgtatggcgtgcttatgacgatgtacgactcgcgtacttctctgtcaaatcaggtagttgaagaggttcagtcatactttggtgacaaagcgtttaagactttgattccgcgtacggtaaaaatctccgaagcaccttctttcggtgagcccgtaattacctatgcacctcaaaataagggtgcaaaagcatatatgaaccttgcaaaagaggtgattaagcgtgcctagtgcaaaaaaacgtggtggattgggccgtggactcaacgcacttgtgtctgaggctgagtatgagactggtggttctgcgacttccgcttcaaattcagcagcagaaaccaaacttgcgattgaggatatcgttccaaacccgaatcagcctcgtatccacttcaatgaaactgaactccgtgagttaagtgaatcaattcaggagcacggtgttctgcagccgcttttggttcgcaagcatggtaacggttatgagatcatagccggtgaacgccgttatcaggcatcgaaactcgcgggcctcgaagaactgcctgtcatcattaaggatgttaatgatgaagagatgcttgccctggcgctaatcgagaatcttcaacgttccgatttgaatcctgtcgaagaggcaaagggctatcgacaacttatcgatgcaagtggcatgacacaggaggccttgtctaaggctgtcagtaaatcgcgctcagcgatcactaattccctccgtcttctagaccttcctgatgttgttcagcggatgatttttgaaggaaaacttactgctgggcatgcaagggcgattttggctgttccctacgaagatgctcgaatcaggcttgctgagaaggtagtcgctgaaggactttcggtgcgtgcgacagaaaatcttgctccattgttttctgccggagagacgccgaagacacccagacccgcaacacctcagtcgtttaagaaggctgctcgcgttcttcgtcaggtattcaataccaacgtgcgagtgaagagctctcgcggtaagaataagattgaaattgagttcaaggacgaagaagagctctcccgtattcttggcgaaatgattcaatttggtcagggggatcaggatgaggaataagtttctcacagccattgctttggtaactaccgtcgccgctggtgcctttgccggatataagatcgcgacagacgatgaattgcgaggtcgactgcttcgcggagctcgggatattgtcgacacatcaaggaagaaaatggatgtgatgacagaagatgtcgcaatgcgcactgctcaggtaactaagaatcccaagattaaccaagattgggttaatcaccagtgggagaatgctggcttttaggtacctaacaattatcagccttttctaaaggggtccttgtctggcatatgagacaaggaccctttattttggttgaaaaaccgttatcgaaagttgttttcaatataatgacaaataaatgaaacagccccggttgcattatcgcaaccggggctgttctatgtttcacatgaaacgttatagggtgagactcccctatgcattcttctgaaccttgaagcgttgcttcaactgaccgcaggcagcgtcaatgtcgttgccacgagaattacgaatcgtggtctcaatgccacgggactcaaggcgacgctgaagatcttcgaccttgtggatcggagacggcttgagcgggctgccctcaatgtcgttgagctgaatcagattgacatggcacagcgttccctcgcagaagtcgcaaagcgcctgcatctcggggttcgtgtcattgacgccttcaatcatggcgtactcataagtcgggcggcgtccggtcttctcggtataaagctgcagtgcctcgtggaggcgcagcagcgtgtactttttaacgccgggcataagcttgttgcgcgtagattggatggcggagtgcagcgacacggcgagcgtaaactgctcggggatatcggcgaacttgcggatgccggggataacgccgctggtagagacggtaaggtgacgtgcaccaataccgataccgtcgggatcattgaggatgcgcagggccttgagcacctcatcgtagttggcgaagggctcgccctggcccatgaagacgacgctcgtcgcacgctcgccaaaatcgttagaaacgtgaagcacctggtcaacgatttcctgtgcggtcagcgaacgcttaaggccgttgagtccggtagcgcaaaaagcgcagcccatgccgcagccggcctgggtggaaacacagacagaaagcttgttacggcgcggcatgccaacggtctcgacggaaacgccgtcgtgatactcaagcagatacttgcgcgagccgtccttggaaacctgtttggtgagctctgtcggcgtatcgaaggcaaaggcctctttaagctgctcgcggaaagccttgggaaggttggtcatgtcatcaaacgaacaaacgttcttctcaaagacccattcgatgagctgcttcgcgcggaaggcgggctggccaagttcggcaacgagctcgcggatatcgttttggctcaagtcgcgaatgtcctgagatttagtcctgggattcatggaagcctttcgattttggggaaacgtagagggtatcgctacaatatggtatcagctgcagaaattatagaggaggagtctgcccatgccgggtaaaagcctagagaacatgcacgtagcggtcttggcgggcggtcattccgctgagcgcgagatctcgctcaattcgggaaagaacgttgtggcggccctgagggaggccggctacacctcggttgaactgctggacacggctgccgataactttatggtgaccatggcaaccggcggctttgacgttgcgtttatcgctatgcacggagccggcggcgaggatggcgccatgcagggcgccatggagaccttgggtatcccctacacggcctcgggcgtgctcgcgagcgcctgtggtgccgataaggaggtctcgaagctcctgtacgccaaggcaggcatccccattgcccctggtctggcgctcgagacgggcgacgaagtcgatatcgatcacatcgtcgaggtttgtggcgagcgctgctttgtaaagcccgccgtcaacggttcgagctatggcatctccctggtgcacgagccttccgagttgcccgctgccatcgccaaggcctttgagtacggcgataaggtgctggtcgagaagtgcatcgagggaaccgagatcacggtgggcgtgtatggcgaggatgaagttcgcgccctgccgatcgtcgagattcgcaagcccgaggactgcgagttctacgatctggacgtaaagtacgttgaccccacggatatccatcgcattccggcgcagatttcgcctgagaactacgcccgtgcccaggaacttgcctgtgctgcccacaaggccctcggttgcctgggtatctcgcgcagcgactttatcgtgagcgaggacggccccgttatcctcgagaccaatacgattccgggtatgaccgatacgtcgctgtatccggatgagattcgccatacggacgatatgacgttcccgcaggtctgtgacagcctgattcgcatgggccttcgccgagcgggcattgcatgctaatcaaggacgccgtatcccctggaacaccgcagtttgtcatcgattcctacgccacgcttgccgagcgtgccaagacgcagacgttcgggcttatcgaggaggatgtcatcgtcctcgacaccgagaccacaggtctttcggtgcaagacaatgagttgattgagatttccgcggcccgcctttcgggccgcgaggtcgttgaccgctttgatacctttgtgcatcccaagcagctgattcctgccgagattaccgagctcacgagcattacgaacgccgatgtggctgatgctccgtcggccgttgacgccgtggccgctctcgccgattttgtcggcggctgcccggtcatcgcgcataacgctaccttcgaccgttcgtttatcgagtcggtcaagggcggtgtcaacgtcagcgatatttggatcgattcattggcgctgtcgcgcattgcgcttccgcgcctggcgtctcacaagctgtcctttatggccgacctgttcggctgtgactcggtgtcgcaccgtgcgaatgccgatgtcgacgccctgtgtggggtatggcgcgtgctgctcgtggcgctcaccgacctgcctcagggccttatgacgcgcctggccgatatgcaccccgatgtgccttggtcttatcgtcccatcttctcgtttttggcgggtcagaacccgggctccatcttctcactcagcgccgcacgcgccgacgttctcaaggccgaccgtgccgacgatcgcgtggatgccgacgaactgccggtcctcaagatgccgagccgcgaagaaatcgaggcggattatgctccgggtggcctggtcaatcgcatgtatcccacctacgagccgcgtgatgagcagattgcgatggcactcgaggtccgcgatgcgctcgtcacgggtacgcaccgtgtaatcgaggcgggtacgggcgtcggtaagtcgatggcctatctggtgccttttgccgaggctgcacgccgtaacaacattaccgttggcattgcgaccaaatcgaataatctcgccgaccagctcatgtaccatgagctgccaaaacttgccgaacaactggacgccggcctgtcattttgcgccctcaagggctatgaccactatccgtgcctgcgcaagctcgagcgcatgagtcgcggccaggtcgagatcaccaccaagcgcgatccggctgacacgctcacggcagttgcggtcatcatggcgtacgtgtgccagtcggcagacggcgacctcgattcgcttggcattcgctggcgcagcgtcaatcgtcccgactttacgacggcctcgcgcgagtgtgcccgtcgactatgcccgttcttccccgacaaatgtctggttcacggcgcgcgtcgccgtgcggcgcatgccgacgtggtggtcaccaaccactcgctgttgttccgcaatgtcgctgccgagggtaggattttgcccccgattcgccattgggtagtcgacgaggcccattccatcgagcgcgaggctcgccgccagtgggcgcgcgtggtctcggccgatgagtcacgcgttctgtttgagcgcctgggcggttcgagctccggtgcgctgagccaggtttcccgtgatttggcgacttctgagggctccacgctctatcttggcctaaccgccaaggcgacatccaccgtcgcccttgcgagcatggcaatcgccgacgtgttcgatggcgttcgtgagctcggccgccgtgcccgtgggggttatgacaatgccaatctatggattggccccgagctgcgcgaatcggacgactggcatgattttatgcagtcggcgcatgccgccatcgacgcactggagcaagcggacaagagtgtcgatgcgctggtgcaagccgtcgccggcgataagcccgagatcgttgtcgacctgagtgatatctcgcatcgtctgcacgaactaacggagaacctcaaactcatcatcgatggtaccgatgagcactacgtgtactcgctgcaggttaaccgcagactgcgtgccggcggcgagtcaatgaccgcagagcgcatcgacattggcgaggccttggcaaccgagtggctgcctgaggtccacacggctatctttgcctcggcgaccatgacggtgtctaagagctttgagcactttaaccacgctgtcggactcgaccgtatcggtgcttcgacgtcctcgtcgctgcatctggattcgagctatgacttcgactcaaatatggccgtggtcgttgccggggatattcccgacccgcgcgatcgcgagggctatctgtcggcactcgagcgcgtactggtcgacgcccatcttgccatgggtggatcggtgctcacgctgttcaccaacagacgtgacatggaggatctgttcgcccgtgtggagcccaaactggcccgtgcaggcctggagcttaactgccagcagcgaaattcgtccccgcgccgtctgcgggaccgttttatcaacgagccgacctcgtcgctctttgcgctcaaggccttctgggaggggtttgatgccagcggcgagacgctgcgctgcgtcatcatccccaagttgccgttctcgagccccacggacccgctctcgtgcgagcgtaatctgcgtgaagatcgcgcctgggcacgctattcgctgcccgaggctgtgctcgaggtcaaacaagccgccggccgcctcattcgctcgtcgaccgattgtggcgtgctcatcttggccgacccacgcctagtgacgaagggctatggcaagaagtttttaacttcgctgcccacgagttcctatcagcgcattgaatcggcgcagatcggtcactatctgcagttgtggcgtgcacgccacgagcggcgccgctagagcgggcagactaaggtcttcgccatatcgcatagacgctttgacagagcggggtcatccagaatgtggatggctccgcccgctgctattacctggctgagcagccaacgctcggagccgtaacgcacgatcactgttgccgcacctgccccgtttggctcgatcgacataatacctgcccagtctagacgctctgccatgtcgagcggcatgaggagctttgcgctctgctccgcttgggagagggagtcgtgaagggatgcggtcgaaggcgcgtggcgctcgacagaatcctcggtgagggaaagaccttcgattttgtccatgcggtaggaacgttgcccatcaacctcgatgtcccaggcaatcaggtaggtctgatcgccatgcgtcgcgatgcgcaaagggtcgatgaggcgctcgcgcggctgtgcatcgtccatcgaacgataagtaatgcggcaacgaacgccgtcctgaatagcgctgctgagctgctgccagtgcgatccgcggacaacagtgtcgacgacgcgctgattgtagccgagctcttcgggaaggagagcatgtcgaatccgagccgccgcctggggctcgatccccagtgattcaagttcatgattgagcacggcgccttcggcggcactcaggcgcagcggcagcacgcgtccagcatcgccggtaagggatatgtgttcgccgttacgctcgcagataatgcgggcgcccgactcgcgatcagcgagggtcgagacgatatcgaggatctcgtccagcgaagctccggaaatgtcgaagcggctgcaaatctcatttctcgtcagccccgcgcttccggctgcgtagagggcttccatgatgtcgatggcacgcgagagtctctgctcgctggtgagtttacgagcgggcatgctcatgcaccgtcctttcgatgaggtggttccacgccaggttgagtgcatcgggggcaacgggcctcatgccgtccatggcatgggccatgcagaatgaggcggcggcgtcaaagtcgcgcacgtcaacggtccaggtccatccttcttcgctgcgtgcaagatcgcctcgcccgcgcgtgagaccgctgaccatatcggcttgcgactcgcgcgcgaacgagaacgttgccgcaacgggcggtcggtcggcaaaatcgaactcaaagaacaggtaatcgttgagattgaagtctgcgggaatggagtatgcctttgaggggcgccaagcacggacgatgcggtcgcagcggaacgttctgatgttgtcggtggcattgtccagaccgcagaaatacgccgtgccatcgtgttcgaacataccgtagacgcagacggtgcgctctttctgctcgccgcgaccgttctgatacaaaaagcgcagtgcacagcgctcggcaaaggcgctccaaactgcatcgacggtgggagaacggtgaatcggcgcctcgtctgcggcagatatgccggtgagataggcaatcttggaccggatgtcggcaagcggcgcggcaaaggcggaggagccggccgcaagcgtctggtcgatggcgtctagcaagatgtcggcatcgtctgcggtgatgagcccacctgccgcaaacgtgtgctcgcggtcgatcgtccacgagctttcctcggtctcttgcgcgccggcgaggcgaacctctttgattacgatgccgcgttcgagtagtttgtcgcgatcgcggcggaacttgcgcttatccgagtcgatgttgcccgagccataccccaaatcggaatccaagacgatttgttcggtcgtcaacggctcgggagaactgttgagtacaaagaaaagattgaggatgcgctgggccgttttatcgaaactgggttccggcgttccctttttgttaatagcggtcgtgtcgcttgccgtcatagagtcctcgcatgggaaggtggtttgctgccatgattttagtccgatatggagattaggctatatccttgtccgctcggggcgttaagatggcccgaattcggtcgtttgcgctcgctcggggtatactttcgactatatacggttctaatgtgcatgcattgggcctatttgtcggattatggatgtggagcgcacatggcgaacacccagaactatatcaaccacctgctgcagaacgccggcatcacgccggcatgcagcgaagaagagcgcttggctgccgaggatatcgctcagattttccgcaaccatggctttgatcccgaggtgcaggagtttaatgctcccgcgccgagcaggctggcatttgctattaccggcatccttgcgtttgtcggcgccctgcttatgggtatcggtggcggcatcggcttggtcggtaccctgctggccatcatcggtgccgtgctctatgtgctcgagcgtaccgggcatcccgtgatttcggggctgggaaagacgggcgtgagccaaaatgtcatcgcctatcacaaggcttctggcccgctcgcgtccccgcgcaatcgcccggtggtcgttgtcgcacattacgactcccctcgcgccgagctgcttgcccgcgagccctatgcttcgtaccgcgcgctcatcgctaagttgctgcccgtcgccacggttgcccccgctgccgtcgccgtcctgcgtatcctgccgcttcccggcgcgctcaaggttctgctgtggatcgtcgcgattctcgcctctctcgttgcgctcgccaacgcggcaaacatcatctccaatcgctacatccttccctatacgtccggcgcggtgtgcaacaaatcttctgtcgccgctttgcttggcgttatggacaatgtcgcccccttccagggcgagaatgagttccccgacgatgttccgttcgacacctattttagtgagcaaaaacgtcgcgccgaggagatggcacgtgcggcggcggaatatgccgcggcccagcagcaaaacgactatggcaacaccattgagtacgaagagcctacctacgaggaggacgagtttggccagccgatcgcttccgatgatcagctcgagtccaaacaaggcgaggctttcgacgagcagatcgatggctttgagggtgcatctgccgacgagacgctgatcggctccattgtgcccgaggcacagggccaggctgtccaagtcgaagagcctgctgccgaggttcccgctgccgagtcggcggaggagtctgttgtggtcgagcccagcgagcctgagcctaagctctatcgcaatgccgccggcaacatccgctttggttcggatgccatccgcgcactcggcatgcttcccgagtcctgtacgctcgattacgaggagggcgaggagccgacattcgagcccgagcctgcccccgtcgcggatgcacctgcacccgccgctgttgcggacgacgggtccgctgcggcttctcctgccgttgcggagtccgaggctatgcctgcaatcgatcccgcagcgggactggacattctggcacccgccgcgccggcgcaggacgtcgcggacgagtctgacgatgattatgccgagcaaccgcgacgcgtgtcttacgagagtgataccgatttctcggccgagattcccgcggcgacgccccatgccgatattgcatccgccttctcttcgattggggccagtgcttccagcttctttaagggtgcatttgcaaagggcaagaaattcatcgacgactttgaggaaaagcgcgccatcgcacgcgaggctgccgagcaggaggctatcgctcagcagcaggcagccgaggcggagcgtgagcgtgcggcgcaggagttcgaacagaacgaggctcagcagcccgtggccgtcgacgctgccgaagctacgacgtcttttgagtcccagcaaccggcatccgctgatgttgttgaggcgacgacgtctttcgagccccagcagcccgttgatggcaccatgtcgttcgacgccgcgcagttcgatgccacgataacgtttgaaaaacagggcaccgcgattgctgagccccttgaggcttccgatgatcaggccgctgtggcaaacgatgccgagaccgccgatgcggttgaagtcccggatgctgccgaagaccaggtcgttgaggtcagtgctgaggaagagcagcacgtagcggttgagcagaacgattcggccgaggtcgagcaggatgaggcagctgtggtctccgaggtttccgaggcgcccgagacggacgagtcgagaccttactccacgcagattttcaccatgccgactccgggtggttctggctccacggttgccaacgtcgcccccactcaggacgaaacggtcgattccctcatggcgcagatttcgtctcaggccacgccgcgcccgcagatgaatgttcccgatccggcgtcagttccggtgcctacgccctcctcgtcgccgttggcttcggttcccgatccgtcgctgccgtcgatgaagcaggctaacgttgcgtctcgcacgtcactgttcgaccttcccgacccctcggctcaggtcgatgaccccttcgcgacggcgcagggtcccgagcccacgtcggcgcccgttgcaccttccatgcccgtcgcgtcgggctcgcagccgctcgagaccatctcggctcccgcttcggccgcgcccaagccccgcaagcgcggtctgggcggtctgtttggtcgtaaaaagaaaaacgatcaggacagcatgagtgactggctgggtgtcgaagacgattacgatgctaagaagtctggccgcggtatcggctcgtgggataacttcgaggacgataacgacggctggaagggcggcgccacgtcttccgatggtgcatctgacgaggacatgctctcggctgtcgcttctatgggcgatgacgaactgcttggtcacgatatctggtttgtggcgacgggtgcctcggattgtgatggcgccggcatgaaggcgttcttggcctcgcatcgcgataagctccgcggcgtattcttcatcaatcttgaatccgtcggcgccggtaggctttcggtagtgacggtcgagggcgagcagcagctgcttaagggcgaccgccgcatcatgaatctggtcagcaaggtctgcaagtcgttccatgtcgattgtggtgcgctcgagatgccctatgccaagaccgatgcctatgccgcactcgaggcgagccgtcgtgccctcaccatcgccggtgtggacggcacgcgcctggcttgtgctcgcaccgaggacgacctgccccacaacgttaacccgacgaacattgccacggtatccgaggtcgtgaccgaggttatccgccgttcgtaggcggagctctaaggagtcaacgtgttttcgttcattaaacgtcattggcctgtttatttgattctgacccttattgccgtcgctttgggatttggggctgcctatatcgtgggtgtaaaggggtcgacccccgcatccgcaatcagcgaagaggtggagcaagagcaaagtacgggtgccgatggaatccccgagtccgagcaggcgctcgtcgacagcggatcttcatctgcagaatagccgcggcactttacatggctaaaagcgggcgaaccgggagactggttcgcccgctttttatgcattagcgcttctttgggatcgacctaaggcgagcgaaccatagggctgccgcacccgaggtcaggagcgcggtgatgcaggcagcgatgggaactgatcctgttgccggtaggtcctgcggtagggtgcagcgctgaatgacgcggtcctcgtcatgtgactcaagtttatcgccgccgccgttgcggcaaagatcgacgcgtgcgctgttgatgagcgcagtttggggtgtataagccgatgtcgtctgcatgtgcacaactgcgccccgggcgtctgtgccaagggttgccttggcgtcatcgagatcgtcatgttcgtttttaaggtcttcgcgcttccaagaatcttcgtcgcacctggttgcaaagtcggcgtctaccgcaccgtactcaaggcgaatgcccgttacgatggtatcgacgggaaggtcgagctcatttacctcaagcgtgattgattttgtggtcgggacatcggttttccagagttgccagccttcgtaatcaacgagacggcggtcctcgcccaggctctctttaacttcgtcggactcaagccaggggttttcatgtccatcgttaagcgtcgcgtttgcctgctcgtcgatgtctgacgagcccagcggcgttgtgcggtaccacacgttgcacagaccgttgaggtcgccgatggcaataggggtttcgattgagacgagtcttgccgtgccgtccttggcgcactcaagatcatcggtaatcgtgaactcatcaacccaggtggtcgactcgtttcgcgcatcgacggtgtaggagaaaaacccttccgcatcggcttgtgtcgcggcgcggtttttgccatcgccgttagccaagaggccatccccggtgggctgggcaatttcttgacgtttgtcgacctgccccttgatctcgatcggcgcgtccttcattgcgaaagattggacttctcccgtagccttcacttcaaacgttatctcctcagcaaggtcgtaggtccgcggggacatcatttcgcgcaatgtgtaggtgccgggcgcaagatgtccgatgcggtgcggcttatcggatgaggtccaggagtctattccggtttcgtcttgtccatatagggtgagctgagcgccctccacctcttgttttccggttaggtcgacttttgagatatcgatcttggtgaaatcgtcggatactccgagatgggcttcgatgacggacgttgtctggtcggcatatgacagctcgaccgtatggggactttggtctaggagatatccttcgggcgcttgggtctcaacgacttcgtagcatgcggttccacatcccagcgaaagatggctcgcacgggcggacccttgctcgtcagtagttacggtggcgacggtttcaccatccagggcaacgatactgccgtcagggcgaataatatcgcctgcagctcggatgtcaaacacggcccccatgagcttgcgctcgtcggtagcgtcggactttacgatttcgatgcttccggttgccgcatcgtcgaagtatgaggcaatcgcaacgggcgttagatacctgtcggcggggattgttatctcgagatcctctccgacaagataaggtttctttgccgagacttctcgcacgtagtaggtacccgggttaagagactcgggcagcgtgacggtaccagttgcgtcggtcgtaaaggtgttcaggacattgtgggtcggataccagcacgtttgtgagatgggctcgtggttgctgtcgagcaactggaagctaaagccggcaaggggaactgcggcaccggtctgagcgtcgcgcttaacaatctggagatgcgtcgacagggcatggttgtccacgatgtactgaagctcggcaccgtcggcaatctgttcagccgagacggcccattctcctgcctgtttaaagccttcggggacggattctgggacctcccgaagtgtatagccggcacggtcgtaggggatggctccgtgggcgccatcgggtcgcttgccggcgccgaaccatgcttcgggctggtctttggtagaggcaaaaccatagatatttgtggtcaacgtgccaacaacctgttgtgagctattgctgatgacttcaaagacaacgccttcagcgggctgttccaagccagactgatcgctgttgccatgatctttaaatttggaaatctcaaggtcaaatgcaatcggaatatctgaaatgcgcgattcgagctcgacgacgcccgaatcgcccaactggtcggctccaacggtgtaggtccagctgtcgctgggtagcaggtagccctcgggggccttcgactcatagatggtgaaggttccaaggggaacgttatcaagggttgctcgaccggtttcgtcggtcgtgagggtttgcgtccatccgggggtggattgagagacgcaggtaaactcggcgccggcgagcgaggcccccgcttgggctccggcacccgttgcggcgtcaagctttatgatgcgtagcgtgatggtgcctggctgctcatcgattgtgacatggccaccaccgccctccgtggtaaaggggatgcggtcgcgtcgagggatatagcctgccggtgcctttgtctctaccaggtagtatgccgtgttgggtaaaagtgttgcctgcgcttgaccgttgctgttcattttgatggtgccgacgcgcacgtcgccggcgctctcaaaaacatcgaatgttgccccgtcaagctgataagtattgtttccgttggtaatggcagcgtttgcagactgcttttggaaagaaacagagaccgctggcagcacgtagagcatgtcttgacgtttgctgccgcccgatatgggtcccaaatagcgccgtgcgcggtgcggagcggctttgatgcctcccgattttgcattgtcgtgaagccaccgtgcggcagccacaacctcattgtcggcggtaaaatgcccgctctttgttttgccttgagctgttgtataggagtaagtgccgtcgatatgggtggtgccgttaagcatccatacggcaagttgagtggcggcacgggcgcgatcgggcgacaggctgtaaccgccaaacgacgttgcggaaggatatccgtgacaaacgatcgccgcgaactcgtcgtcgagccatacccagccctgatcaaagttgagccatgggccacccggcttggtgggaccgggacgttcctggttcatacagtacgcgattgaggcgtcttgagcctcgtacttaccgatgaagaagggcccacaatcgtcgctaatggtgcgaaagccgagctgatcgtacccgtcgatggcaagtgcgggtctcggagccaagcaactgatgagtaggaagaggagtaggagcagcgggcctgttgcgattgcgctgtggacagagtgcgtgggtgcgttggacatggctgctccttatccctcgtgcgccgcacggggaggctgcggcgcttgggacgaggctacccccgaggttcatgcgggtaagtaccggaagctgaccaaaagcttgcccgatttccgacaaattgggttcatatggaacaatcaaataaaaccgcaggtaaaagatggtgaaataaggacaccagaggtccctgtctccacaattggactgtttttcagacgattctccacagctaaaacaagcatcgacacccttgtatcgaacaagacaaccgcgttatactagccaacacacaagcgggcatcgccaagtggcaaggcatcagcttcccaagctgacactcgcgggttcgagtcccgttgcccgctccaaaaaagttaaagcacgataccgttccggtgccgtgcttttttcaataaagtgccgggactcgaacccgacagggtgcgagcgttaaataaacgcgaagcgtttatagcgagcaggcgaaggcgccgcaaggtgcctgaagccggtgcgcgtccgcgacgcggacgcgcggacgtcccgttgcccgctccaccgagcatggcagatttcgggagtgcggattcagcccgccttgccctcgcatgttcccgagcccggattcgccgaccgcagccggtgcggatttgcgaagcaaatacgcggacgtcccgttgcccgctccaatctcaaaatgttaggttgatgcccgtagctcatacgggcacctgcgcacggtacaatagtcgagttacgaccaacgtgccaataaccaaaaaggagccgctatgatcgatcgctatacccgcccggagatgggacacatcttctccctcgagaacaagtacgccatttggcaggagatcgaggtcctggcctgcgaggcccaggcggagctcggcaagatcggtatttccaaagacgaagcccagtggattcgcgaccacgccaacttcgagaaggcaaaggtcgacgagatcgaggaagtcacgcgccacgacgtcatcgccttcctgaccaacatgaaggagtatatcgatgccgacgttcccgagggcgagcccaagcccagccgctgggttcactacggcatgaccagctccgacctgggtgatacggctctgtgctatcagctcactcaggcttgcgaccttatcatcgaggacgtcaagaagctcggcgagatctgcaagcgtcgcgccttcgaggagcgcaacacgctctgcgccggccgtactcatggcatccatgccgagccgatgaccttcggtatgaagtttggctcttgggcctgggagctcaagcgcgatctggaccgtcttgaggacgcccgtaagaacgttgctttcggtgccatctcgggcgctgtcggcacgtacagctccatcgagccgtttgtcgaggagtatgtctgcgagcacttaggtctggttcatgatccgctgtccacgcaggtcatcagccgcgaccaccacgcctacctcgccggtgtgctcgctaccacggcagctacctgcgagcgcattgcgaccgaggttcgcaacctgcagaagaccgatacgctcgaggccgaggagccgttccgcaagggtcaaaagggcagctccgccatgccgcacaagcgcaaccccatcaccatggagaaggtctgcggcctgtcgcgcgtcgtgaagtccaacgcccaggttgccttcgacaacgttgccctgtggcacgagcgtgacatttcgcactcctctgccgagcgcgtcgcccaggccgacagctttatcgcccttgaccacatgttccagtgcctcatccgcgtcatcgatggcctgcagctgtaccctgcccgcatggtggccaacctcaacaagacccgcggccttatcttctcttccaaggtgctgctggctctcgtcgacacgggcatcacccgcgaggacgcctacgccatcgttcaggagaacgctatggcaacctggcatgaggtgcaggattgtgtctccggccccacctttaaggagcgcctcgaggcggatccgcgctgcaccgtcagccaggagaagctcgacgagatcttcgatccgtgggacttcctcactcgtatcgatacggtcttcgaccgtctggagcagctgagcttcgagtaggctctgccgcgacattaacttgtttgggcgctttgctggtaatgtgtgttgccggcaaagcgccttgttgtatccgagaatagacagcgataataagtgacttactgtgtatttgagaggggatcgcaatgattagttttgactacaagccgcagggcgtgtgcgctcgcaatattcacctcaatctctctgacgacggcagcaaggtgctgggcgtcgagtttaccggcggttgcgatggtaatctcaaggccatctctaagctggtcgagggtgctccttccgatcgcgtgattgaggttctcgccggaaacacgtgcggcatgaagaagacttcctgcgccgatcagcttacgcgcgccatcgaggccgcccgcgccgagatcgcctaatgggcattaccgactacattaagaacggaatatcgcgtcgcggtttcgtgcttggtgggactgccgccggcgctgccacgctgctcgctggatgctcgaaaaaaacgggcaccagcgatgatgccgccggtgagcctcaggtcatcaaggacgattccaagatcgtctcgattacagatgaatacgaggccgtcgacattgaccttgagcccgcagcctcgtggacgctgccgctgggcacgctgctgtattactgcgatggcgactacgctgccgcgatgatggcgcctgcttctgccctgcatgccaatacactcggcgtgctcaacctgggcgatggctcgctcaccacgcttatcgaggatcccattgaggggaccgggtacgcgttttacgatgtccgtgccggcgatggcgtgtttacgtgggttgagatgaactttgccaattcatcgtggaagctctacgctcaaaatctgtcaggagcttcgcttgccggtgatgtggttgaactcgaccggggcggcaaggactacgatccgccgttgttcacggcgttcgggtcatcggtcgtctggtataagatgccttcgtcgagtggcaataaaacgagcaacgattcgttctgctatcgccgctcagtcgatgagtccaaggccgagacaatttggaaatcgacgggtcgctttgcatccgccccgcgcgtgagtgacggcatcttgaccatctctccgcgcgtccacaacgacgagggcgtctactacggtatgacggcaatcgatctgaccgacggcaacaacaccaagcgtgcccagctggttctcccctcgtcggtctcgcctttcgaggccgtgtatatgggcgatacctttgtgttttccatcgaggcgacctatagcggcgtgggcagcctgggcaatatgggcacgtatatcggcaacgagggcgggccgtaccttttcctgtcgcgcgagccgcttgcgtgtgctgccggcaagaagaataaatacctcgttaaggtccaggcatcgcatttcctaatcgatacctctgccaaaacctacggctcgctgttgtcgcccgatcgtgctttggaatatggcgattatcctgctacggcgggaaaatcggactcattccttacctatgcgacggtgcgaaacagccagggtatacccgagacggttaccgcacgtctattctctctttgaccttagaggggttaaaaaggcgtcaacaggggaataagcgcgttgtaattgtgagtaccgcccgccgagctgccgtaccatagcggcgctcggtgggctcaggtgcgttaaaatgggcttgttcttagctaattgagacaggggggccgtgttatggcttcagatgcaaaaaagattctgttggtcgaggatgagaaggcaatccgtgacgctgtcgctgcctatctcgagcgcgagggctactgggttgtgggcgtcggtgacggtcagtccgcgatcgaggagttcgagaagcatcagttcgacctggttgtgctcgaccttatgctccccaagattcccggcgagcgcgtttgccgcaccattcgcgatacctcggatgtccccattatcatgctgacggccaagggcgagatcgaggaccgtattatcggtctcgagctcggtgccgacgattatctgatcaaaccgttctcgccgcgcgagcttgtcgcccgcgtccgcgctctgttccgtcgtgcccatcaggccgatgagcccgccgtcgaggtgctcgacttcggtgatctggtcatcgacatctccggccacaagattctggtcgagggcaaggaagtcgatctgacggcttctgagttcaagctgctcaccacgcttgcccgtcaccccggtcgcgtctataaccgcatggagctggtcgagaaggtgctcgggtacgactttgagggttacgagcgtaccatcgacagccacgtgaagaacctccgcgccaagctgggcgacgatcccaagaagcccaagtggctctacaccgtccacggcgttggctatcgttttgaggctccggccaagaccgataagtcggacgagaaataaggtaatcgcatatgacacctgcgcgctttgaaatcggacaaaagcacaagcaggagagcgaggcgggttccaaggcaagttggaacacgcctcgttccgattcacggccgacgatgagctatccctcgcgtatggccctggcttttgctttgacatcgctcatgacggtactggtactggtgggcgttgtctccgttgtatggggtacggtttttacggactacacgcgctccaatatcgtcgagatcgccaattccgctgccgaaaagcttgcgacatcgtacgaggaaaacggcaactggaccgcgggcgagcttcgcacggtcgcgacatcgagcctggtgtccgacgatcttggcatgcaagtcgtcaataaaaagggcgttatcgtctacgacgactcgtggccttcggctagcgctaccgccgatgtgcgcgaaaatcaggcaacgaccgacgacacgagtggcaagagggcatcgcacagcccggtctcctccgcccccaccgactccgacagcgtggccaacgtcgagatcgtaacgtcctccggcgagcatgtgggccaggtcaaattgtgggcaatcggctccgacgccctgcttaccaaggcggattctgcgtttagggagaagacctttaacgccatggcgctcgccgcggttgtggccatctgcatttcggtcgttatcggatcgctcgtgtcgcgcatgctcaccaagccgattcatcgtattacgagcacggccaagcaaattcgcgatggcgatctgtccgctcgtactggtttgcgcggtgatgacgagattgatcagctgggtgagaccttcgatgagatggccacttcgctcgagaaggatatgaaacacgagaagcgcctgacctcagatgttgcacacgagcttcgcacgccgcttatggccatgctcgcaacggtcgaggccatgcaggatggcgtgtatcccaccgacgatgagcatttggagaccgttgcctccgagacgcgccgcctggcccgtctggtgcagcagatgctcgacctgtcgcgtatggaaaacagcaccgcgccgctcaatcttgaaccggtggacatggtgccgttcgtgcgttcgatcgtgaatggtcaggagcgtctatttgccgaccgcgatctgcgtctgcgctttgcggatgaaacccagggccatgacgatgtcgtcgaggccgatcccgatatgatcacccagtgcgtcatcaacctcctgagcaacgccatgcgctatacccccgagggcggctgggtcgtggtgtcggtgctcagcgaccgcaagcatgtcaacatcgcggtttcggataccggtatcggtattgccaaagacgacctgtcgcgcatcttcggtcgtttttggcgcgccgacgccagtcgtgcccgcgaggcgggcggcctgggcgtgggccttgccgtgaccaagcagatcgtcgagcgccatcatggctacatatccgtggagtcggagcttggaaagggtacgacttttacgattcatctgcctcgcgagcacacggcggacgcggcatctactacaatggagcactagcttttcgctattcggtgaaggagggggtttcgtccctgccgctccgggtttgcgaaaacgtgcgggaaagagcccgcattactgtcgtattttggtaaggagtgactcacgtgacaacgatggagcgtcgtccggattcccgtggcaaggttcgtgatatctacgatgccggtgaaaacctgctgatggtcgccaccgaccgcatttctgcgttcgacttcattcttcccgacgagattccgtttaagggagaggtgctcaaccgcatctcggcattctggttcgataaatttgccgacattgttcccaaccacctcgtctccatcgacccggcggatttccccgaggagtttgccgagtatcgtgactatctcgccggtcgcgccatgctggtcaagaaggcccagacgattcctatcgagtgcatcgtccgcggctatctgacaggttcgggtaagaagacctatgacgagaacggcaccgtctgcggcattcagctgcccgagggcctgaccgaggcctctaagcttcccgagccgctgttcacgccgtccacgaaggccgagatcggcgaccacgacgagaacatctcgttcgagcgttgctgcgaaatcgtgggcgaggatattgccgagcagatccgcgacctgtccctcaagatttacaaggctgctgccgagtatgcagcgacccgtggcatcatcattgccgacaccaagttcgagtttggtgtcatcgatggcaaggtcacgctgatcgacgagtgcctcacgcctgactccagccgtttctggcctgccgccagctacgaggagggcaagattcagcccagctacgacaagcaattcgtccgcaattggctcaaagccaactgggatatgacgggggagaccccgcacctgcccgccgaggtcatcgatggcacgtccgagcgctatcgcgaggccttccagatcatcacgggctcccagttcacaagcatgaaggagaacgcataagtgagtacccgtagcgccacgaacaagcgcacgcaatcccacgaggttaccggggttgcgcgcaagtccgccgcatccgccaagcccgtccgtcaggcagcgagctctgtccgcgtcgtgccggcttcgtctaaggcacgccgcaaagagctcgagaagggcgagaacctcgagggcctctctaaagaggagaagcgcgcccgcaaggctaagcagcgcgccaaggaggatcgcatctacacggtgtcgaatatccttctcaagcaggatgaggactacaccaagcgccgccgcatctggtgggccgtgctcgctatcggcatggtgctcgtcgtggccatttgggcttcgctgtacttcgctcccgctggcatggtgtccagccccgtccagatggtcggcatcgttttgtcctatgtcatcatcctgggtgactttatctacgacttcgttcgtatccgtcccctgcgcaacatgtaccgcacgcaggccgagggcatgtccgagaacaagctcaacgctcttattgagcgcgcggctgccgaggaggacaagaaggactccaagaagaagtagcgtttgtattcatacatatcgctaagatataaggcgcgtcgttttagcggcgcgcctttttactgttctatagatagatggagtggcacatgattcgagctgccctgacggtcgaagaagccctggagggcatgaaggccctggagcccaagattaaaaactatgcgcgcctggttgtccgcaagggcgtaaacgtcaagcccggccaggaggttgtcgttcagtctccggtcgagtgcgcgccctttgcccgcgtggtggtcgcggaggcttatgccgccggcgctggtcacgtgacggtcatttgggccgatgatgccgtgacgaggctcacgtacgagcatgtcgataaaagctattttgagcagacgcccgagtggaagcgcctgcagctggattccctggcccaggacggcgcctgctttatctttatcgagggtgcggaccctgccgcccttaagggcatcgatcccgccaagcctgctgcagcttctaaggcaaggaatacgcagtgcaaggtcttccgccgtggactggactacaacatcaacccgtggtgcatcgctggcgctccggtcgtggcatgggcgcgcgaggtgttcccgggagacgccgatgaggttgcaatctataagctgtggaatgcgattctgcacaccgctcgtgccgatggccaggacccggagagcgactgggagcttcatgacgcggcattcgaaaagaacctgcgtttcctgaacgacaatcgttttgaccgcctacattacaccgcggcaaatggaaccgatctgacgattggcatgacgaagggtcacgagtgggccggcggcaagggtaagacgcccgatggacaccccttcttccccaacatccccaccgaggaggtcttcacctcgcctgatcgtatgcgtgccgacggtatcgtgtattcggctatgccgctcattcaccacggtaacaaggttgacgatttttggattaagttcgaggccggccgcgtagtggactacgatgcccgtgtgggcaaggcgacgcttgcgagcattattgacaccgatgaaggtgccgctcatctgggcgaggtcgcgctcatttccaagaacactccgatccgcgaaagcggcgttctgttctatgacacgctctatgacgagaatgccagctgccaccttgcgttgggcgtcggtttccccgagtgcatcgaaggcggatacgacatgtccaaagaggaacttctggagcatggcgtcaacgtttcgagcacgcatgtcgactttatgatcggcacagacgacatcgatatcacgggcattacgcctgatggacgtgaagttgtgattttccagaacggccaatggagttgggaatagtcccagaccgtggtacaatgccacccgcgggccgttagctcagctggcagagcaggggacttttaatcccaaggtccagggttcgaacccctgacggcccaccatagaaaagaaagcgatcgactccggttggtcgcttttttgttgccggtgcatgggttcgaacccgaaagggcgcggagctgaggaaacgcgtgagcgtttgccagcgcagcgcgcaaggcgcgaagcgccgcggcggccgcctgcgaagcaggccgaacccctgacggcccaccatagaaaagaaggcgatcgactccggttggtcgcttttttgttaccgccgcatgggttcgaacccggttttctctatatataagaacgcttggcgaacaaaacctgccttttaccgacaggaaacaaatagctgatgcttttggagtaaagtggcgcaccagagatgaccgatgccttaacacctataaaacagctggtcatcgccaatatcagaagccgatgcttcagttttaacctcagtgatgcggctgagggatctattcatttgtgaacaaaatatggagtgcgcgattcccgcccacgggtgccctccggtctggcaatatatctccttgccgcgcggcccggtcggaccggatgagattaccgttatcgtctccggcacgtccggcggcgaggttactgcagcccgtctgagcgatttctgcaccgccccggttaagggcttcgctgacgctctgcccgtctgcctcttcgttatgatcctgggtggcttcctcggtatgatgaccgagaccggcgccctggacaacggcatcgccgttctggtgcagaagcttaagggcaatgagattatgctcattcctgtccttatgctcatcttctctctcggtggtaccacctatggtatgtgcgaggagaccgttcccttctacgccctgctcgccgctaccatgatggctgctggcttcgaccccatggtcggcgccgctaccgtcctgctcggtgctggctgcggctgcctgggctccacggttaacccgttcgccgtcggcgctgccgtcgacgctctgaccggcgttgacatcgctgtgaaccagtccatcatcatcggcctcggcgccgtcctgtggattgtcaccaccgctatgtccatcgtcttcgtgatgagctatgccaagaaggtcaaggctgacaagggttccaccatcctgtcgatgcaggagctcaaggacgccgaagaggctcacggcaaggctgcttccgaggttaacaaggaggtcaagctcaccggtcgtcagaagggcgttctgatcgccttcgctttcaccttcgtcgtcatgatcgtcggcttcatcccgctggccgacctcaacgagggcgtcgccaacttcttcgacgctggcgctgtctacgacgccgacggtaacgccgtcgtccagggctggtctgccctgatcaccggcctgcccattggccagtggtacttcgacgaggcttccacctggttcttcctcatggctatcctgatcggtatcatcggtggcctgtccgagaagcagatcgtcaacaccttcatcaccggcgctgccgacatgatgtccgttgtcctcgtcatcgctctcgcccgtggtatctccgtcctcatggctagcaccggcctcgacgtctacgtcctcgacgctgccgccaatgccctggctggcctgtccggtgtgatcttcgctcccatgagcttcctggtctacttcggcctgtccttcctgatcccctcgacctccggtatggccaccgtctccatgcccatcatgggaccgctggctgttaagctcggcttctcgcccgaggtcatggtcatgatcttctccgccgccatcggtgtcgtgaacctgttcaccccgacctccggcgccatcatgggcggtctcgccctggccaagatcgagtggacgacctggctcaagtttgcccttaagctcatcgtcgcgctctccgtcgtctgcgccgtcattctgaccgtcgcctgcgtgctgctctaagtacccaacgggtaccccacggaaaccttgacgatcctgtagaggatcacctggtcatcgtctgtccggtggggtaaacccaccggtagactcctacctttagccccctcccgttccgtgcgcgggagggggcgctcttgtgttccggcgttttaccaaacgccggaaccactcgacgctgcaagcccgccagagcggcaatctgacgttcaatcgtcgggcatggccaaaaggcctatgccctcctctttcacgtcaccttgctcgctctggtgggctttcgctgacttatgctcaacctgcggcgctgccattgttggcgcagggggcggcttgctcgctctggtgcctgttcgctgtccgttctctgcccgcgacgtttctgctgttggtgcaaaggggtcaggttaatttgcgccaaaaggggaagttgcggtggaatagttcccgtttggccgtcttgaggggttaaacaggagctatttcaccgcaacttatcgatggcgtgtttggttggtgcctgttgatggtctgggtatcggggagggcgggctccgttataatcgcctagaacattaattggaaacgggacgggagccatacatgcgccagggtttcgacaacgcgaagtatatcgagctgcaggccgctcatattaaggagcgcatctcgcagtttggcggcaagctgtatttggagtttggcggcaagctgtttgacgactatcacgcgagccgcgtgctgcccggatttgagccggacagcaagtttcgcatgctcaagagcattgccgacgacgtcgaggtcatcatcgccattaacgcgaaccacatcgagaagaacaaggcccgtggcgacctcggcattacctatgatgaggacgtgttgcgtctggttgacctgttccgcggcaacggctttgccgtcgcggccgtggttatcacccagtacgccggccagcctgctgccgacgtcttccgcaatcgtctgaacgcgctcggtattcccgccaagctgcattatcccatcgagggctatccgcacgatgttgacctgattgtatccgacgacggctacggcaagaacgagttcgtcgagactacgcgtccgctcgtcgtggttaccgcccccggccccggctcgggcaagctcgccacctgcctgtcgcagctctaccacgagcacaagcacggcaccgccgccggctacgccaagttcgagaccttcccggtctggaatcttccccttacgcacccggtcaacattgcctacgaggctgccacggctgacctcgacgatgccaacatcattgactccttccacctggaggcctacaacaagaccacggtcaactacaaccgcgacgtcgaggccttcccggtcgtgcgtgccctgatggagaaaatcttgggcgagagcccttaccagagccccacggatatgggcgtcaacatggtcggctttgccattaccgacgacgaggcctgccgcgatgcctccaagatggagattgtccgccgctactttgccgcggtcgaggccgtgcgccgcaccggcgtgggcgacgagcaggtcgaccgcctcaagctcattatgaagaaggccggtatcgacaagaattattcgccggcgcgctcggccgcccttaccagggagcagctgacgggcggtcccgtgggcgctatggttatgccggatggctctgtggtgacgggtaagacttccacgcgcctgggcgccgcgagctcgctcatcatgaatgccctcaagcatgtctcgggcgtcgaccttgagctcgaggttatcagcgacgaggcgatcgagcccatcagcaagctcaagacgcatttcctgggcagcaagaatccgcgtctccataccgatgagacgcttatggcgctttcgattacctcggccacgagcgagacggcggcccgtgtcctctcgggactggaacagctgcgtggctgcgatgccttctttagcgtgatcatctccccgacggatgagacggtgctgcgcaagttgggcatcaacgtgtgctgcgagcccaagttcgaacgccgtgggttcttccaccgctaagacgagtttattggtctgataaggccgcatggggtatatgccctatgcggcttttttatcaacaaagcctttgttcgaggtaaaaataggccgtttacctgcctataagcgttttgggcggtatacaataacgctgatgaaacatcctttgtgggatgcgccggtcgtgcacggcgcgttagatgctcgtgctcggtttgaggaggctgccatggcgggcaagggtcgtgcgagtgtcaacgatatgaagcgtgtcgaggtgctggtgctgatggagatcgctcagcaaaccgaaggcaatggcggaccgtatggcttctctcgcaaagcgcttgccgagcgcgtgggagtttcgccgtatcgcgcccgcgccgcaatcgatcgcttggattccgaaggcatgatcgatgtcgtctcgcgctatagcgacgacggcggtcagcttgcgaatggtattcgccttaccgagcgcggtgagtggtatctcaagggcgtccgtgccggtatgctcgttcaggatatgctcgaggacgaggtcgctgatcgataacagtgtgcaatccttgccgcagcagcgccgcctgggaaaccgggcggcgttttgtttcgagattgagaaatgcgattgcgcctgaaaaaaatgtgaacagctcggggttcgagtattacaatgaagacccgtaagatgtgtatggacaacttctacgggaagtgcaggtaactcaatatgaccaagcatgtgttcgtgaccggtggcgtggtttcgtccctgggcaagggtatcaccgcggcctcgctgggccgtctgctcaagtcgcgcggctataaggtaacgatgcaaaaggccgacccgtatctgaacgtcgaccccggcaccatgagcccgtttcagcatggcgaggtctttgtgaccgaggatggctatgagtccgacctggacctgggccactacgagcgctttatcgacgagaacctgacccgcgattccaactttacgactggtgccatctataagagcctgatcgcccgtgaacgtcgcggtgactttttgggcggcaccgtgcaggtgattccgcacgtcacgaacgccattaaggataagttccgtcgtattgaggagcagaccggctccgacgtggtcatcactgagttgggcggcaccatcggcgacatcgagtcgcagccgtttgtcgaggccattcgccagtatcgcaaggaggccggccccgagaacgtctgctacatccacgtgtcgctcgttccctatatcgccgccgcccatgaggtcaagaccaagccgacgcagcactccgtcaaggagctccgcagctttggtatccagcccgacattatcgttctgcgctccgatcaccatatcgacgatgccatccgcggcaagatcgcaagcttctgcgacgttgacaccgactgtgtctttaccaacgaggactgcgcgagcatctacgatgttccgcagctgcttgccgagcaggactttgacctgcgcatttgcgagcgtctgggtctggacccgcgtgagcgcgacatgagtcagtggaacgagttcctgcgcaaacaaaatcacgctaaccatcacgccgacaaggtgaagatcgccgtcgtgggcaagtatacgcagctgcccgatgcctacctgtcggttatcgaggccctgcaccacgcgggtgtgttctacgatcgccatgttgacgtgcagctggtcgatggcgagagcctcgatgagcagaacgtctccgaggtcctgggtgacgcctcgggcatcttggtccctggcggctttggcaagcgcgccctggagggcaagatcctcgcggccgagttcgcccgcgagcacaagattccgtatctgggcatttgcctgggtatgcaggtggccgtgtgcgaatttgcccgcaacgtggtcggccttgccggcgccagctcttccgagttcgatccggatggcccgtatagtgtcatcgacttgatgagctcgcaggaggacgtgaccgagaagggcggcaccatgcgtctgggcgcctatccgtgcaagcttgccgccgataccctcgcgcgcgaggcatatggcgaggagctcgtctacgagcgtcaccgtcaccgctttgagttcaacaacgccttccgtgaccagctcgagggcgctggtctggttatctcgggtctttcgcccgacgagcgcctggtcgagatggtcgagctgccgcgcgacgtgcatccgtggtatgtggccacccaggctcatcccgagttcaagagccgcccgaccaacccgcagccgctgttccgcgagttcgtgcgcgcctcgatcggccagcacgagggtgtcgaccgtctgcaggtgacgcccatgaacaccgctacggactagggttgccggcgaacaaagaacataccgaagctactccctcgtcgctcgctgtggcggcgggggagtatctcgattacctcgcggtcgagcggggattggcgcgcaacacgattgcggcctaccgtcgtgacttgacgacgtactgcgcctatttggagcgggcgggtattgcgtcttttaaagatgtgagccgtcaggtcgtggaaggttttgtcgccgatcgccgtgacggaggctattctgatgcctcggtggagcgcgcgctcgcagccgtaaagggcctgcatgcctttttggtgcgcgatggggctgtggcccaaaacccgatggcggcgttgcgcctgcccaaaaaggcagagcgcctgccggaatatctttcggtggaggatgtctcggcgctgcttgatcaagactttcccgaggacgagatggggctccgtgaccacgctatcttggaagtgctctacggttgcggcttgcgcgtgagcgagctggtggggctcgatgtgggcgacattcatatcgatgatgggtttgtcctggtgcgcggtaagggctcaaaggagcgtctggctccgctggtggggagcgcggcacgtgccctgacacgctatatatatgacgggcgcgccctcctggctgcccatgctcgcggggcggaaacctcggcggtttttttaaataagaacggacgtcgcctgtcgcgccaggccgtgcatgcgatatgtgagcgctatgggcgtcaggtgggattggtgggactccatccccacactttgcgccactcctttgccacccacatgctcgcgggcggtgccgacctgcgcgtgctgcaggagattttgggtcatgccgacatttcgaccacgcaggtctacacgcatgtcgaccgcacacagctgactgaggtctatctggcggctcatccgctggcgcatcgctaacgcgttgctgacctgcatatttattgctattagggggacgggcccagatcgccgcgacgtgtttttgcgcgcgcacggcaatctgggcccgccccatttttcgccacttatcgcctcggtggtgggtcgcgtgtgtcgcgggtgggggagtttgggggcgatgtgaacggcatgtaaagggacgtaaaaatcgcctcaaggtcaacttgaaggttgaggttcgcgggcgtggttctacaggtggcatcccgcctttgctgcaaacacaacatattgtgttttcgaacatatgctcgggggtgttttacaacatattgggggtggagtggtggggtggggtgggggaaggggtggggaaaggtgttgaaaaatggggcggttccccatattattgatgacgtcgacaggcggggtggttccccgcgtacgtgccatctgagtaaccgaggggagggcgcacatgggaatgacgggtgcatacgagcgcaatctcgatgcaaaaggtcgtctatccctgcctgcaccccttcgtgaggagcttggagagcacgttcgcgtgttcaaagccctggatgtcgatgctctgtacgtgttctctgccgaggccttcgataagtgggtcgaaggactcttcgcgggtcgtgagggccacgagggttttaacccgcgtgacatcaacgaccagaagctcatgagggcgatcaacaagcgcaccacgtcgatggatgtggacagcgcgggtcgtatcggtctttctgagtctctccgcaagcaggcgaacctcgaccgcgaggtcatggttgtgggcaactacgaccaccttgaggtttgggaccgcgctacggccgatgaggacgatgatgacgaggccctgctggacctcttcttctcgtaagggcaaggcacgagtaacggatggagcgtgggatcttgacacaagaatatcggcatgaacctgtcatgctcggcgaagtgcttgagtcgctgcagctaaagagcggttcccctgacctcttgactgccagtcaagcgctctcccagctgagctacgcccccgtgacgaggtagtactataggggaagatcttcggggatgcaagaggtttttgttgaaactttttcttacgggttttcctgggacggggctgaattgactgattttgacttcggcaaaatcagtcaattcagccccgtcccgataaaaccctcgcgcgacgatgccttacttgtagaggtaggcgatcgccgttccggcgtggacgactatcttagctgtggatcggacaatattgctgatgcccgtgtcagccaagagtcctagaggagaatgatccagtttccactctaggccgtgttcgcttatctctgtgttgggggctatggcgatgatggagatggttttgccctcggcgccatcgatggtccaagtctcgtcctggtgcaggattctggccgtcacttcgtcttcttcgatccagacgggggcgtccgcatagcccgcgagcagccccagtacggacagggccatgtccgggcggccgccggtggcgcaggttgctaccacttcggcacccggccagcggcgacggacggaatcgagcgccagcgccagatcggtatagtccttgtaggggtcgtggcgttctacttcaaaatcaacagcggcatcgaccagagcgcgtccctcatcgcttacggtgtcggcgtcgccgacgtagacgtcgcagctcaggccagcgcccagcagagcatcgagcccgcggtccacggcgacaacgtggtcgcactcccccgccagttgacgcagcagatccgcgctcgccaccaccggcgagccgcaaacaactaatactttacaagccacggccctcgcctagccctcaaacgaaagcacgcgggccaggtccaggtcctcatagctgtcgataaagatttcgcagttatcgcaaacctcgtcgcgctccatacggccgtgcgggtcatagatgcccacacgcttaaagcctgcaatgccagagctcttaagtccaaagacggcgtcctcaaacacccacgcgcgctcaaacttgtgcccgtggcgctcttccaggcgacgcaacgccagctcgtatacatcggggaactgcttggagcgtcccgcctcgcccgtcgtggtaataaactccatatagcgttcaaggccagcggccgcaagcgcagacttcaccagctcggccggcgtggacgtggccacgcacatggcaatgcccgcagccttcgcctgctccagaaacgccaagagcccttcccgcggcggcaccttggagtacccatcaatcaaaatatcgcccagctcgcgataaacttccttgccattcacgccaatgccccacgtgtcgtggtaggcccggcactcgtcctcgagtgaaaggtgttcgaactgggcaaaatcgtcgaccgtcacatcaataccatgacggcgcaataactcggtctgcgcatggccccagacgggggagctattaaccagtgttccgtcgcaatcgaaaataaaagcaacacttggagcagcgatgtggttcataaacgagcctttcgatgtcaaatggtaaacaacctgctaaaaacgttttaccaaacgtaagcctatcagttttgaaaccctaattggtaaaactgtcaagggttttaccacggcaattctgccagtggtataaacatgtcgcttaccgattaaacgccctcgcaaatccgctttcgtccataaaactaacgtacaggtgttatcgtagtttctgccgaaagttccaccgagcacgcgaggtggaacgaatcatagaactatcgccgtcccttcgattcgtgcagccttggacctttcgcatctagtcaccaaggcaacatgctgccgcgtcatgatgggatcaaacgtgagcgatacaaagctaaagccaacggcaaaaaagcccgctactcgcaaggccgctccgcacgcaccggagctctctaaggacgatgtctatctgtttggcattggcatgtgggagcgcagctgggaaaagatgggtgcgcaccccgacacgcaaaaccgtacgcgcggctggcgtttttgcgtttgggcgcccgatgtaaagagcgtccacgtcattggcgaatttaacgactgggatgaggatgccaacccgctggtgcccatgcatacgagcgctatttgggaaggctttattcctggcgccgagcagggccagctctataaataccttatcgagaccaacgagggcgaaaagctttacaaggccgatccatatgcctttaaggccgaatgccctccgggtaccgctagcgtgctgtggaccctcgatggctacaagtggaacgatgccgcatggctcaagcgccgcgccagccacaaccatatgtcgcagccccttaacatctacgaggtacatattggatcgtggaagcgccacggcgacgcgccgcagggcgagccggacgagtacggcaactaccctggccccatggaccccttccccgcgcagcgcggcgagttctacacctacgacgacctgtcggtggagctcgtggactacgtgcgcgacatgggctacacgcatatcgaggtcatgccgctcatggagcatcccttcgacggctcttggggctaccagacgaccggctactacgccgccacgtcgcgctacggcaacccgcagcagctcatgcactttatcgacgcgtgccacgaggcgggcattggcgtgatcatggactgggtgcccggcggtttttgcgccgattcccacggccttgccacctttaacggccatatgctgtttgagcacgagattcaccccaactggggtacgcacaagttcgacttcgcccgcggcgaggtccgctccttcctggtctccaacgtgctgtactggctcgagaacttccatgtggacggcatccgcatggacggcgtgtccagcatgctgtacctcaactttggcattgacgatcctggtcaaaagaagttcaacaagtacggtaccgaggaggacctggacgccagcgcgtttgtccgccaggtcaactgcgccgtggaggcgcactaccccgacgtgatgatgatggccgaggagtccaccgcgtggccgctcgtgacctatccgccgcaggacggcggcctgggcttccactacaagtgggacatgggctggatgaacgacaccctgcactacatgcagaccgattttccgtggcgccccggaaaccacggcctgctcacgttctccatcatgtacgcctttaccgagaactttatctgcccgctgagccacgacgaggtcgtgcacggcaagtgctcgctgatcggccgcatgccgggcgactggtggcgccagtttgccggcctgcgcacgctggccttctaccagatgacgcaccccggtgccaagctcaactttatgggcaacgagatcggccagtttattgagtggcgctactacgagtccatccagtggttcctgaccgaggagtacgagacccacaagcatcatcaggcgtttatcaaggcgctcaaccacctgtacaccgccgagcccgccctgtacgagcgcggctacaccgacgacggctttacctggatcgatgcggacaactccaagcagtccatcgtgagctttgtgcgccagggcgaggacattgacgacgacctggtgatcctgatcaactttgacccggcgagctacgagagcttccgcgtgggcgtgccgcgcgagggcgactgggaggtcatcttcgattccgaccgtcccgagtttggcggcagtggctatgccggtgaggagccctacacctgctcgagcgagccctatccctggaacgggcagatggactccatcgagattaaggtgcctggcctggctggcgtggtgcttaagcgccgcggtcccagcagctacaagccgccggtggttgaggctcccaaggcgaccacgcataagcgcgcgtcctcggtgaagcctaagcctgcggctgctaagaaggctcccgcgaaggcgaaggccacgacgaccaaggcaaccagggccaaggctgcggccaagaagccggctgccaagaaggcaactaccaaggccaagtcagccgccgttaagtcgcctgccaaggatgcgtaacaaagtcgttaccgctgtaatcacccgccccaccggggcgtaggatgtaagtcataaccgttccgggagatatccccgggggaaaggaacgtatgaataagatcttcgacaacaagcaggaatttaccgagctctatcgcgatgccgtcatgagcatcagcggcaagagtgtcgaggccgccagcgacctcgaccgctttaacgccctggccaagctcgtggccgagaaggcgcgcaccgttgccaccaagagcgacgcccgcgccaccgccgagggcaaaaagcgcgtgtactacttctcgatcgagtttttgatcggccgcctgctcgacaactacctgctcaactttggcgtgcgcgacatggtcgccgaggcgctcgacgacatgggcttcgacctttccatcatcgagaaccaggagcccgatccggctctgggcaacggtggcctgggccgtctggcagcgtgcttcctggattccatggcagccgagggcatcgccggttacggcaacggcatgcgctaccgctacggcctgtttaagcaggagatcgtcaacggcagccaggtcgaggccaccgacgagtggctcacccacggctatccctgggaggtccgccgtcaggacaaggccgtgaccattaagtttggtggccatgttgagggctttgaggagaacggccgcacgttctaccgcacggtggacacacaggacatcctggcagtcccctacgacatccccgtggtgggctatgccggcgagaccgtcaacaagctgcgcgtctgggccgccgagccggtcgaggagcacttcgatctggaggccttcaaccgcggcgactacgccctggccgatgccgagcgcgccgaggccgaggccatcagcgccatcctctaccccaacgacgccggcgagcacggccgtctgctgcgcctgaagcaggagtacctatttgtctccgccggcatctacagcctgctcgacacctttgagaaggagcacggcgagaactgggagctgctgccgcagtttgttgccatccacaccaacgacactcaccccgccatgtgcggccccgagctcatgcgcatcctcatcgacgagaagaagctcgagtgggacgacgcctggagcatcgtgacgcaggtcgtgagctacaccaaccacaccatcctgcccgaggctctggagaagtggcccatcggcacgttctccaagctcctcccccgcgtgtaccagatcatcgacgagattagccgtcgttggcacgagtcgttcgacaccacccaggaaggctggcaggagcgtctgcgccagaccgccattctgtgggacggcgagattcgcatggccaacctgtctgtgatctgcagccacagcgtcaacggcgtggccaagatccactccgacatcatcaagaacatcgtgctcaaggacttctatgccctgacgcccgaaaagttcaacaacaagaccaacggcatctcgcaccgtcgcttctttgccgaggccaaccccacctacgccaagctcgtcaccgaggccattggcgatggctggctcaaggacgcctttgagctggagaaactcaaggagttccagaacgacaccgagttccttaaggccgtgggtgcctccaagcgcgccaacaaggagcgcctggccgcctacgtcaaggccgaaactggtctggtcatcgaccccaacaccgtcttcgatgttcaggttaagcgcttccatgcctacaagcgccagctcatgaacatcatgaaggtgatggacatctacaaccgtcgcatcgacgatcccaacttccatgtgacgccgacgaccttcatctttagcggcaaggctgcctcgagctacacctttgccaaggagaccatccgcctcattaactccgtggccgacgtcatcaacaacgatgcccgcgtcaacgaggtcatgaaggtctgctttatccccaacttccgcgtaagcaacgcccagctcatctaccccgccgccgagatctcggagcagatctccacggccggcaaggaggcctcgggcacgtccaacatgaagctcatgatgaacggcgccattacgctgggcaccctcgacggcgccaacatcgagatcgccgacctggccggccgcgagaacgaggccatctttggcctgaccgctcccgaggtcgagcagctctgggcatccaacagctactttgcgtgggacaccctcaacggcgaccgcgagcgtctgggccgcgtgatggacgagctcaaggacaacacctttgcgggtctttcgggcaacttcgagagcatctacaacgagcttatgaacaacaacgaccccgacctggtcatggccgatttccgcagctacgtcgacgcctgggaggcgctcacgaacagctacggcgaccaggagacctggaaccgcaaggcgctgctcaacaccgcctcctccggctggttctcgagcgaccgcaccattcgcgagtaccgcgacgagatctggcacgcgtaaaggcgcgcgagctcccttatgccagcacggcattactcgacgggcgcgaccgagcgccgcgcccgtcgctaatgggtttagaaacatcgatgacagaaggagaaatcgatgagtaagaaagaatgcatcgcgatgctcctcgcaggaggacagggcagccgattgggggcgctcacccaaaagatcgctaagccggcggttagctttggtggcaagttccgcattatcgacttttcgctgtccaactgctccaactcgggcatcgacacggtgggcgttctgacgcagtaccgcccctacctgctgcatgcctacgtgggctccggcgaggcttgggatctggacagccgtgacggcggcgtgtcgatcctgccgccgtacgagacgcagaccggtggcgcctggtatgcgggcacggccgacgccattacgcagaacctcgactacatcaaggccaacgaccccaagtacgtcctgattctttcgggcgaccatctgtatcgcatggactaccgcaagatgctcaagacgcacattgagaacaacgccgacctcacggtgagcgttatgcccgtgccgtgggaggaggccagccgctttggcatcctgaccaccgaccccgaggacggccgcatcaccaagtttaccgagaagcccgagaagcccgattcgaacctcgcgtccatgggcatctacatcttctcggccgacgtgctgatcgaggcgctcgaggaggacgctctggaccaacgctcgaaccacgactttggcaaggacatcatccccaagctgctcggcgagaataagcgtctgtacagctacgagttccacggcttttggaaggacgtcggcaccatcgccagcttccacgagacctcgatggacctgctgggcaacaaccccgagttcgatctgtttgacaagaacttccccatcatgtccaacatcaccacgcgtccgccgcactacattggcccggacggccgcctggacgactgcctggtctctaacggctgcaagatctacggtaccgctcgtcactcgatcctttcgaccgatgtcatcatcgaggaacgcgccgtggtcgaggactccgtgctgctgccgggtgcgcacgttaagagcggcgcgcacatctgccgcgctattttgggcgagaactccacggtcgaagagggcgtgaagctcggctctgtcgataccaccaaggatacggccgtcgttggaaatgacgtcgttatcgggaagggggaatgatccgatgatcaatcgcaaggccatcggttatatcaccgctaactactcttcgacctacggcagcgtgctgctcaaggaccgccccatcgcgtccgttccgtttttgggccgctaccgtctgatcgacttcccgctgtccaacatgatgaatgccggcatcaagaccgtcggcgtcgtcatgccgggaaactaccgctcgctgatcgaccacgtgggttcgggcaaggactggggcctggaccgcaagaagggcggcctgttcatggtgcccggcaacgcgtatggcaccaccaagggcggcatgcgcttcctgctgcgcgacatcatctccaacaagacgctgttccagcgctcggacaagccctacgttgtgatgatgggcaccaacatcatctttaacatggaccttaacaccatcatcgacgcgcacgagaactccggcgcccaaatgaccgtggtgtactgcaaggccacgcgcaatgttgatgacgagaccaagctcgagattaacgagaacggccgcctgacgggcgtgagcgccggcgtcgtgtacggcgacaacgcctctatggactgctgcatcgtcaaccgcgagacgctgctcgagatcatcgaccactaccaggccgccgactacctggacctgctcgaggcactccagggcgactttggcaacatcgacgtgtgcagttatgagtacaagggcgaggtcgtgggcgtgtttagcgagaagtcgctgtatcgccgcagcatggacctgctcgaccagaccgtggccgaccagctctttgaccccgagcgccccatcctgaccaaggcccacgacgtgccgccttcgcgctacgcgactggcagccacgcgtgcaactcgatcatctcggccggctgcatcatcaagggcaccgtgcgcaactcgatcctgtcgcgcggcgttgtggttgaggaaggcgcctcggtgaccaactcgatcatcaaccagagctgcatcatcaagagcggcgcccgcgttgagaacgccatcctggacaagaacaacgtggtgcccaccaacaccgagcttcgcggcacgcccgagaacatcctggtgctgggcaaggctccgttaacttccgataccaccatcgctcgttaacattggcgtcgcataatcgcacgtaaacttaagaatagccgcccggttagcgcctggcggctattctcgaattgcaacatgggagacaatatggcagattccagcaaaaagatgcagatcgtgtttgcctcggccgagtgcgcaccgtttgtgaagaccggtggcctgggcgacgtggcgggctcgctgcctgcggcgcttgtgcgcgccggcgccgaagtcatcgtgatggtgcccaagtacgccaccatcaaggacgagtacaaggcgcagatggagcacttctccgacttttacgtgagcctgggctggcgcaacgaatactgcgggctcgagaagctcgagcacgatggcgtcacctatatgttcatcgacaacgagcgctactttgcgcgcgactatccgtacggcttctttgacgacggcgagcgatttgcgttcttctccaaagccatcaccgagagcctgcagcacctgcccgagggctttgagtgcgacatcctgcactgcaacgactggcagacggcactggcgcccgtgttcttgcgcgagttctaccagggcctgccgctgtacgaccgcgtcaagaccgtgttctcgatccacaacgtggcgttccagggtcagtttagcgacaccgtaatggaggacatcctgggtgtggcgcatattcccgcggcagccacgcagttgcgctgcgacgcctgcagcatcaactacatgctgggcgcgctgcactatgccgatgccatcaccacggtaagccccacctatgcgggcgagatccagacgcccgagtttggcgagggcctggacggcgtgctgcgcgagcgctcctacgcgctgcagggcattttgaacggcattgacgtggcaggctttgacccggcgaccgacaagcgtattgccgcaaactacacggttgaggaccgttccggcaaggccgtgtgcaaggccaagctgcaggaggagctgggcctcgaggttcgcgacgaccgcccgctcatggtgatggtcacgcgcctgacgcgccagaagggcatggacctggtcatgtacgcgctcgaccgcatcctgtccggcggcgttcaggtggccgtgctgggcaccggcgaccgcgactacgaggatggcctgcgctacttccaggacaagtaccccggcaccatggccgcacgcatcgagttcgatccggcgctgtcgcagcgtatgtacgccgccgccgacatgttcctgatgccgtccaagtttgagccctgcggtctgtcgcagatcatcgccatgcgctacggcaccctgcccatcgtgcgcgagaccggtggcctgaaggacaccgtgcagccgtacaacgagtttaccggcgagggcacgggcttctcgtttaccaactttaacggcgacgagatgggcgacgcggtgttccgcgcggcacgcctgttctgggacaaccgcgatgcctggaaccagctggtcacgcaggccatgagccaggactttagttggacgcgctcggccgataagtatctggacctgtacttctttatgcacccggagattgagcgtccggcggctgtgaaggctgctgcggctgtcgaggagccggttgctgttgaggccgagcctgcggcgcacgttaaggagcccgctgttgaggagcccaaggccgaggagaagacggctgtcgaggccgaggtaaagcccgcagcgaagcctgccgccaagaagacgacggcccgcaaggcaacggctaagaaggctacggccacgaaggccgctgcgagcaagaccaccgctgccaagacaactaccgccaaggcaacgaccacgcgcaagcgcacgaccgccgctgccaaaaaggcagccgaagttgacgctgctcccgaggtaaaggccgaggccaagactgaggcacctgtcgccgagaccaagccggccgccaaggctccggctaagaccactgccaagaagacgaccgccgctaagtccaccgccgccaagaagaccacggcttcgaagacgacgaccaccaaggccgccgcaacgaaggctgcccccaaggccgcagcaaagcctgctgccaaggtcgaggagaagcccgtcgagcccaaggccgaggcaaccgtcgaggccaagcctaccgcgaagaccaccacgcgcaagcgcaccacgacgacggccaaaaagactacgaccaaggctgctgcccccaaagcagagcccaaggccgacgccaagcccgaggtaaagcccgagccggcgccgaaggcagccgaggtcaaggctggggcaaagtccgagcccgccaaggagactacggtctcccccgccgctccggccgagaaaaaggctccgtccaagaagacctccgtccgtaaggctactgccactcgcaagcgccgctaatccggacgatccacaatctaatcctcaataaacaaggggtgtcgttcagtgcgacaccccttgttctatagatggggtaaaacgattatctagcacaaccgttcgccgatagtgagcggctgtagtttatacaactaaagtgcaacggatatacttaacaactgtgcgttaagcccatgacccgttggccatgattgtatagaactggaccatactatgagattgattcacaacagccgcctgccgcagtttcgcgctccgtttggtgctgtgaccactggaacttccgttacgctctccgtgattttggaggacgccgatcccaaccaggcaacgcttacgctgcgcacctgggtcgacgagatcggggaatctctgtatcccatgacgcacgagggcgacggcatctataccgccgaactggagtgtggcgagccctgtcttatctggtacagctttatatgcaatatcgagggccagcccgaggttcgcttgggcgcgccgcagggtcgcaccggcggcgagggcgtaacctacgattacgtcgaggtaccgtccttccagctcaccgtttacaaacaccgcgaagttcgtcccgagtggtacgagcgcggcatggtctaccagatcttccccgaccgctacgcccgcgacgagcattggcgcgagcgcacaatggcagggctcgaaaagccgcgcaagggcattcaacgtcgcatggtcgaggattggaacgagccgcccgtctacgagcgcgccgaggacggctccattaagacctgggacttctacggcggctcgctcaagggcatccaagaagacctgccgcgcatcgccgagctgggctttacggccatctacctcaaccccatctttgaggccgcgagcaaccaccgctacgatacggccgactacaccaagatcgacccgatcctgggcaccgagcaggactttaccgagctgtgccaggcagccgagaagctgggcatctccatcattctggacggcgtctttaaccacacaggcgacgactcgatctactttaaccgctatggcaactaccccggcgtgggcgcttggcagagtgaggattcgccgtggcgcgatgcgtttaccttccatgaggacggctcgtacgactgctggtggggcgtaggcaatatgcccgccatcaacgagaactccgagctggtgcgcgagaggctcttgggcaagcatggcgtgattcgcaaatggctgcgcgccggtgcccatggttggcgcctggacgtcgctgacgagctttctgacgactttctggccgagatcaagaaggcagtacttgccgaaaagcccgacgcgctgctgctcggcgaggtctgggaggacgcctccaacaagattagctacggccatctgcgccgctacctgcagggctccgagcttgattccgccatggactaccccttccgcgacatggtcatcgggtttttgatgggctacaagaacgcctaccaggcggccgaggacatcgagaccctacgcgagaactacccgagcgaggcattgtcctgcgcgctcaatttgctttcgagccacgaccgacctcgcattatctcggtgcttggcggcggccccgacgagtcgcagctgcccgagtgcgagcgcagtaaatggcgtttggacgaaggtgcgatgggcctggccaagagccgcttttggctcgcgacgcttatgcagatgaccttccctggcgtgccttcgatctattacggcgacgagtacggcctggagggcctaaccgacccgggcaatcgacgcaccatgccgaccaaggaccagctgcacgactttgacacgctggctatcgttaagaacgcctcggccgtacgccgtgcgctgccgtttatgatcgacggcgaaatcaaggccttcgcgctcaatgacgaggtgctggcctacaaccgtacgggcaaggacggcgagtccgcgaccgttatcatcaaccgcagcctgcgcaattcgcatcgcgtgacgattccggcgctcggcgaatgtgcaagcgacgtcattagcggccacgagtgcgtgatccacaacggcacggtcacgctcgacctgtacccgctgggttcgtcgatcatctatcaccacgccgagcagcgcctgcaggagccgctcgatcacggtgcgggcgtcgtatgccatatcacctcggtgccgaccgacgacggcaagcccggcacgatcggcgcgcccacgcgtcgctttatcgaccatctggccgccatgggcatgcgctactggcaggtcctgcccgtcaacccgacggatttcttccgctccccttacgctggcccttcggcctttgcgggcaatatcgacctgctgccagagagccatgaggagctggcggccgactttaagacctggaaggcccgcggtggcgaggacgccgacccgctctacacggcgtttaagcatcgcaatgccgactggctcgagaagtactgcgtatacatggccgtcaaaaagtattttgagggcgagtcacgccacgattggccggccgaagtcgcacgctacaacgagcatctgatcgacgacgagcgtttccacgacgaggccgagctgcaggcgtacatgcagtaccgctttgacctggcatggtgcgagcttatgaattacgcgcacaagaagggcatcgaggttatcggcgacattccgatgtacgtctcggacgattcggccgacgcgtggagcgagcccgagaacttctggctgtccgataccggcaaggcgattgagatttccggcgcgccgcccgacaactttgcgcccgagggccaggtatggggcaaccccaccttccgctgggaccacatgaaagagaacggttaccgttggtggatggaccgtctgcgtcgtgcgttctcgctctacgaccgcgtgcgcctggaccacttcctgggcttccacagctactttagcattcccgctggtaaggcttgcgctgacggccgctggttggcgggtccgggcaaggatctgttcaagactgcctacgacgagctgggtccgctcaactttattgccgaggatttgggctatttgacgcccggcgttcgcgccatggcttcgacctgtggtttccccggcatggacgtacttgagtttagcgattacgacgttcgcaacgggatttatcccacgcccggcaagatcctgtacacctcgacgcacgacacgtcgacgctcgccggctggtgtacgcgctcctttgcgggcggcgacgagccgagcggtaaggaatttgcgggtaagctgatgggcgatgcgctcgcaagtgacgctcccctggtaatgatgccgctgcaggatgtgctgggcttgggcgatgatgcgcgcatgaacgtgccgggtgtcgccacgggcaactggacctggcaggctgacgaggcggatgtcgaggctgccgaggacaaaactgcacagctcctgcgcaacacccatagattctggggcgaagcgtgataaaacccccgatatagggtacagttacagacgtttgaatttatgcgggcagagcgatctgcccgctttgtgctgaaaaggaagtattatggcgcgctacgattacaagtgctcgagctgcggcaacgtgtttgaggttgagcatcccatgtccgagacccccgaggtcgtgtgcccgagctgcggcgctccggccgccaagacgttctcggccagcggcatcaagtttgagggcagcggcttctacaacaccgaccagcgcagcggcggttccagcaccagcgccaccagcggctgctgcgccaactgcccgcatagccactagaaacaaaaaggccccgcgatcaacaccgatcgcggggcctttttgttgccagggtagctaatttgggacggggcttttttagctaccccatgtctgagcgaatgctctggatgatttttctgggacggggattaaaaaatcattgtttacctaatgattttttaatccccgtcccagaaaaatcatccgacaggtgggggtagctaaaaatgccccgtcccaaattagctacccctgggcttcgatttactttcggaccaggcgggcgcagaagtggccgtcgtaggagtcggcgttgacggggacactttggaagaggcctcggtcgttttgacggacagatacgagcttcttggcctgctcgaactcagagagttgcagaatctgcgcctcggagagcggcgccacggaaaagccctcgccctcggaagaactcaggaacgcgtccacgacctgcgtgttctcctcgtcaaagaccgagcacgtcgcgtagatgagctcgccatcggcagccacacgcgcagcagcctccttgagcatcgtcagctgtagcttgggcagctcggtcgtcacatcgctctcggtcaggcgccacgggatctcgggatgacgacgcatggttccggtacccgagcacggcgcatcgataaacacggtatcgaacttgacccgctcgccaagcatggcatcaaaggacgtgagcacctcatcgagctcgcaggcatcgcccgagacggttcgtacgcccttgatgcccgccttatgcaagcgcgcgagattgagatcgcacttgcggtcgtgcagatcgagcgcggtatgttgacgctcataaccggcacgcttggcctgacacatcatcacataggtcttggtgccacgaccggccccgatctcaagacagcttccggggcgcgtagccgccgtggcaataagctgcgcgttgaggtcagatgccaccgcagccgaacgctcaaacacacccgaagcaacggtgacctgagcatcgaccggcgcatggcagcccggaaagacaggcgccacgagctgcgagatacacggatcgggcttggtcgcaaacgcattctcgtgcagggcgagcggcgcaggcgccagattgccggcaaagttgagcgcgccctcgggcgtatcgaacgacaccataatgcgggcgcacaaccaacgcggcagacccatcagacgcgacaggcgcaccagacggcgctctgactcatcggcatcggacgcggtggcaaaatcctcaacgttatctgcgaccttgtgcagcacggcattcgcaaggccggcagcggacttagcaccgctgcggaccagctcaacaccctggctcacggccacgcggcccggcgtatgcaggtagagcatctcgaaggccgaaatgcgaagcgccatgcgtacgcgcggtgccacctttttgggcttatccaaaaactggtcgagcaactcatccaaaataccctgcgtagcggcaacgccaagcgccaagcgagcagcaaaagcagaatcgcgctggtcaatggccttggcagaagcacgggaggacagcacgtcgcgcgcgtacatgccacggcgattggcctccatcaacacatcgagtgcaagcttgcgcgcgggagacagtttgctcatgacagaacaccccaagtaaggtcggcgccctgcaggccggcagcccaagcagaagcagccatagcacgcttaccgtcgggtttaacctcgagtagctcaaccgcgccatcggaaagccccaggtagacacgcttagcctgaacaagaacctggccctcgccaagcgacacgttggcaggcgcagcatcaagcacgcgcaaagtcttgccagcaattacgcaacgagcaggcgccgtatcagacgaagcaagcacatgacgcacgcaatcaagcgccgccatctgcggatccagacgcatctcctgcttggaaatcttcgcagcatgggtgacgagcgactcatcctgctcggtccaaacagcagtgccgtcagcaagtgaaggaagcgtatcggcaagcaacttgccacccagctcgccaagctccattgtgagcgcctcggcatgcttaccggcaaccgacgtagacgcctgggcacaataagcgcccgtatcaacgccatgcccaatacgcataatggatacgccagcaacctcatcaccagcaagaatggcacgctgaatgggagcagcgccacgccaacgaggcagcaaggacgcatgaacattcacaataccaagcggcgccatatgcagtacctcatcaggcagaatgcaaccataggctgccacacagaaaatatcagcctgagcagcctggagcgcctcaacaacctcgggcgtcatacgattagcctcaataaccggcaaccccagctcaagcgccttagccttaacaggagaaggctcaagcttcttaccacgcccacgaacagcatcgggacgagtaacaacaagcacaatctcgttgccagccgcaacaagcgaagttaaagaaggcacagcaaaatcgggcgtacccataaacacaatacgcataaaagttagtctcctctcaataacgagccgagacggctacaatgaacagcggaaagccaagtcaccagcccatccgcaataacaattcaacaagaacaaatatacccaaaaccaaagaaagagccgcaataaaagcagctctttcagcaaagcacctatcagcgaagacgcccttccctggcccgacgacacccgggcgaaccgagccagaacaacgcagtccccggtgagacgatatgagcaggacataaaaacattgagagcccctgctgcatgaaagaccgcggattaggccgacaatggtgagtgtctaattcagccgcggcggccacgccgcattcatggaaggggctcccatgctcgatactaccaccttcgtcggcctcgacgtccacgcccgctcgataaaggcagtctccctcgacgtcatgaccggggaggtgcgctgcgcgaccttcggctacgacgccggggcagtcgcggagtgggtgcggtccgtggacccaaaggccaagtgcgtgtacgaatccggggtcacggggttcgacctgcagaagaggctctccggcctcggggtcgactgcgcggtcggcgccgtctcgaagatgatcaagcccagcgcggacaggcgcaggaagaacgaccgcaacgacgccgagttcctcgcccgcatgctgtcggtcggcaacgtggtcgaggtgtgggtccccgacgacgagtgcgaggccgcccgcgacctgaccagggcgctcgaggacgcgagggacgacctctcgcgctcgaagcagcggctctccaagttcctgctcaggcacgggctcgccttcgacgagaggacgcccaccggccgcaggaagggcaactggacccgggcgcactggtcctggatcgagtcgattaggttcgcggagggggccgacgaggaggtgctcgcctactacgtcgacgcggtcaggcgggcggcggaggagaaggcgaggctcgaggggctcgtcggggccgaggcccgcaagcccaggtggaggaggagggtcgactccctgcgctgcctcaagggcgtcgacaccgcgtccgccgccgacctcgtgttcgaggccggcgagttctcgaggttcaggaacgcccggtcgttcgccgcatgggtcggcctgacgccctccgagcactccagcggggagagcgaccgcaggggcgcgatcaccaaggcgggcaacaagcacctgaggaaggcgctggtcgaggccgcgtggcactacctgacgtgctcggggcggccgaagggcctcgccaagggccaggccccggaccgggtcgcccgcaggcatgccgccaagggcgtgcggaggctggtcgagaggcgggaggcgctgctcgcgcgcggggtccacaacaacaaggcgaacgtggccacggcgcgcgagctcgcctgctgggtgtgggcggtcggcctcatggccgaggaggcgtagggggccggtcccccgcacataagccgatcaccccggaagcggttcgatccgaagccgttgaggcgaacctcaggtcccttttctgcgagcgcccagggcgccacacgcgtgcacagactgtcggttcgacgtagaagcctcagccgtagcaacggattgcccagcgagagatcgccgcgggcggatattaaactgcaaagacgagcgtcgggaagacacgccgaggtcgccgcggacgggttgatatagggagagggcctgaccccatatcgttggggccaggcccgattttgcctgggagttctagaccttgtcggccttagtacataccgccgccctgctgaccagcggtagcagcagcgatagcgtcctcaagctgagtgttcttgggcacatcggagacggtagcctcggtgataagaatcaggctggcgacagaagcagcgttctgcagggtgacgcggctgaccttgacggggtcgaggacgcccatctcgatcatgtcgccccactcgccgttggcagagttgagaccctggccggcgggcagctcggcaaccttgtcgaccacgacggcgccctcaaagccagcgttcttggcgatggtggcgaccggagcagtcagagccttcttgacgatgtcgacgccgatcttctcctcggggtcgtcaagctcaacggcgtcgagcgcaggagcagcgtccatgaaggcgacgccgccgccggcgacaatgccctcctcgacagcagcacgggtagcctgcagggcgtcctcgacgcggtgcttgatctccttgagctcggactcggtagcagcgccgaccttgatgacggcaacgccaccggagagcttggccaggcgctcctggagcttctcacggtcgaagtcagaggtggtgttctccatctcgcccttgatctgagcgatacgggcgtcgatggcctccttggagccagcaccgccgacgacgacggtgttgtccttggagatggtgacggacttagcggtaccgagcatatcggcggtgatgtcagcgaccttcacgcccagctcgtccagggcagcctggccaccggtgaggacggcgatgtcctccaggatgcgcttgcggcgatcgccgtagcccggggccttgacggcgcagacgttgagggcgccacggatcttgttgaggaccagggtaggcagagcctcgccatcgatgtcctcagcgatgatgagcaggccacggccagcgcgctggacagcctcgagaacgggcatgatgtcctggacgctggagatcttctggtcggtgatgaggatgtacggatccttcatcacggcctccatgcggtcgttgtccgtgacgaagtaagcggagacatagcccttgtcgaactgcatgccctcgacggtgtcgatggtgatgtcgaacgtctgggaatcctcgacggtgatgacgccgtccttgcccacgacctccatggcctcggcgatcttctcgccgacctcggggtcaccggcagagatggtaccgacggaagcaatctgctccttggtctcgaccggcttggcctgcttcttcatctcggcgacggcggcgttgacggccttgtcgatgccgcgacggatggccagcgggttggcgccagcggcgacgttgcgcaggccgtcgttgacgatggcctgggcgagcagggttgcggtggtggtgccgtcacccacggtgtcgttggtcttggtggcgacctccttcaccagctgggcgcccatgttctcgatgttgtcctcgagctcaatctccttagcgacagaaacgccgtcgttggtgatggtcggggcaccgaacgtgcgctgcagcgcaacgtagcggcccttggggcccatggtgacggtaacggcgtcggccagggtgttgacgcccttggcgagcttagcgcgggcatcggtgttgaacgtaatgttctttgccatggtaggtaatcctccaaaagaaatgtgactcgcgtcgccgcttccgagtcctatgcggcgggcgcgttcaaagacgaatcagagattctgacgagactaggcctcgacgacagcgtagatgtcgtcggcgcgcatcagcagatacttctcgccgtcgaccttgacctcgttgccaccgaacttaccatagatgacaacgtcaccgaccttgacgtccatggggatgcgctcacccttgtcgttgaccttgccggcgccaacggcaacgatggtgccgcgctgcggcttctcctgggcgttgctagcgatatacagaccagaagcggtcttctgctcggcctcgtcgggcttgaccagaacacgatctgcaagcggcttcaaagacgacatgcttgtctcctcctttttgggccgcgtggttatgccacgcgaattaaccctttttgtttgcgtacgcgttgaatggtacccacgaatggcgggttatacaacacggagtcaaaaaatcttattttttggcacttagattttctgaatgccgggggataacttagcgatgcctcccgtgtggctccggaggggcggggcataaggtttcctgctcgggcagtcctgctcgcacgaaggccacattaagtggccttcggctcgtgcggaactcgcgataaaccttatgccccgcccctccggagtcacacgggaggcaggttaactaattcgggcccggcattcagaaaagtcagtgcagcaaaatggcgatgcggataggaacgtgggcatggttttcgctgcgcgcacgggtcccctggggagcaccgtgcatttttgggagtattcagcaggccagggtggctgcatacgcgccagacataccttattggtcccaagaacgccttcagcgggcggttttggtcggtgggcagaccccgttgggacaaatgggcgtacttcgcgccgtaccggagcccaaaatgacgtcaatctccgtaacgttactcagccgcagcggcaccggcagagctcgcggtgctgaatactccgttttttgcacggtccaggcgggggtacatcagggccagaaagaacatcccggcctttttatgcaatctgtaatgtgaagtatgcaaaacacatgaggttgcactgctgatgtccaaattgaacgcacggagcagcagtacctcaaccccgcgcccaaatccaacagagcagggacgctcatggcggatccccaccgaaacgcaaacgcggctcgagcgccatcccaaaataggctgcatgagccgcgtttaacggtacgacatgaatatcagcgctcgtaaatcaagttgcctgccaggtaggtggcctgaaccttggtggcttggagttcttgggggtcgatggtgagtgggttttggtccaggactaccaggtcggcgtatttgccgggttctaggctgccgaggttttgctcgtcgcccgctgcataggcgctgcccagggtgtagttgcgcagggctgttgctgcatcgatgcgctcgctcggcagccagccgccctcgggccagtgacttttggggtcctggcgcgtgatagccgtgtagagcacgttcatgctggtaacgggcgtgatagggctgtcagtaccgaaggcttggcggatgccgcgctgcttataggttgcaaacggccacatgatgcggctgcgctccaagcccaggtcgcgctccggaccacctgggtcgagcgtgatatggcagggctggctcgaggcaacgacgttaagcttgcgtagacgatcgatgtcctcgggcaagaggttctccagatgctcgagcgtgttatgaccgtgctggggcaggccgtacagctctgccgcctcctcaaagatatcgagcgcggcatggatggcaccgtcgccgatgacgtggatgcgcacggtgtggccgcgctccgcggccgccagaactagcttgcgcatgcgctcggcgggaaccgtcagacggccctggtcgcccgggaagcgcggattggtatagggctcggtgagatacgccgtgtgttcgctcgacacgccgtcgaagaactgcttaaagcccggtgccgagagcagcacattgttcgcgtaacgtgcctgcagctcttccaagtgcgactggtcatccagcagcgtggggaacagatgggctcggatgcccaacttgccggctgcctgcagtttgtcgtagacgtcgtcgcggataaaatcgcagcccggcatgggcatgagcgacatatcgcatatcgaggtgatgccctgctcggccatacgcctcatttgatcggcgtaagcgcttgcgatgcgatcctcgcccagccactcaaggcagcgcggtagcagctgcatggcagccgcctcgtgagcaatgcccgtgagctcgccgtttgcgtccttgtcgtagctgccgcccgctggtggctcgctgtcgcgcgtgacgccgagcgcctcgagtgcgcggctgttgagccaaagcgtgtgcccgtcacccgaatacataacgcaggggcgatcggggaatgccgcatcgagcgacgccttggtaggatgctcgggcgggtcccaacggtagtcgcgccagccctgagtcacaacccaagcgttgtcgggcaggtcctgggaaaactcgagcgcgtgttgcaccagcgccgcctcggacgtgcccatatccatgagcatgtacggcgaggagccaaccgaagtatggaagaaatgcaggtgcgcatcgtggaaaccggggcagacaaactgctcgccgtagtcgataaccggcgtggcggcaggcgcggcggcaatcacgtcatcgggcgcaccgactgcgacgatacggtcgcctgcgatggcaatcgccagctcgcgggcggtatcgatgccgtcttgcgcggtaaagacgttcttggagcggataatccgatcgatatgttgcatgggcatccccatctctggcaggaaattcaacacccccgagtgtactcccccgcccttgtaacaaaaccccaagcggcaaacggcaactttaccagccctagcggcaggtggcatactggagagagcctgtacgattttgcgatcaacccagcaaggagcaaatcgaccatgacgaagaccaaggcacagcagattatggcggcgaccgaggctcgcgcggctgacgacgtcaccgtagccatcaaagatatcgctaccgagtttgaaccctatatcatcaagcagcgccggcacttccataagcacccggagctgagccttgccgaggagcgcacgacctccgacatcgccaaccagctcgacgccatgaatatcccctacgagcgtccgctcaagaccggcttggtggcaacgcttcgcggtaccgcgtcggatgcctaccatgaggacggcacgccgcgccgccgtatcctgctgcgcgcggatatcgacgccctgcccgtcaccgagcagaccggcgaggagtttgccagcgtcaacgagggctgcatgcacgcctgcggccacgactgccacatcgccatgatgctcggcacgctgcaaatcctgcgccatatgaccgacgacatccacggcgaagtccgcatcgtcttccaacccagcgaggaaaacggccagggcgccaagctcatgatcggcacgggcgtgctcgacggcgtcgatggcgcctacgccgcgcacatctggagtgaggtcgacgccggcaccgtgagctgcgagcccggaccgcgcatggccaataccgactggttccgcatcgacgtccgcggcacctcgtgccacggtgccatgccccagcgcggtcacgacgccgttatggttgccgccgagatcgtcaacgctctgcagaccatcgtttcgcgcgagatcagtccctacgagccggccgtcattaccgtcggcgagctgcacggcggaaccgcgcgcaacgttatcgccggcacggcctacctcgccggcacggtgcgcacctacggcgattcgacccacgaggaaatgccggagctcatgcgccgcatcgtggagcataccgcggccgccttgggcgccgaggcaaagctcaccgactacaccatcgccaactacaaggtcgaaaacgatgccgcctcgagcgagcgctgccgccaggcagtaatcaaatgcttgggccccaccggccaaggccattaccgcggcacgctttcgggcgaggatttttcggagtacctgcgccgcgtaccgggcgtgctcgcctttgttggcacgcgcaacccccagattggcgccacgtacgcccaacattcttgcttctacaagattgacgagtcggtactggccaagggctccatggtggccgcccaatatgccatcgactttttggccgagcccacacaagaagagctcgacggccccacgattgccgcggtcgccgaaaccaaccccgacttggccgccaagttgcgctctgccaaggccacgtccgccgaggctcgcgatgctatccatgatgcccgcacggcgcgccatgccgccatcaagggcatccatgatgcacgtgccgccgctcgccgcgaggagaagcacgacgagtagtcgatccacgaccatctcgcagtcatagccgcatcgcgatatcaaagcgggggcggacgcttcggcacgtccgtccccgcttatttgtcaagcgctatttctaccgtttctaccccgtccccaaatggcaggtggcagggttactcgtcctgcgggtcctcgtcggagcttggcgcaggctcgggctcaggcgcaggctcgggctccggttccggcatgggcgcgggctcgggctcaggcacgggctcgggctcaggctcaggctcgggctcgggctcgggcgcaggcgccggcgccgcagcggaatcggatacgggcgctgcgtcggcgctaaaaccagccggagcagacttcttctcaaacggcagcacaaaagtcaggacgtcgtccttgtcctcgtcggcccactcgcttgcgtagcgtgcaacccaatagccaacggcgcgatgcttgagcatgttgccaaagaccgtgaggaataccgtgacaaacgccgtcagcaccaagaacaatacgagcgtgatgccaccgccggtaacaagcgcctcaatagccgtaggacggtagtagtagctatacataccgacagaggcaatggtgccaaagacgaacgtcaggatccaggtgacaacgttggcgaccaggcccgtcaaaaactcggggaggaacgaagcgcagaacagcttggtcttattgttcttaaaggccgcccagaccttatcgagcgaaaacgcgctctcgacgcggccggtcaccgcaaagtgcatcacggcgatgtcggcgaacatggtaaagaagacgcccaggaccgccgcggcaatcatagccagaacaaacaggcccagcgaaccgatcagcgcggcctcgagcgcataagagccgtaatatgaatacgaacccgcggcaccaattaccacgctctccaccagcgaaagcgccacaccgataacgggaatggcagcgataaccttgagcacgcccgagataacacccgaaaagacgcccagaccaaacgacgtggagcgcatcagcggacgatccatgccgtcatcgaccttaagcgacaggtcgcggccccattcgatgccaaagccagaaccgcatgcgcttgccacacaggcagccaaaaagccgatggcagccgcgataccgccgataacgggaatgaacagcacgagcactgacacgacacagatgagcgccggcaaaaaggcgatctggcacacgcgctgcagcacgcccggcgtcttggtcatgtcctcaaacgcctgagccacacagcccttggacgcattcgccacggacggttgcggaacaaactgctggggctgaccctgaggggcagaggctgcggcaccggcattgggggcaccacacgcaccacagaacttatcgttgtcgcccatgggggcaccacactgcgaacagaacatcgagatcatcccttcgtatcttgagcgaatcatctggatcgcaaacgatgtctttggcatcattatcacccaatgtggggacaaatactccaacatgacgcatttgcaatacgcagggcgctattcgattgtttgatgagctcgaccgcgttagttcgttccgcggaaacccttgccgacgatctcggagctgtcgacgatcgtgataaaggcacccggatcgacttcgcgcgcatagcggcgcagttgcacggcctcgcgacggcttagcacgctcatgatcaccgtcacgcacttgcccgagaaagcaccgtagccgcggctgatagtcgccgtacggttgagatgcttgacgataaactcctcgaccttaaggggctcggagcaaatgaccgtgcagactttacgcaggtggatgctctcgatggccttgtcgaccacaagcgtcttggcaaacaggccgagcacgcaatacagaccgacgcgcgggccgtacaagaaggccgcgatggtcacgatgccgatatcgaccagcagcagcgcacggccgatctcaagcgtcgtgcggcgtttgagaatcatggcgaggatgtccgtgccgcccgtcgaggcaccgatatcaaagacgatggcgctgccgagcgccggcagaatcacggcaaagcacaggtcgagccacatatcgcccgtcatcgagacatcggtcggaataaagagctcaaacagcgaaacataggcggacagcgcaaacgaggcaaagacactccacaggattgccttgcgctccaaaaagataaagcccagaacgacaaggaccgcattgataatccacataaagacgccgacgggcagggtcgggaacagcgtggacagaatgaccgacacgcccgaggtgccgccaaaagcaaagtgattaggggttttaaacgcgacgatggcaaaggccgtgaggatcaggcccaaattgagctcggcaaaaaagcgcggaaagcccggctcctggctgcgcttgcgaccagcgcgctcgccccgctcgataacatcgcgatcgaccacgcgctccatcggcactacgggaggacgatgcacctcctcggcagcacgcgacgccgcctctgccgcagcggcctcaattgcccatgccttgctttctgtttcgtgctcgtcggccattacggcaactcctcgttaacaatttggaaacaatgtgcccattagagtaacgcggaacgtggggattgcaacccttagttagacgagcggtatgactatatcgggagcgtacaaaaacggccggccacgcttttgcttgcgcggtcggccgtttaatgttttcgcagataaaacctgccaaaacaaacctgtccctttttggaaggttattcgtgctggctggtgcggtgctcgtactcctcgggggtgatgacatcctcgatgcgcaggttgacgcccgccacctcaaggccagtcatcgcggcaaggcgctcggtgacacgtgccttgacatcgtcgaagatcgcgggcgcataggcgccgtactcgatgatgacggagatgttgacgaccacgcgattgtcatcggtgacctcgaccgtcacgcccttggtcagattctcggcaccaaactgctcctgcacaaagtgcatgaggttacccttcatgcccagaacgtgcggaacctcgcgagtggccatggcaacgatcttctcgatcacgccgttggaataggtcagcgagtcctcggactcgtctgcttcctcgtcgtcctcatccgtatcggactcggcctcgacgagagcctcgtcctcgagcgtcacatcctcagcttcggcgacgaccgcctcgttctcctcgagctcggtatcggctacatcgaccttcgtattaaaagccatggttcctccttatgcctgccgcggatgcgacagtcgaatacatattagcggccgctaaacagacggccgaagaagttgacgatcccgttctcgccgtcgcgaatttggccgatcacagcgccgatcagcacgaagaatgcaatgacgagcgtgtcccacaggcccaacgtgagcaccaacacggcgaggataaagccagcgacggcgccgagcgtggtgttgggatgacgcacagcatagctccagatggcagcgcccgtacccttgatgagacccatagcctcgtcaaaatccgcggctgccgcgtcttgcaactcggttgcctccgctttggaatcaacaggttcgttcgccggcgtggcgctctggtcaatcgtcaggcgcggcgtacgagcggtcttatcttgattggtatcactcaccggaaacctccacggtctggacggtagtcttggacggcaaaaaacggacgcgcgcggtcgtacccggcgtgccgagcatggtgtcgcaggcttcctcgatgcgctgctgcatcgaggaagccagagatgccacgtccttatcgtcaagcgcgatagcctcgaccttaaaacggacgtgcgaatcgtcggagccttggacgcgggcctcgacatgctcgaccatcacgcggtcgtcacgctcggcagcagccctagcgcacgaagaaagcgccgcaagggtaacctcgatattgcgctcccccgccggatgcacgcaggacggttcgcgacgggcgaacatcaggcggaaaaagctcagcagtgcgccgagcgccacgacaccggcacacgccgtgacgacgatgcgcggcatggggtcgcgcatcagcagcataaagcgatacgtatacggcccccaaaactggcagacaagcgtacccagcgccacgatggtggcagcaagatacacgatcgctagggctcgtttgagtacgcgcacgcggcgctcccttcaaatctcgactctcgaaatgcaaaacggttcgcatcattataaaagagccgggtccggtgctctacgcacgcggatccggctcatctattccacgaggcttgcatgctcgcttcattatgcccagatatgcacggctcaatccgtgctggcgctactcctcctcaagggcagcgatgacctcgtcggtcatgtccatggtgctgtagacgtcctggacgtcgtcgagctcctcaagacggtcgatgaggcgctgaaccttcttggcgtcggcgccggagacctcggtcggggtggtcgggaccatggtggtctcggagcccttgacctggacgccctgctcctcgagtgccttggagacagccatgacgtcgttagcagcagtccagacaatccactcctcgccggcgtcctcgtagtcctcgccaccggcctcggcgatagccatcatgaactcatcctcgtcaccggcagcaccgttggcgatcatggtctccttcttggcgttctcgtccaggatctccttggcgacgacgatctggcccttgcgctcaaactggaaggcaacggagcccgaggtgcccaggttaccaccagcgtgggagaaggcggaacggacatcagcggcggtgcggttgcggttatcggtcaggcagtcaacgtagacggcgacaccggcgggaccgtagccctcgtacacgatgttctcgtagacggcggcgtcagcacccgaaccaaaggccttgtcgatagcggacttgatcttgtccttaggcatggactgagccttggccttggcaacggcagcggcgaggctggcgttgttctcgggcagcgggtcgccgccgagacgggccgcaacggtgatgttgcggctgagcttggagaagagggcggaacgcttggcgtcctgcgcgcccttacgatgcttggttgtggcccacttagagtgtccggacatacgtgtctcctatcggttttgacctaaagcccagcgcagatgctcgggcaatataaacaaacgtcgttatgatatacctactggcctgcgagataaaccccaaaatgaaggcgtcgtgatgatggcccctttggtgcaaagtaacctgaccccaatgcaccagtttaggcccagaggaggtcgctgcgggtgatggtggcgccgatggcgaagggcatgcaggcgatggccggatacaggtagcgcatgtaagtcgagccgttgcacgggccaatcaggcacacggcgagtacgcccaacagcggcacccagatcgccagcgcacgccatgaatgacgacgcagcaggtagaccaccacggcgatcatgatccacacataggtggccgagctcatggtgagcgaaataaacgggatgcgctgcaccgctacacggtacagattgatcaggtggtcgcaccagcgcaccacgttgctgtcaaccggatggaagtcgaagtatttgaggttgtcggggcgcgccatgatctcggcactgcgcgccgtgctgtagacccatgcgtcgcgggcgctcggataaaagtagccatagtagttattgataagcgctgagatatagcactcggggtcctttttaaacatctgggcccaaacctcaaaataggcgtcgatatcctcctgcgaggcatattcgttaaagcagttcttgacggcatcggacttgtcggggttgtaccggcggcccaggttttcgtacttgagcacgcgatcgatcacggcacgctcttcttcagtcaccaaaccgtcgcagggagcttccacgatggtgccgtcctctttaaccgtaggattgacgcccgagttaaggccgtcgtgcttttggacgaagcgcgccgtctgctgaaacggaatcgagagcacctcgcgcttggagctgggcgtaatgtcgtgcgccggcataaagaccttggtgaagtacatattggagacaagacagagcgccagaacggccaggatgccaacccagcggaagcgcggcacgcgaagcgaggacgcagcacccgtctgcttagccgtacggcgagccgcatgcacgtcccaagcgcaaaacgccgccgcgatcacgcatgccgccagcggaaacaccaggccgccgttacgcaaaaacgtcgaccccatggcgcccagggcaagcaacagccagtcgtgacgcgcaaaaagcacgggcacgggctcgcccacacgctcgacattcgcatcgcgacgaggcaggccacaggccacaagcttgacggtctgcaccagcaaaaccaaaaacgcatcggtaaagagcacgtctttggtgagcagcgccgcgtagtttgagaacatcggcataagcgcaaagaacagcagcgccacgccgcgaacgggcatgccgacgccaaatttacgcagcgacgagatggaatatgccatgcaggcagccgtgataataaattgggcgcaggtgtagatgatgaggcccgcgtttgcgctgttaaagaccgaaaggcccagctgcacacacgagccgataagggccgtgtgcacaaccgggtgatgcccgttgagcagcacattggggttgagcaggcgcaggtagtcgctcgtaccgttgggatagttgaaccactggcgaatctgcgcgcccgtgtcccccataaaaaggccgggcagcgaggcgatgagcgtgggcgtccaggcaaccacgagtaccaagaaggggccagcaaaggggtgttttgagagcacggcgtgggccacgcgccacaaacggccaaagcgcgcttccgaaaacggaatgcgccgagtgctcagccagtccaagcactcaaacgccagatagaacgccacgattgccaggagcatccagcctgcgccgccaatccaggcgcagataatgcgggctttgtcgccgagcacaatttcggccgaatcggtgaggtcgtagctacggccgaacaccatgcaaatggcaaagaacagcgacggcagtatgatcgacggtcgccaggcgtcgccgcggccaaagaacacgtagcgaaacggcagcgtgagcaggcaggcaagcgccagcagcatgaccgcgtcggtgtgtccggcaaacgagaggagcacctcgtagcacacatacagcatgcccgaggcctgcgggtcgatcgctaggaccgcgttgctcgataccggggcggggtcgatggaaaacgccgtggtcgcaaacagggcaagcaaaaatgcgatgaacgtctgcttggcgggatagcgcttaaaccaaacgatgcgagcggcatcgcgcgcagctgttgtggagaggtcggattccttcacagtccaaaaagcctttctagaagcctgccaaaaagggacaggtttattttggcaggttttatctggggaaacgttacagttccgtcatcgttgcccagcacaaccaccacaaaggtgcctgtctgtgatggtttggattaggcgtcgaggtagatgcgctgggggcgattgcggtgtcgggcgaagatgatgagcgccaggcctgcgattatgagcggaaggctcagcagctgccccatcgtgatgacgccacccagcagatagcccagttgtgcatcgggcacgcgcacgaactcgacgaggaaacggacgatgccgtagcccatcacgaacacgcccataaacgtgccctggggcaccagcggccttttgcggctgagcacctgcaggatgcaaaagagcacgatgccctcgagaaacgcctcgtagagctgagagggatggcgcggcatatcgcccgcggtgccaccgaagatcacgccccagggcagatcggtcggcttgccccacagctcgccgttgacaaagttggcgcaacgccccaagcacagggccagcggagcgccgatgacggcaaggtctgccaacgtccatgcgtcgagcttatacatgcggcacacgatgatgccgccgataatgccgcccaccagaccaccgtggaaactcatgccgccctcgttggtggcaaagatctcgagcggatgggcccagtagtagccatcgccgtaaaagacgacatagaacaggcgcgcgccgataatgagtccaaagaccacgccgactacgacgctcgtcaggtcgtcaatcgtgatgttaaagccccaacggcgctgcgtgcggtacatgacgaccgccgtgagcagggcgccgaccacataggccagaccgtaccagtagatagtgatgggacccgccgaaatcgcgacaggatcaagcatatggtagaggtcgttgagcatgtcgatccccctgctccctacatacaaatgcggccgcgggccttacgctcgcagccgcatatttgggcgtaacgtctatgcggagtttgccgtccgcagctttcgcatcttagaacggcgcgtactcgtcgtacaggtcctcggcctcgccggagacattgacctgctcgacgcgggtaacgccgggcacatgctccttgaggatgcgctcgatacccatggacagggtcagcgagctcatggggcaaccggcacaggcgccctgaagctccagcttgacgacgccctcgtcgtcaacgcccatatactccatatcgccgccgtcggcctgcaggttgggacggatctcttcaagaaccttcttaagcagctcttcgttaacagccacaggggctcctttctcacaataacgcgggcacgcccgcggacaggggctatgttactacagccatgtacccgctcaagcgccagccatgcgcacggacacgactttcacgagcagtcaatttgggacggggctcttttggctgtttttgccgccagctggcattggcacgcgctactgctgagcttgctccccggtaccaatatggacatcgacgatgacctggcggtagctgatgccgcaggagtcgaggatacggcggctgatgcggccgtcgtcggtgtcggcatacttgttgtccaggtagacaacctcgcccacgcccacctgcgccaggatcttggcacagtcgtgacacgggaacagcgtgacgtagactgtggaaccctcgaggtctttgagcgagccgcggtagttgagcacggcgtttgcctcggcatggaccacgtagttgtgcttgtcctgcagcgggtcgtcgctcgtgccccacgggaaaaagtcgtcgttaagtgccgagggcgtgccgttgtagcccaccgaaaggatgcggtggttggtgctggcgatgcacgcgcccacctgcgtgttggggtccttgctgcggcgctgcgcggcaatggccacgctcataaagaactcgtcccagctaatgacatcgcggcgcttgcccgacgcagtttgatgaagatcgtccgacatggcagacacctccgtaatcgcaacattttgacccattgtagcaggtaggtggtgggggcgtttcttccccaggtgggacaaattaatcagtagttcttgtcccaggtttgaaagccatatcgagcttgttgccgcaagcgaccctgggacaagaactactgattaatttgtcccaccgacccctctgcctacgcgcggcggggcttttggttgatgcggtagagctcggcgagaccccgcaacgtcagtgcgtcatctaccgtcagactgtgaccgaccaacgacgcgagcgcctcggcgtcgtcgccggtaatgacgatgggcacatcgccctcccccgctgccttggtcgcgcgcatctcggcaagcaccatgtcgagcatgccgtcgatgcgcgctacctcgcctaagaccacgcccgaacgcatggcctcgcgcgtgttgcggccgatgacatgcgtcggtgccgagggctcaacctggggcaggcgcgccgcagcggccgaaagcgagcgggcaccaagcgccagacccggcgcgatgacgccgcccacaaaggtaccgtgcgcatcgatgacctcgatattggtcgtggtgccaagatcgatcacgatgcacggcgagccgtagacggcgcgggccgccacggcatcggcgatgcggtcgggaccgatctcggccgggtcgtcgtagtgcacgggcatgccggtcttgaggcccggccccacggtgagcacgcgtcccgtgcaagtacgggaaagcgccgccttccatgggcgttcgagcgccggcaccacgcagctcagcacggccgccgtgggcacgagcgcgccgggcatgcccgcatcagccgccagcgcggccatgacttgagcgagacgcatgcgcgcctcgtctgccgtgatgcgcgccggcgttgtgatctcgcacgtcgcaagcgggcattcctgcgccgcggccgaatcctcggcaaacaggccaaagcgaatgaacgtgttgcccacgtcgaccgtcaatatatatgcgcacccattaagcattgtcggcgctcctttcgtctgcccagcagtatatcccgtatacaaatgcatcccaaattagctgcttttggcggagcgcagggcggacgatgccgctatactggtgcgcggtcgtttgcgagctcacgcggcggcccttggtaacccgacttcccgcgccgcatccgtagcggcgctcccgggggaagcggatatacgcaaaggagttatatatgagcaacccctcgaaccgcgcctcaatgcgcgggcaactcacgctgcgcggcgtcgtcatcggcgtccttggctgcgtgatcatcacggcaagctcggcctacaccgccctcaagatgggcgcactcccctggccgatcgtcttcgctgccgtcatctcgctgttcttccttaaacttatgggcaacgccagcctcaacgaggcaaacgtcacccacaccatcatgtccgcgggcgccatggtcgccggcggcctggcgtttaccatcccgggcgcctggatgctgggctatgccgaccggatcagctggctcgacatgtttatcgtggcactcgccggcaccatcctgggcctgctggccacggcactcatccaccgtcactttatcgtggacgccgcacttgaattccccaccggcaacgccgcagctcagaccctgcgcgcgaccgaggccggcggcaagaccggtaagcagctctttggctccatggccctcgccggcatctacagcgtgctgcgcgacgccttgggcattgtgcccagcatgctgtgcacgctcaacatccccggcgtgacctttggtatctacaactcgcccatgctgctctccgtcggcttcctcgtgggcttcgccccggtcgccttctggtttgccggcgcattgctgggcaactttggcatcatcgtcggcggcaccgctgccggtctgttcgacgtcgtgaccgcacagggcattgttaagtccctgggtatgggccttatgatgggctttggcgtcgccgtcgtccttaaggacatcctgccgcaggtcgccggcatcgtccgcggtcttgccgccgacagctccaccgacaccgacgagcagtcgctcatctcgggctcccttaagctcgacgccggcatcatcggcctgggcgccgccgccatcgccgtcgtcatcgccatcgcactcgaccttggccccgttcctgccgtcatcgtcacgctgttcacctttgtcaccaccatcatgagtgcgcagagctgcggccagacgggtatcgaccccatggagatctttggcctcatcgtcatgctcatcgtggctgcttttgcccagatcgctcaggtcaagctgttctttatcgccggcatcgtggccgtggcgtgcggccttgcgggcgacgtcatgaacgactttaaggccggcgccgtgctgggcaccaacccgcgcgcgcagtggatcggccaggccatcggcggcatcgtgggcgccctggtcgccaccgccgtcatggtcgcactcgtcaccgcctatggcccggacgcctttggccccgacaagagctttgttgccgcgcaggcaagcgtcgtcgccaccatggtctcgggcatcccgagcgtgccgtggttcgtgggcggttttatcgccggcatcgtcatgtactggctcggcattccggccatgatgatcggcttgggtgtgtacctgccgttctacatgtcgctcacggccttcctgggctcctgcgtcaagctcgcctacgacaagtgggccgctcaccgcgacgccacggccggtctttcggacgaggagaaggccgccaaggacgctgccttccaggagcagggcctggtcgtcgccagcggcctgctcggtggcgagtccatcgtcggcgttatcttggcgtttgtctctgttggcctgagcctgctgggctaagccgagcagctgctcgcccgaatccattttgtctacggctagcccggtaggtggcccatgcggtcgcctgccgggctttttcatatcgaaacagtaaaaggccggcgcgcaactttaaacagcgcgccggccttatcaatttaactatcgaggcggcgtcgcaacaaaccgtagtccattgcgaggtcgacgctcgaagcgctacatctgcttgcgacgacggtcgctcagcgtcacgcccgcggcaacgagcgtaataccgccaataacgaagacctcgcccgcaagcgcggagttgtcgcccgtctgggaaagtacgccatccgcagtcttcttcttgacggcaggggcctttgcggcagtctgcgtaacctgaggcttggcctgcggctcggccttgggatgatacttgtcgtactcggcctgtgcggcagccagggcgtccttggcatcgccaagttctgccagtgcagcggcataggcgtcgttggcatcggacagcttggcatcggcatcgctcagggcggccttgagaccagcggcggcatcgacggcagccttgtagcgagcgtaggcggcattcagcttgaccagcttatcgttgcccgtcgtgcccgcggcaagagatgccttgtggtcgacggcctcaaggtcggccttaagtgcctcgtcgtttgcgagctcggccttggccttgacgatctcgaggttcgcatcgacgacggcctcgttggcggcctcgagctgcttctgggcatcggcgacaccggcgacggcagcatcataggcggccttggcgtcgtcgaccgccttctgggcgccggcaaagcgctcgaaagccttgttcgcggtggccagctcgccctcggcagccttggccttggcctgcgcgtcggacacagcctgcgtcttggcgacaactgcctgcttggcgtccgaaagagcggtcgcggcctgtgcgcctgcggccttggccttgtctacaccagcctgggcggcgtcatcggccttcttggctttgtcaagggcgccctgcttgttcgcaaggtccgtcttggcagtgtcacgcttggcggtaaggtccttgaccgaagccgtagcgttgtcatacgcctcactggctttgtcggactttgccttggcggcatcgcgggcgctgagagcctttgccttgtgggcagaagcctcggtggccttcgtctggcagtctgccagcgtggcgttggcggcatcaagggctgactgggcagtagcagcattgctcttggcggcgctgaggacgtccgtcggcgtcttgatatcgatacccttgaggtttgcctcggcggcatcgtatgccgtcttcgcggcggcggcgccggacttggccttctcgtactcgcccttggcggtgttcacgttcgtgtcggccgcggtataggcgtcgtgcgcggaatcctttttgttgacggcagcgtagtaggcattgctggtcgaaccgtaattcttctgtgcctctgccagcttattctgaagctgcttcagctgctccttctgctcctgcgtgccgcctgcgttgtaggcggaatcgatgtagtcgttgaggagcttcttgaactcggagacagtgaaatcggcctgcgtgtcatcagcgctgtaatcaaatatggttacctcggaatcggtgttcttaccgctaccggttgcgatgccgatagccttcgtaccggcatcgataatgttgagataatgcccgcactcatggtagatgctgttgtagtgctggtagatatagtaggaatcatatcgatggttgccgagttcgtcgccatactgcgcgacgtacttattgaatgcctctttctcttgggtgtagaggccggtgtaaggccagccgagtgtatcctcggtttcgccgccggtatatgcgccgcctccgccggcaagattttcaccgttgtcatagtagcagcccgagtgtccccagatgttcgatgaatatgatgtattgagggcggctgccacggtcatgcggaggctgacgctgagcgccgactgaccgttcgccttgcggaggttgttctgggtgtcgagatatgtcagggcgttgcgcatctgttccagggaaagcgggttggtgtcgcgagacatgtcctgatcgacgtaattgtcataccactcggctttatcgtccgcgccggtcagcatcgatacagcgtcttgggcgttttgcttctgcgtggctgtgaactggctgccgccgatgatatagttcatgaaaccgaacatgccctggctgatgacattctggtctacggtcatgttcgacttgaggtcggcaatctgctggttaagcttgtcgacttcagcgttcgcggcatcgtaagcgctctttgccgatgtaacctcagcgcaaatagagtcgtattcggctcgcttctgctgacggacctcgacgagtcggtcgtactcagccttcttgtcggcctcggtctgctgggccttctcgtatgcggccttcgcggcgtcgcgcttgctggcggcggcgttgtactccttgtttgccgcatcgtatgcagactgggcagatgccacagcagcgttggcggcgttggccttctcctgcgcggcggtggcggcagtctgcgcagcctgcaggttcgcctgtgcggtggcgtctgcagtcgttgcggcatcgagcgcggtctgtgcggtcgcaagctcgctggcggcagtgttcttggcggcctcgagcgcgttcagatcgacgcccatgcccgaggtcgcagcatcgagcgcagcctgagcctcgttcagcttagcttgggcgttatcgcgcgcagtggtcgcagcggcgagggcaacggcagtctcctgcttcttggcctgggcagtcgtcaaagccgcctcggtattttgcttttcctgctgggcgctggcctcgacagccttggcctggtccagattggcctgtgcagtagtaacagccttattggcggcatcgagctttgcctgcgcgtcctcgacggccttcttggcggcctcgtactcgtccatacccatggcctcgagcttggcctgggcatcgtcgagagccttcttggcctcgtcctgctttgccttggcgtccttgagcgcctgggtcttatcctcgacactcttgctggcctgatcgagctgatcgttcaggtcgcccagcttcttctgctgctgctcggtcttttcgacggccgccttaagctcgtcgatcttctcctggagcgcggcgacttctgccgcgttctgctcgacctcgttgtcgcttacagcctgcgaggcctgatctttttgctgctgggcctgcttttgagactgacccgccgcctcggccttcttctgggcggcatcgtaggcagcctgggcatccttgagctgctttgccgattcctcggccagctgggcagccgtctttacgaccgcttggttaccggcaacaacggtgttctctacagaactaccccccccctggatagaatcgccgttatcggctgacggtgcagcgattgccgccagcggtgacatgagcggctgagcaatgaggccagccgtcaaaacggttgcgacggcacggttggcaacgcccttaacgttgaccgccttggcccgaggctcaaagtgttgcggattatagttcgccatggctttctcccttttgacacggatgtatccatacgcctcaaaaggtagctgtcgatttttgaattctgttgcgcaacattggcgaccagcgtattttttgaaattcgtgctcctgcgcttcacaatttcgtcacatatgaaagagttggtgcatcatattcttgcgggatggaatcgagcctgtgatttccatttgctcccacatcatccgtcctatcggatcccgcgtccaacagacacctcgcccgccacggtgtagagtagggacaacgggcgcgatgcgcggaccgcgctggaacgaggtggacatggaactcgacaaacaacagatcaagcgactgcgcgagcgccatcaccggcgccacggcatccgccctgcgcacagcgaggccatggagaacgccacccgcttcctaaatcaggcgttcaacattcgcgaaggtcgcgcaccctatcacgtaattcgcaagcgctttgtaaacggggcgcgcctaaccggctcgcatctgtgcatcctcatcatcgccatgcttatcgcgagtatcggactcgatattgactctgacatcgccatcgtgggcgccatgctcatctgcccgctcatgggctcggtccttgccatggcatacggcatcgccacgctcgaccgcgagattaccgtcgaggccgtcgcgggcctggcgctgcaaatggccttttgcctggtaacgtccacgctgtactttaagctctcgccccttggcgccaccacggccgccatcatcgacaactcgacacccactgtgtgggaccttgccgtcgccctcgcgggcggttttgcgggcggactgggcaactcgcgtgaccaggaacctgccacgcttatcgccggcgtggccgtggcgaccgcactcatgccgcccctgtgcgcagcgggttacggcatcgccatcgcaagcgggtcgttatttctctcggcgctctacgagtttggcatcaacgtggtctttatcgcgctggcggccgaagccgtgctgcttcttttgcgcgtgccactcaagcgcgacctgaacggcgacggcattatgaccgccgaggaagacgccgaggtcgacgagctgtcatgcaaggtgcgccgccgcatcattgtgggcacggtaatctttgccatcccctgcatcgttatgacggcgggctccattggctcggcgcaggccggcgtgcaggacggctacggcgtcaccgagaccacgcgcgaactcgcggcggtgctgccgggctttaaggattacaccgtcgccgtcgagacttcggccaccgaaggcgacgaggaaggcatcgtcgagcgagagattgtcgcccatgtgacgacgagcgagacactcggagcacacgaccgccacgtcgcccgcaagctcatcgacctcaacgtccccgaactcgaccgtgtggagtttgacgtgaagtgatgtggagcatgggatggatggcgcacacaggcgtaagtcgcggcgagacgcagacacaagcaaaaagaggggcgcagttcatgcccacatcccgctcgctgttttattgcagcgaatcacccgtccgtatcgacatcgccagactcaactgtaaacgccggatcggtgctcacaagataaaatcgggtcaccttagtatttctaattaggtagatctgcccctgatcgcgccggcgcgatatatacgcaacgtgaaccgtgccgaattcttcgccgttttccttctttattaccaggatgttgggatcgtccgtacgcttaaactgcccgtctgtgcaggttccgtctttgtcgaccagctgccatcggcagttgtcctcctcatgaaaagccaggatttcccgactcgttttgtcatcccggtagaaaccatcaatggcaaaaccttcggaggcgcatttctgcatataggacgtttctcggcttatagcaaacagccctgtagcgcccaagagcacagccaggcagaccactgcaagggttatcgaaataacacggcgatccatgttagcccaaccgatagttgtttaacggagcgcgaaacatgcctggaacctccgatatcagggggaacgtcgccagcagactggagacaactatatgttactgacattaaaccatacggctgccacccgcggagggggtatcggcgagcggtgtgttggactcgcccgccatgatagtgaggtgctcttcctcctcacccttgagagctgtcctcttgactgcgaacgtcgatgtgcgactcgtgccgtcctgcgctgtgcaggtgagggttaccgtgtttttgtggctgggaatgaggccgatgaccttgaactcatgctctgttgttggcgcatcaccgccgtgaggcgtacgggagaacgcagcgaccttgagtgcatcgtcggacttcctacggccggcgacctcgtaggagacggttacgagatccgttgtcgcaaaacgtacgtagcagctcagggtatcggtgccaaagggatcggctttgacaaacggggccgtttcgtcgtagccgcctgcagcgtacttggcatcgagttgttctttgatggccgcctgcttctcgacgttgtaggtcgcgacgatctgcttgtggatcttcttttgctcgtcggtgagctcggtatccgcgttggatgtatcgctcgcatcggttccggcagcagagcagcctgcaagtcccgcgctcgtcagcgccaacgcgcccgccgccgtgcccgcaagggcagcacggcgcgtgagcagccgaccgccttcgttactcaatcccatgtcgtcaccatcgaagaatgtcatcgctgccgtttccttcatataccagggcgcttgccaagctctgtccaactatggctcgaagcttaacaaacgccccttaaggcaagcttaggctcgcggcagttcggagccgtggccgcgacggcgttcgatccagctcacggcaaagtcgacgagctcgcgctggcgcataaagcggatcgtcccgttgccgagaggagccgtgtgaaccgtgcattcacgctcaaaagcagcgccgatctcgtcgaagtcctcgccgttgacagagagtgtgcggtattccttccacacgcgctggccgttttccataatcgcactgtgctccacgcagtcgtgcttgccggggtactgcgcgcgggcatccgccaaatgcagggatgtgttcttgtcgtagcctacgcccacgagcagcacataaccgtccaaatcgtacaggcgcgcgatgggcgatccgtcgccaaagatattgcttagatcatggttttccgtcaggaattgcgcgtgcgggccgtttgccgccaccgaacgcgccgggtggtcgctgcgaagcgtacccggccacgtgcggaacatctcggcaacggcccccatcgtattggtgggcgtgatgcgcttgtcgtaggccggccaattatcgcgaatcagctgccaccactcttgcggctcctgccaatggacgccgctcgccgggtccaggtttttccacgactgggccggcatcatgacggtgccggtctcgcccaccgtctggagcagcgcctcgatcaccggttgcgcgccgccgcacacatatccaagcgagctgagcgagcaatggaccataaccgtctgccccgagcacattccaacggcagaaagcgcatcgaggatatcctgcttgagcacgatttgtcggtccattgccgctcctttctatttctgggtccttcttctcactgttgtcagccgaaaatgatccgttttcctccgtccccgagggatcattttttagtacttgaagaagccctcgcccgagctttcgcctagcttgccttcgtcgagcatctttttaaggacggacgccatggccttaaagttgtagggcatcatcatctttttgagcagcgggctcaccaagcccgggaccttctgatattgcatgacgatgttataggccgtctggatgcccacggtgtcgaacacgcggaacgggcccttgggggcgccggtgccgcgcgtccatgcgaggtcgatgctcttggggtcgctgacgcccgagacatacagatcaaggccagagagcagccacggcaccagcatggagttgagcaggtagccgttcttttctttgttgacgggaagcgccagcatgcggatgtcgttggcgaagtcaacgagctcgtcaaagtagcgcttgtcggtctggtcctgggccatgacctcggtcatgttgttcttccagatggagttggcaaagtgcagtgacaggtacttctcggggcggccggtgtacttggcaaaggtgctcggcagcagcgtggaggagttggtcacgataacggtcttttgcggcaggaccggggcgagcttcttgtagaagtcgatctttgcctgagtgtcctcggccatggactcgatgaccaggtcggcgtcggccacagcggctgcaagatcgagttccagcttgagcgtggagtaagcgcgctcgacggcggcaagcgccgcttccttgtcgaagggctggtcgctgtcggcgatgccggcgcaccactcgcccgtgccgtccgccatgccctcgattgccgcgatgtactcctcgcggacatgatcgatcttgggctgggtgcggccgatactgccttcgctgcgcagccaaatggttacatcaaagccgcaataggcagcctggaaggcaatctggcttcctagcacaccgccaccggcaacgcaaacggtcttgtagctcataggaacagtcctctcttacgtaattccatagatgtgtatttattcaaccgtaaggaggccgcgcggcgagggcgggtcccctaaacggacggtatttggcggcgaacggctacatctgttcattatctcagggttctgaaggacattttgcttgccgtcggaccgccgttttcggaagtatgcggcaaattctggaacccccgagcacacccccgttttccgcagacaaagccgcaggtacagagcttggacatacctggtgtgttcggcctattcagattttgccgcatacttccgaaatccgagctctcaggaggcaaccgcaagaccatttacgcaacagatgtccaacaaaaacgggtgatagccggcacggctaccacccgtttgtcttatatccgactcgaagcagaccgactacttcttaatgccgcgacccaggcgcttggcgaccgatgccacggcctcctcgctcaccgagtcacagctcgcacatccgtcgtgggcgcgcatctggccggtgacctcgtccatcgcgagcggcgccaccttctcgagcttaaagcccttgccggcacgcatgttctccttggccacactgatcatgagcttaatgcggttgagctggttgacctcggatgcaccggggtcgtagtccaccgcgacgatgttgctctcgggatgctgacggcgcagctccttgatcacggccttgcccaccacgtggttgggcaggcacgcgaagggctgcgtgcagatgatgttgggcgcgccgtgatcgatcaggtcgagcatctcggccgtgagcagccagccctcgcccatgttgttgcataccgaaagcaccgtacgagccttgtcggccatggtgccgatacgctcgggcgcctcaaagcgctcggacttctcgagcagctcctccaccggcgtgcgcatccagtccaccagcttaataagcgcctgcatgctagcgcgaaccgtggcagagcttcccagctcgtccttctgcagctcggcgttgctcatggagtacaggaagaagtcgagcaggcccggcaccacggcctcgcagccctcgcgctcgatgacgtcaaccacgtggttgttggccgtgggatggaacttgaccaggatctcgccgaccacgcccacgcgcggcttggtgccctcgcccacaagcggcatggtgtcgaacgcgcggatggcctcgcgagcgagcttggtgtagttgtgcctgttgaacttgggcgccagcttgcgggcgcgcgccatgcactcctcgtagagcgcgttggcggcaccgggcgtggcctcgtagggacggcagcgatagagcatctgcatcatcacgtcgccaaagagcacggcgtacacggcctgcttgagcagcgccggcgtaatcttaaagccggggttgtcctcgccgagcgccacagccgaaagcgagatcaccggaatctcggggtgaccgctctcgcgcaatgccttgcggatgagcgcgatgtagttggtggcgcggcagccgccacccgtctggctgatgaccacggccgtcttggacaggtcgtagcgaccgctctcgatggcctccatgatctggcccgtcaccaaaatcgacggatagcagatgtcgttgttcacatagcgcaggcctgcctcgacggcgtcgtggtcggtcgagggcagcagctccaaattgtagccggcaccgcggaatacctctttgaccaggtcaaagtgaatcggcgccatctgcgggcacaggatggtgtagccctcgtcgcgcatctgctcggtaaagggcaccttgggccacgcggtcgaagcgctctcgcgctgtgcctcaaacgtatacttgcggctcgcgaacgcgggggcatccgtggagggcgccacaggcgcggcatcgccctgctcgtaggcctcgcccgcggccgtggcctcggccaggcgctcggcctcctggtccttgagcgccgccatgagcgagcggatgcggatgcgcgcggcgcccaggttggacacctcgtcgatcttgagcacggtgtagatcttgccgctggcctcaaggatctcctgcacctggtcggtagtcagggcatcgagaccgcagccgaaagagttgagctggatcaggtccaggtcgttgcgcatcgtcacaaaacgggcgacggcgtacaggcggctgtggtacatccactggtcgacgacgcggatgggacgctcgggcttcaccaggtgcgcgagcgaatcctcggtaaagaccgcaaagccaaagctcgagataagctcgggcaaggcatggttgatctcggggtcgttatggtagggacgaccggcgagcacaatgccgtgaccgccatggtcctcgacccacttaagagcctcctcgcccatggtctggatgtcctcgtggaagcgcgcgtcggcctcaaaggcagcgttgacggcggcatcgacctcggaacgcgtgatcttgggtccacgcacgcgaccgcgaccggcctcagcatcggccacacggtcgacggcgagcacctggtacagacggcgcttgagctcggtcttatcgtgatagggcacaaacgggtacaggaactcgatgttctgctcgcgaatctcgtcgatattgagtgccaacgccgtgggatagctcatgacgatggggcagttgtaacagttgccggcggtcggatcctccttgcgctcccagcgcacgcacggcatccagataaagtcgacgtcgcggtcgatgaggttcatcacgtggccgtggctcatcttggccgggtagcacacgctctcggacggcatggactcgatgcccgcctggtaggtctttttgctcgactgctcggacagctgcacgctaaagcccaggcgcgtaaagaacgcatgccagaaggggtagttctcgtacatgttgagcgcgcgcgggatgccgacggtgccgcgcggggcctcgtcgggactcagcacctcgcggttaaagagcagctcgtttttctttttaaagaggttgggggcctcggtcttctgctttttgtggccggcgcccttctcgcagcggttgccggtaatgaagcgcctgccaccgccaaagtcgttgacggtaagctggcagttgttagagcaacggccgcagcgaacatgcttttgcgtcacggtgaggtgcgcgatgtcctcggccgaaaggatggtcgaggtgccgtcggcgccagcgcgatcgcgggcgagcagggccgcgccataggcgcccatgcagccggcgatgtcgggacgcacggcatgaacgccggtgagccgctcaaacgcgcgcagcgtggcatcggacataaaggtaccgccctggacgatcacctggctgccgatctccttgggatcgcgcagcttaatgaccttgaacagggcattcttgatgacggaataggacaggccggccgcgatgtcgcccaccgtggcgccttccttttgcgcctgcttgacgcgcgagttcataaagaccgtgcagcggctgcccaggtcgacgggggacttggcatggatggcggcatcggcgaacgcgcgcacgtccatgttcatagagacggcgaagctctcgataaagctaccgcaacccgacgagcaggcctcgttgagcatgatgtgttcgatcacgccgtccttgacgcgcaagcacttcatgtcctggccgccgatgtccaggataaactcgacgccgggcaggaaagccttggcgccgcgcaggtgcgcgacggtctcgatctcgccggaatcggccttgagggcctcaatgagaagcgcctcaccgtagcccgtggtggtcacgtggccaatggtgcagccggcggggatgtggttgtagaaatcggccatgatgaccttggccgtgcccaggatgtcaccgttgttgttgccgtaccaggtgtgcagcagctggccgtcctcgcccacgagtgcggccttcatggtggtggagccggcgtcgataccgatgaacacgcggccggtgtagccgtcgagcttgcccttggggacgacctcggcgtcgtggcgggttttgaactcggcaaagtcctcgtcagtggcaaagagcgggtccaagcgctcgacctcggcaccctgcgtgtcacccagactgtcgatggcatcgataagctgcgggaacgtgctgagcttgttggactcgtgcgccatggcggcgccgctcgccacaaataggtgagcgttttggggcacaatgcggtgctcctcgtccaggttgagcgtgaggtagaagcggtggcgcagctcggagaggtactgcagcgggccgcccaggaaggcaacgttgccgcggatgggacggccacacgccaggcccgagatggtctgggtcacgacggcctggaagatggaggcggccacgtcctcggggcgggcgccttcgttgagcagcggctggacatcggtcttggcaaaaacgccgcagcggctcgcgatgggatagatggtggtggcgttggccgcgagcttgttaaggccgctggcgtcggtgtgcagcagagtggccatctggtcgatgaacgcgcccgtgccgccggcgcaggtgccgttcatgcgctgctcgatgccattgtcgaagtagatgatcttggcgtcctcgccgcccagctcgatggcgacgtcggtagccgggatgagggtctcgacggcacgtttgctggcgatgacctcctggacaaactccaggtcgagccactgggacagcagcaggccgcccgagccggtaatggcgcaggtcatctgggccgtcggcagcacggtcgcagcgccctcgaacaggtcgcgggcgcaggcacggacgtcggtgtggtggcgctggtacttggcgtagacgatctggttgtcgtcgttgagcacggcgagcttaacggtggtggagcccacgtcgatgcccaggtgcaggttgccacaagcgttctcggggttgaagatcgcgccttcgggggcgtggacggcggctacgggctcagcggcggtggcgggctcgctatcgacggacgtctcccctgctgcgttcttggcatcggcaactgcctcggcaactttctcggcagccgcggtcgcggccttctgcgcggcgtccaccacggcgggcgcggcctcgcgtgcggcagcgaccatgcggtccttgatgccctcgacgagtttgctcatctgtctctcctcttagttgttgggctcgacggctgcggcggtgtcggccgcgtcctcgagctgcaaattcaataacttcatgccgtattccggcacgttgatatcgatgggttggccatacaggtcaccagggcgcacaaaagcgagcaccgtcataatgcgcgccatggcctcgggcgattcggtgagtccacgctcaaaccagcgctgaatcatgccgacctcggcactcacgacgtaggtaacgtagtagtcaaagaacgtgcccagcgccaggcccaaaatacccgtctgcgcacgcggcaccacagcctcacgcgcagtgtcgatgatccttttaatgaaggcctggtcgccgcccggacccaacagcgcaccgattaagtcgcggttggccgcaagataacgcagtagctcaaccgaaccgggcgctggctcgagctcatcgatgttgtgatagaggtcaggcaactgagctgcagtgatgagctcaatgcgctcacggatctcggccagcaagccatcctcgatttgattgataaagtcgggaatatcgcggtagtgcgaatagaacgtgcggcgcgtaaggccggcacgctcggtgagcgacgcgacgttaatgcgcgaaaggtcgccgctttcggcaagctcgctggcaagtgcctggcgaagggcacgctgcgagcgaagggaccggcgatcgcatttctcgagctgggacaaacgtcctccttgttactcagcctgtgcgctattgcacagtgcgagtattattgcacaccgtgtgcatcaacacgtaaaggcaataatttggatgtgacgaagggcagtccctttgtcacatccagcgaccgcctaggttgtgccagttgtacccggcttttggagtggcattgccgattgttcaaaatgtcattcgtgggtagaatagtgtcgacggcagcccaagttctggaaagctgggcagcgccgttgtttgcattagggggtcaacgccttagcggcggcgaccccttctgtcgcgcttcgaacgctgcttgagtgcctcggaaaggccgacaagcgccgtgaagaacgggaccaaagcggtcagaagtctcacgaaatcaatcaaatcggtcatgggcatcacctcccatcagatggagggcgctgcccgacacatggagctgccgtcaacgataccgattctatcaaaacttagttatatatacgaatatatgttcgcatgccaaaggtgcagggttctcatgaaaaagggctgtccctttgtcacattattcgatgacggtgcgagagttttgcttgcgcatggtggcgagcatgtgtttggggacggcgtggaccatgcagctgccgatggtcgcgctcgcggcggccttggctgcatcgcttgcgtttttggtcgcgtagctgtggcggaaacgcttgagcatggcgatgtcgttgccgccgtcgccgtagaccgcgacctcatcctcggcaataccgtagtagcccgccagccaggccacgctctcgcccttgttgcacgccacgtccgtgatctcgaacatcaccggatcgaacggcgcgttgaccacgcggtccgatcgctcggccaaatatgccttaaggtcgcgctccagctcgggcgaggtcacgcggcagttgatcttgcacacatcgtggcgcaggatgtcaccgatcgactggtcgaaatactgctcctcgtgatacccgccacgtgcacgcatgccgcgcatcacaatacgcttgatggggctgtcctttttaaagcccgcctgatgcatctcgaacgaaccgctcgagaacatgccatcgggcgtggagcagtcgaagcaaatgtccgggaatgccttgagcagctcctcggtaacctgcggatcgatggtccaggttttgagcacctcgccatgactgtcgcgcacgattgatccattggagcagcaggcgtcaagcgccaggcccgtaaagccatgctcgccgatcggcagcgtcgagcgtccggtcgcgggaaccacatgcaggccagcctcggtcagctcgcgaatggcgcggcggatggttccgtcggcctcgtgcagggcgttcagcagcgttccgtctaagtcactcgcaaacatcttgatcatgggcatgcctctccttcgtctgcacgatattgtagacgagaacgggcgtgcccaaacaatggcgtcccggcgcgacgtgccactgcctccacaaattcacggtgccccagtgccttaagacattcgccataagcgacttttcagccgataaaacagcgctgtaatcaacgtcagcaccgccaacattcctgcgaatacaatcgccggagtccatcgatcatatgcgagcccgtaaaccaattggccaataggcgttgcacaggaaagcatcatataaacgagtgccagcacttttccacagagttcctttggcgctgaccgctgaacaaatgaaacgatttcgaccgatgcaatgcttgcccacgccatgacccatgccgagccggccacaagcgcggcaaacgcaaattcatcaggaccgctcagtagcgtgacaataatcggcacgactccaagacagatcatcgcaacatatcgacatatgcccttgaaggaaaaacgatgtgaccaaataccgaccaaaccactgccgacaagaccacctaagcccatagccacctcaataatcccaacaaaggatgactgcattccgagatgcttcgcaacaataacgggagcaccaatcgttaacccaactaacgcaaggttcaaaatagccgcaatcaaaaacacaacgagcaatgatgagttttgagacaggtaccgaatcaactcccgaaaatcgtttcggcgtgtcgtacgaatcgcgccgtctcccatcgtttcagatgaggcattttgcttgagtgcgcccccgaacagcagggctgaaatcgtaaacgtcaacgccgcggtttcgcatagagtatcgataccaaagcacccatagactgccgtcccgactacaggccccaagatattgctcatcatgattatctgcgagaccaacgcagtggcacgctcaaccttttcttggcccgtcatacgcaccgcctcaatttgaagcatcggtttcagcagcgattggatgccatattggacgcaaagcattgctgccacgacaaccgcaagaggcagcgaacgcttcatggggataaacagcagtgatgcagccatcagaacaatgccgagtaccacaagaaccccgcgatgtcttccccgatccgccaaaatcccgccaaccggagtcgcgagcacgcccggtatgaacgctatcgccgcaacggcgccatataacgttgaggagccgctgcaatcgaacaagtaaagcggacacgcaaagcacagtgccgacagcatcgaatacgcacacagctgtgcaacaagaagaccaaatagcctgatagatcgcactgtttttggcgccaatgaaacgctaattcttcgcatcccagccataagcctgcccccaaatacatactgttagtatgtatttaatgacttgaaaagggcagccgtggctaccctcacaaatcaattacataccgttggtatctatattaccatccggcacggttccatacgtcccaaatctgggccgttgtctggagcacttcattacccaaatcaagccccaccgcggccgccatctgcgccaaacattgtgcgcgagcaagcattcgctccttgggctcgagcggacggaacaatggcagcagccaaagattcgctaacaacgatacggcctccgctgcttcgcgcgggcattcgcacgcaatggagccgtcagcgatgccctcctcgattactggcaagagattgccatcggccgactcgtcaaacgaaccttggtactgcatcgccagcagccgcgagctttttaccggatctgccgcaggatgcatgcgagcccatagctcgatttgcggaacgacggactcgggcgcataaagtcgtttgagcttttgagctcccgtcatattgccagcaccgagtgtcgcgcgacggtgctcagtaatcggagccgttgcccgatcaaatgcggcgttgaaaatctcctctttgctcttgaagtgatgatagacagcacccttggtcatgccattgaggcggtcgacgatgtcttgaatgctcgtcccctcataaccctgtacgcagaatagctccagcgccgcgtcgagaatcttcgcgacagtctcctcgggatatttattacgacccataatccgtccatccacaacgcaagtcttgtgcctcattgcagcattttaacgttgcggatggtagacggtcgattctacaccgcggcggggccgtgttcgccggtacggatgcggatgacttcctcgaccggctcgacccaaatcttgccgtctccaacggcaccggtgcgagcggcgttgcagataatctcgacaatgccgtcgacgtgctcgtcggcgcagatgagggtgaactgcaccttaggaatcgtgttgacaagcaactcgttgccgcgaacgtattccttccagccatgttgcgcaccgcagccctgcacctggttgatagtcataccgcgaacatcagcatcaaacagcgcgtctttaagaacctcaagcttctcctggcgcacgatagccgtgatctttttcataatgaattcctctcaaaaatcaacgtatccctttacatgagacgcgggtttcccaggtgccgcaaaccaacctcggaaatcaaaaagttcaactgactggtcttagcaggtttcccaagtgccgcagattgccgtgaaagaggagcgaagcgtacttaagtacgtgagcgacgattgaacggcaaggtgcggtgcttggggaagctgctaatcgagtccggagaacgaaggataagcgctctcgccgtgctgactcgcatccaggcccagcgcctcgtcggcctcgtctacgcgcaggctgccgtggaacagcgccttgaccaccgcggcaatcaccaggtcgagcaccagcacgataacgatcgtcaccacaatacccaggatctgcgagatgagcagcgacacatcacccgtgtagaacaggccgcccttgccggtccacgaaagctccggcacgcagaacaggcccgtgagcacgccgcccaggatgccgccgatgccatggcagccaaacgcgtcgagcgcgtcgtcgtagccgaacttggtcttaagatggctgatggcgaaatagcagacgggcgagacgatcaggcccatgaccagcgccgcccacggctcgacaaagcccgcgcccggcgtgaccaccacgaggcccgcgaccaaaccggtgctggcacccaccagcgtgggacggccggtgtgcacgcgctcgacggcaagccacgagaccatgcccgccgcgctggccgttacggtgttgaggatggcaagcgccgccacggcgtcggccttgaactcactgccgccgttaaagccaaaccagccaaaccaaagcaggccggcgcccagcgccacaaacggcacgttatgcgggcgatagctcaccatgccaaaaccgcgacgacgaccgagcatcaggcagagaatcaggcccgtcagaccggacgagatatgcaccacgtcgccgccggcaaagtcgagcgcgccgatgatgtcgccgataaaggagccctcgccgccccacaccatgtgagcaagcggcgcgtaaaccacgagcagccaaatgcccaggaaggccgccatggcgccgaacttaacgcgcccggcaaggctacccgtgacgatagcggccgtgatcatggcaaacgccatctggaaggcgatgttgatgatctccgggtaggcagcaccgtccgcggcattgccctcggcagcctgcagcacctggttgagcaccggcaggcacagcagctggtcaaagcctccaataaacggactggagccatcgccgccgtaagccagcgaccagccggcaatgacccacagcacgcccaccaagccaatgacaccaaagcacatgagcatggtgttgatgacatttttgcgcctagacaggccgccgtagaaaaacgccaggcccggtgtcattaaaaacacgagcatggtgcagatgagcataaacgttgtcgatcccgtatcgtacattcgctcccccttggtcgcatgaacgttgtcggcgctcatgatggagccgaagggcaactggtgtagaccagatacggcgttgttaaacgctgcgttttcgaatggaaacggtgccgcaatcttggaaacggcgcggcaacggacgcgaaacgaacgggaaacgtgcgggcgagaagggcgcacttggccccgccccgactagcgacgaaacaggtcgcgagcgcgatcgcgaagattggttgctcggataacaccctcgtagcggttgatacgcagacgagggaaggcgttgaaaaagcgcagatcgcggcggctgagcgacacgctcggcaccggacggctcgcgcgattgccggcacggagacgagtgagcgacgggcgcggcatactcggtgcggcatcggcaacacggcgggcggcaagcgccaggccacgagcgccgtccgagataaacgtcggcatcgacgctttctcacgcagagcatcgagcgccgcatcgcccagctcggccagccatgcgttgacggcacggctgcggatatgcgtctgcgccaccgagtcaattgccgaatcgggaatgcgctcgagcatggaatccgaggcatcggcgagcgattcgttgatgcggtcggcaaggtcggcgcgcacgcgctcgagctgatcggacagacggcgccagctcgccagcgaacacaacgcatccacggccatcgcaacggcaacggcaaaggccgccagtcgcacgatcagcaccggcagatggccgagcagccccagcagtgccggctccaccaggcggcaaatgaacagcgcacccaggccaaacgcgcaagcccagtacaggcagatgcgtccatgcaggttaaacggcagatgtgaatagtcccaaaaccgggcgccggtcgttttttcgagcaacacgcccacgctatattcgatcacgctgcacacgagcgctgcggcgacaaactggctcgaggcatccgggatcccgcgcagcagcagccagcaggcaatgccgcccgcaccgtagatgggacagcacggccccagcaaaaagccactgttggcaaagcgtccgtgattgagcatggcgcagactgtcgactcccatgcccagccgcaaaagccgtagaaagcaaacgagagcaccaacgccgaaagcgggcaggcggcaagcgtcgcaccgccaaatgccatgccgatcgcggttcccaccgtctacccactcctcttttcgttcgattctttgctcgagccgtcgctcgagccctcgttcaaatcgttcgcgccgcctttgcgcggcagacggccggcaatcgtctcgcgcagcgcgcaccatttatctgccaggcacacaatccatgcctcacgacacgtcggcggcaccggcaccagcggaaacatatgacgcacgatgatattccgctcgcgcgacgtcagctcaaaatcttcctccgcacgcgccagggcaaaaaacggatgccgaaatccgtgcagtcgatggctcgggtcggggtcatgccaatcgtagagaaagtaatcgtgtaacagggccccgcgcagcagcgaggcacggtcgaccgaaatgccaacacggcccaggcgctcggcaaaggacagacttgcccgcgccaccgaggtcacatgcgtatacaccgtcacatcgccatgctggataaactcgcgcgtcaggtccagacggcccgcctgtgccagttgacgggcagcatggtctacttcgcacgcgattttctcggcacgaacggcatcggacatgctgcctccttccagcgactcacgacgacaaggcacggcctgcgcgcaatgaataaaatcatcatcgaatctaccagtatggcatcggacaaaacgttttgccccaccagttggcgaattaccgcgccgccgtcacatatcaaacgccaaaatgtgcgagactgtcttgtgcaattgtgccggccgagggagtgccggcgcacgattcgcatggagtaacccacaacgatgctgcttacgcaaacgacaacgcccgaggacgtcaaggctctcgatcgcgccgagcttccgctgctctgcggcgagatccgccacgccatcctcgaaagctccgccgccgtcggcgggcacgttgcccccaacctgggcgtcgttgagcttacggtcgcgctccatcgcgtgtttaactcccccaccgacaaaattgtctttgacgtgtcacaccagacctatgcccacaaggcgctgactgggcgcgcgtacacttatatcgacccggcacgctacggcgaggtctctggctttgccaatcccgacgagtccgagcacgacctgttcgccatgggccatacctccacgtcggtgagcctgggctgcggccttgcccacgcgcgcgacctggcgggcgacagctacaacgtcattaccatcattggcgacggttcgctttcgggcggtctggcgtttgagggctttaacaatgccgccgatctcgacagcaacctgatcatcatcgtcaatgacaatgaccagtccattgccgagaaccatggcggcctgtatcgcaatctggccgagctgcgcgccagcaacggcacctgtgagcgcaacgttttccgcgcgatggggctcgactaccgctatctggacgccggtaacgatgtgttggccctagtcgacgtgctgcaggaactgggcgatatcgatcatcccatcgtgctgcacgtctccaccgcgaagggcaagggctttgagccggcccagagcgaccccgagcgctggcatcatgtaggtccgtttgacatggcgactgggcgcaagctctgcccgggccatccgagcgagcctgcgccgcgcacctatgccgacattacgggcgaggccctgagcgctgccatagagagcgatccgcaggttgtgggcatcacggccgcaacgccctacatcatgggctttacgcccgagcttcgcgccgcggcaggcaagcagtttgttgacgtgggcattgccgaggagcacgccgtgacctttgccaccgcgcttgcgcgctcgggcgccaagccagtctttggtgtgtacggcacgtttttgcagcgcgcctacgacgagctgtggcacgacctgtgcctcaacgatgccccggcgacgatcctagtgtttggcgcatcaatctttggcactacgtccgagacgcacctttcgttctttgatatttccatgctgggcggtcttcccaacatgcactacttggcaccagcctgcatggaggaatatctgtccatgctgagctggtcgctcgaccaccgcgagcatcctgtggcgattcgcgtgcccggcattggcctggtaagccgccccgacttggcgcctgccgaggacgccgattacggtgtcgcgcgctacaacgtggtgcgccaaggccgcgacgtggccgtgctcgcgctcggcgatttctttgagctgggcgagcgtgtggcaaaccgcttggcagccgaatacggtatcgaggccacgctcgtcaaccctcgctttgcaaccgagcttgaccgcgagttcctcgacagccttgccgccaagcatcgcgttgtcgtcaccctcgaggacggcatcttggacggcggttggggcgaacgcgtcgcgtgctacttggcctgcacgcccgtgcgcacgcgcaccttcggcatcgccaagggcttccccgaccgctacgaccccaacgagctgctcgctcagaacggcatgacggtcgagaacatggccgccgaggccgtaaggctactcaacgagtaaaaaacctccgcaagggaagcacccatgcggaggtttttattttcgcgacgcgattatctcaatctgtaacatctatggcccgaattcccgtctaactgttacagatctagaaaagacgtcttagtccctgacctttgtctcaatctgtaacagatagagaccttctggccgtccagatgttacagattgagacattcgaattcccctaaagagaaaatctcgatctgtaacaggtagaacccatttcctcgtctaactgttacagattgagacaaagcagcgagacaggccaccacatctgcaagaaccaccacaaaggtgcctgtccctttttggtaggaagaattacccataaggtaagtatgtttctgagttatttcgtgttgacccatttgagcgggatagggtataactctactcaaccgctagggattttattgagaaaggtgttctaccatgagcaaaaacctctcccagcaggtcgttctcgaccgccgcggcttcgttgccgccaccttcgcaaccgtcgccggccttggtcttgccggctgctccgacaccagcgccgaggccgacaagggttccgccgccggctcctccaagagctccgaagataccgaggcttccaccatactcgatgccaaggcattcgacaaactcgtcgacaacggccccaaggccgatgacgacgccatcgccgccagcacctgggccacggccgtcaaggacgccggtgtctttaagatcggtggcgttcagacctccacacttttctccctcctcaacgagaaagacggtcagacccgcggcttcgacgccggtatcgcacagctcctgtccaactacattctgggcgagaacaaggtcgagatcacccaggtgacctcggacacgcgcgagtccgtcctgcagaacggccaggtcgacgctgtctttgccacctacaccatcactgacgagcgcaagaagctcgtctccttcgccggtccctactactacacccagcaggctatcctggtgctcgccgacaacgacgacatcaagagcgtcgacgaccttgccgacaagaacgtcgccgtccagtccggctccaacggccccgccatcctggaggagttcgctcccaaggccagccagcaggagttcaagaccgacgaggaggcccgtcaggcacttcagcagggtcgcgttgacgcctatgtcatcgataacaacatgcagcagagcgccctggtccgcgaacccggtaagtacaagatcgccggcaagcccttcggcagcaaagagccctacggtatcggcctgccgctcgattccgacggcgtcgcctttgtcaacgacttccttaagaagatcgaggacgacggcacctggaccgagctgtggcagatctgcatcggcgaccgtacgggcgacaccaatgttcccgagctgcccgagatcggcgcctaggcagcgaacctggtaacggccgctacgaaaccatacggaaacgcgcgatgtgctttattgcgctaaactgtttcctcactgagttgtcggggcttccgtacacacgggagcccctttccttaccggcgggaggtccgcatgagtctctccgagctctggtcgctctatggccagaactatatcgacgcgctgctagcaacctggggcatgacgcttgagtcgtttgccatcgccatggtgctggccgtcgccgtcaccgtgatgcgcgtgtcgccgctcaagccgctgcgcgtctttggcgacctgtatgtccaggtcttccgtaacatccccggcatcgcgctgctcattatcgtcgtctatgcgctgccgccgctcaaggtcgtcctgccctaccgcacctgcgtcatcgtcgccacggtgctcttgggttctgcctttggctccgagaactttatgagcggcatcaacaccgtgggcgtgggccaggtcgaggctgcccgctcgctcggcatgaacttcaaccgcatcctcgccaagatcgtgattccgcaggcgctgcgctcgagtgtgctgcccatgaccaacctctttatcgccgtcatgctcaccaccgccctgggtagccaggtgccgttgcagccgcaggaactcaccggcgtggtaagctacatcaacacgcgctcgctcggtggcgtcgccgcgttctttatctcggccctcggctacctgggcacggcttttgtggtgagccacattggcaactacatcgataagaaggtgagaatcctccgatgagcaagcactcctcccctgcgctcaccatgcgcgatgcgctctacgaggctcccggccccaagatgcgcgccaagattcgtatcggcactgccatctcgctcgttgccgttgcggcactcgtcgtcctcgtgctgcagcgtttttacgtgaccggtcagctctcggtccactactggtacttctttacgcacctcaccacctggaagtttttgctcgccggctttgagggcaccgtcaaggtcgcgctcaccgcaggcgccatcgctctggtgctgggtctcgccctcatgctcggccgcacgagcgacatcaagccgctacagctggtctgccgcgtgctcaccgacttcttccgcggcgtgccgagcctgctgttcatctatttcttctttttggtgctaccccagtacaagatcgcgctgccgtcgttctggatgctcacgctgcccgtcgcactcgccgcggccggcgtgctggccgagatcttccgcgccggcgtcaatgccgtgccgcgcggtcaggtcgaggcggctcaggcgctcggcctctccaaggctaaaatcacctttaaaatcgtgctgccccaggcgattcggtttatcatcccatcgttgatttcgcagcttgtggtcgtggttaaggacaccaccgtcgcctacgtggtgagctaccccgacctgatgcagaacgcccgcgtgcttatcaccaactacgatgcgcttgtatcggtctacctggtgattgcgatcatctacatcctcatcaacgtcgccatcaacaaggccgccatctatgtttcgcacaagaccggcgcaaccatcattcgctaagtacccacgtttttaaggcataaggagccgagcatcatggcacagagcactacttctaccgacaagcagccgctgatcgagctcaagcacgtcgacaaacactatggtgacctgcacgtcctcaacgacatcaacctgtcggtcgaccgcggcgaggtcgtcgtcgtgatcggcccctcgggctcgggcaagtcgaccatgtgccgcaccatcaaccgcctggagaccatcgactcaggcgagatcctcatcgaaggccagcccctgccgcaggaaggcaaggaccttgcccgcatgcgcgccgagctgggcatggtgtttcagcagttcaacctgttcgcgcacatgaccgtgctgcagaacgtcatgctgggtccggtcgacgtgctgggcgtgcccaaggacgaggcgcgcgagcgcgccatggacctcctgagccgcgtgggcgtggccgagcaggccgacaaagtgcccgcacagctctcgggcggccagcagcagcgcgtggccatcgcccgctcgcttgccatgcagcccaaggccatgctttttgacgagcccacgagtgcccttgaccccgagatgatcaacgaggtgctcgaggtcatggttcgcctggcccagcagggcatgacaatgatcgtcatcacgcacgagatgaactttgcccgccgcgtggccgaccgcgtcgtgtttatggccgatggccaaatcgtggagaccggcacgcccgacgagttcttcgaccatccccagaccaagcgcgcccaggacttcctcaattccatcaagggccactaacccagtaaccacgcccgcccgccatgtcaatccgaattcgaaagccacccctatgatcggaacccgcacctcatcctcatacaccccgcacgtcgacgtcgcccccgccgaccgcccactgatcctcgtcgcgccgcgctgggaagaggcgaagccgtttttaagcgagacgctctcccccaacgaggaaatcgcaagtgtctttgtcgatgccatccttgccgccggcggcctgccgctgcagatgtccatcaccgaggacattgaggtcatccgccattacgtcgatatcgccgacggtatcgctattcccggcggcccggatgtcaaccccaaacgctggggcgatgatcgaccctacgaccccacgctgtgctgcgagatccgcgatagctttgagtttaagctggtcggcgaggtgctccgcgccaagaagccgctctttaccacctgccgtggcacgcagttgttaaacgtcgccaccggcggcaccctgtgcatggatgtgccaagtctgggcgcgcgcgagggtcgcacgcagtggcgccacacccacgtgctcaacgaccccgtgcaccctgtcgaggtcgtaccgggctcgctgctggagcgcgcactcggcgggcacaagctcatccagaccaactcggcgcaccactgctgcgtcgaccgtctgggcaagcacacgcgtctggtcgcccaggcaaccgacggcgtgcccgagtgcatcgaggtcgagggccagcccttctgcctgggcgtgcaatggcatcccgagtacacctggcagacactcgagaccgactttaacctgtggaagtcgtttgtcgaggcggcggcaaaggttaagcaggcccgctagctcgcgaatcacacaggcttaaaccttccatgccagggggggggcggacaccagccacggtgcccgccccccctgtatttggtatgctcggtatgattatccctcacaaacaatcaaagaaatctcgaccgcaatcggtcgacggtaaagcagatggctaaaacgcttgctacgtttattagacagtcaattaaaatcgaaacgcattggccattccccaacggggtcacaccgcaagtccacatgagcatcgaggacggaagcggaagcatggaatcggctccgagctgtatgtagatcgctacgacgttgacaaccaacaacatgccaatgggaccgaagccagacccaaaataagaaacaacgatcacgctagagaccgtgtatgccaggcagacgacactggtcagaagaagtcgatagcaaaatatatctaggttagaatactgttgtgcatccgaaacgatcgcgcagttaagacggtacaaaacgacgctcgacaggacaaaggcgcccaaaagggcgaaagaagacagcatcgctcgcgcaacagtagcgcatacccgcttccctccccgagcctccgacaacccccacggttcctcaacaaagcccgaactgacaaagcacggaacaatgcaagccgcgatgaacggaaagaacaatgcgtgagccaacggggccacgttgaacaacagaccgcgaaaaacctctgcattatcaaatagaaggacatcctctgccgatagccgaagcgtcgggtctgggaaaaagcccaagaaactgttctcacggaggctacagaaccacatcgggaaagaattaagctgcaataccaccatgcacgcataaattgccaggattaaggcgtatgcccatttgctcgcatgcttcaattctgaatggaggaaccctttaatctgacgagccattgagtacacctccgacatgacaggtcacgagagtgtaaatcaataccgatagacagccggctgccgcgccataccccagaagcgtgagctggcccatatcgctatacccaagggcacatccgactccaaggtacggccccggaagaaagaagatccatcgcaaggatggtgtgggcgactgaaggtaagctccgtagagcgtcaggctcatgacaaaccctattattaccgcagccccgctaaatacggcgctgcttgtaatccggtagatggtcaccgtctccaacgcaaccgatatcaccaatacggcgttgactaacatcgcaggcaaaaatgcagccagcatgccgtgcgtgcagttttgtcccccacgtattatggctattgcaagcagaagaaggcaaagcacgctatatgctgcgacaatcattaaagcagacgaaagcacgtgtgccagagccccattaaagcgggcgaggcctcttgccgaagaaattcggtatccctctttatagccatgctcctgtaaaagcaccagacaaatgatgagtgggacgaacagggatgtaccgacaaaagcactgcgcgcaagggactcgtcaggcgcagaagggtcgattacattccagatgaaaccaatatcctccccacaaacgccattgccaaaggctagcaacgttgctccgttatttaggatgacgccaaagagaagaccgaacgtcaacataagcgcaagaccaaactgcgccgggaacattctgtgcaaacgcatcaaatctgcccttatgggacgaatcgcctgcttcatagcgagaccgccttcatcaagcgcctgtaatactcttttagggacgacgcctcatcccttatgacgtccatcgattcctttttcagcagttcaccgtcatgaataaacaggcagcttgttgcaaccgatgccaactcatccaaatcatgactagagatgagcatggtcttaccctgctctcgattcaatcgaccgataagggcccatatattctcgatgcccagcgggtccaacccatttgccggctcatcaaaaataagcaagtcggtgtcacccaacaaagccgtagctatatccagccgccgtttcattcccagagaaaaactgctcacgctctttttctcttcgacgtccagtccaaccagactcaaaacgcgaggaacctcacggctctcatcgagcccccattccgcacatcggatttgaagattctcagccgcactgagggactggtatgctccgctggaatctggcacatagccaacatgcgctcgcatcaggctcagctctctttttgacttgcctccaaagagctccacgctccccgaagatggctcacagaggcccaatacgattttaatgagcgtgcttttgcctgccccgttctcaccaacaagggcgcagagctcagactgatgcacctcgaaggaaacgtcacgcaaaacgcgccgtttcctatagcgcttcgacacctttgatagccttaccgctgatgcactcatatcgttccccctttctcttatcgaatttacttctagttattgtttgtcgataacttgaatttgtcaagataatttcaaaagaaaggacctgcgttaaacacgggtcccatcgcactgatatttcgtttttagttgttcgctttatgctactcgtcgctcaaatctacagcaaagactgatgtcggaagcgacgcctcgttgcctccgccgtcccgcatctgcctcacgacattttttgcgcgctcgacaataagctcctcgagctcctcctcgctcacgcgctgaataatatctcccggctgacaatcaagttcatcacagatatcgagaagcgtcttgaggcgaatggctttaatttttccgtttcttagctttgaaatattagccggagtatgccccgtcgcccgaatcagatcggcgctggtctttccggtcttaagcagctgtgtctcgagctcgatgatgagatagctcatgtttcctccctacacaagctcatcagactgctcttggagcagcgaggcataactccagattgccgagataaataaacagacgaccgcgccgataaacgaccccgcatccaaggtaacaccttggcaaatcgcaacaacgaaggaatgaggcacgatgtaaagctccagtccgccaatggtgagatcgaccgattcataggcaccaacaagcgaaaccgcggcgttaacagcaaaggcaagtgcaagaacacggataagccgcacatgcgccttggtaaagggcgatacgccccgcgagatgttacggccaattccgcacataacgacaagcgaaatacctgcgacaagcgccatgcacagtccgcttgggatgacgacgcgcccgccgtcgagaagcgtcacgacaccgaaagaatcgacagaagcaacgtttgcaaccgcataccagatcacgtaaacaaccaacgcggcaaaagcgacgagcatccctgcaaaaacggctgccatgcaaaaaccaagcttcctgatattttcgcccgccttgaccatacgctgaacgctgttggacatacactcaccctcatcgactctatcgttattcgaacagtttatcgaacaacgatatggattgcatgcggaaagccccgccagtgcgcataggccatttactaatcagaaggggtgagagtggatttttggacacgtatcgaacgagagtggataatctcccactttgaggccgccaccgggcctaaaacgggagagtatccactctcatagtcatcaaagctcgcaagctcttattcggccgcctcgcgcagggccgacatcgtagccgcatattgctgctgtaacgcatgcattccctcgcgagcgccgtcaacagcatcggcgccgcgcagcgcttcggtcaccacgaccgctggctcgtacagattatcgaatcccaggttctggctcacgcccttgagcgtgtgcgctgccataaacgcttcctcggcgtctcctgccgccatggcagcttccaacttgtccatgctctcgtcatctaaaaacttgagggcaaagcgggcaagcatttccccgcccatcagccgagcacacgcgtcatcataattagcgccgatcttctcatacgcctcacgcatggaaatcatggattaaaaactcctttggtcaaactaaatcgtgggaaacgcgacgacgtcggcagggcgtgccaacgtctcggcaatttggtcttgcacctcgagcagacaatcgagcagcagcgggttaaaggtgccgcacttaccgtccaggatcatctggatcgcctcctcgtgcgggatagcgtccttgtacacgcgcacgctcgtcagtgcatcgtacacgtcagccaccgagaccacctgcgcggcgatggggatatcgtcgcccttaaggccatcgggataacccttgccgtcccagcgctcgtggtgccaacgcgcaatctggtacgcatattccataagcgcattgccggcgtgatggctacccagctcacgcagcatgtcggcgccgatcgtggtatgtgtcttcataatctcgaactcctcgggcgtaaggcgtccgggtttgttgagaatcgcatcgtcaatcgacatcttgccgatatcgtgcagcgccgaagccagggcaatcgtggagcgctcctcattgtcgagggagatggtgccactacgctggaccagacagccaagcagcagctcggtcagcttctcgatgttcgtaacgtgcctgccgctctcgccgttacgaagctccatgacgccggccatgatgtcgatgagcatgcgactgttcttgacacgctcgttgtactgctgggacagcaggttcgtcaggcggcgctgtttggcgtataggcggatggtgttgcttacgcggcggcgcacgacacgggagtcaaacgggcggttgatatagtccgaggcgcccagctcgtacgagcgcagaaccatatcatcggaatcttcgctcgaaatcatgatgacaggcagattgtcgatacccgatcggcgcgacagatcggccagtacctcaaagccgctcgcgcccggcatgacaatgtccagcagcacgagcgacaactcatcgccataacggtcgaccatatcgagcgccgtacgaccgttatcggcctcgaggatgcaatactcgtccttgagcatctcgttgagaatggctcggttcatctcggagtcatcgacaataagcaccgaaggtttttcgctttggaaggcctcgatggaatcggcatcggtcacgaccgtaccggcttttgccttagcgcggctcagtaactggacagcacggccaacgccctcatcgaccgtctcgccatgaatgcgaacgccaccaacacatgccgtcaagctcacgtactcatggcccggaataatcgtggaatggacggcatcggatacctgacgcagacgacgggcaaagtcatcggagggaatattgggcatgacgaccacaaacttgtcgcagccatagcgcacaagttcgtcagtcgaacgaataccgctgcgtatggctgttgccacagcaccgagcgcaaggtcgccggcatggcggccacatgtatcgttgaagaccctaaaatcatcaaggtcgatcaccgccacgccagccttcatgcgggcgctacgaagcttttcttcgtaatatcggcgattgcgcacattcgtcagcacgtcggtgtagacaaggtcctcttctgcagcctcttgcccatcgatcggacgcaccatcagcaagacatgaggctcgccctcgacctttagagggcgcagacgggcgcggtactcaacaccatcgttgagcagttgctccgacacctcatcggaatctgtcaaggcctcaagactcgactgacgcagacaagggcagcgatcgccggcgagcaggcagttaggctcgctcttaatctgatcggccgacagcaaacgtaccacggggtaggtccttgcgacacgggcgacctcggcggcagcctcctcgtcggttagattgaccttgtgattattgagcatacggggccctttcgatagtttcgcatggagcggtgggttccaaatgttacaagggtaacaccttgtcgatgcaggtaggcacgtgaatgctgttacatttttatgagttggcagacggcgcgattgaagccgcaaacgtaaggttttgagcgcatttgttaacacggccgaaacgtttgcggatgaagcctgttttgtttttttgcagctgctagaaccccaggatgccacggacagtctgggcagccgctgccgggcgatcgcgcaggccgttgtgcgcgccgggaaccattacgagggggcaatccaaaagctcagccgccatcctcgttcccgcctcgcggggcgtaccaatcgagagctcgcccaaaagcacggaggccaccgttttcgacgcgcgaacgctatcccaatcgggaacgcaggtcatagtaatcccgtattcgttcgccatgaaactgcggccgttgcgcagggcatgcttggcttccgccacggtcaacttgggggcctcagggtccgaatcgccgatggcgcccaggaaggcccgtaatgccctggagacctttcctgcggcgatcatctcgagcaaaaccggggccgcgcccagaccggcaccctcatccgtcacggcgggttcatgcagaatcgcacgcgagattatggcggggtttgcacggagaagctccagggccaccagcgtaccggcactgtgcgcgagcacgtttaccggagcgccaatatgctcgataacagcttgcaggtcggcggcttgggcggcgaggtcgtagcgtccgtctgcagcgtcgccactctcgccgcaaccgcggcggtcgtaggcaatgacgcgatagtcgcaggcgagctcgcgggcgataccgtcaaaaaagacaccgtcgacgcaggcgccgtgaacgcacaccaaggcgggtgcatcggacgatacacccgggccggcatactcgcggcaggcgatcgtggtgcccgcattctcgaccgtaaaatccatgttgtgccccatcgtcttgcgttttgttaacagattaactgtacccgacccgatacctttcatgacgcggcatcgaaggcagagttaaaaaacgaaacctgcaaagcacaagcccggaccatacgttggagccgatgctatgcttaaggttaattgtcttgaggagcttttacctatgtctacgtttctaaatgccagccccatctttgggcccgttcgcagccgtcgcctgggcctttcgctcggtgtcaacatgatgccggcgagcggcaagatctgcacgttcgactgcatctactgcgagaacggtctcaatgccgagcgcccctgtcacgaatcgtataacacggctgccgtggtgctcgatgcactcgaggccaaattgcgcgagatggcagtcgaaggtgagctgcccgatgtaatcacgtttgccggcaacggcgagcccaccgccgcaccggagtttccgcaggccatcgccggcgctgtcgcgctgcgcgacgagtttgccccaaactccaagatcgccgtgctctccaacggcacgcgcgccgaccgccccgaggtgcacgacgcgctcatgatggtcgacgacaatatcctcaagctcgataccgtcgacccggcgtttatccagctgctcgaccagcctgttggcccctacgacgtcgagcaccagattgagacgttcgtaagctttgacggtcacgttattatccagacaatctttttgaccggcgagtatcagggcaagctcatcgacaacaccggcgaggagtacgtcggcccttggctcgcggcgctcgagcgcattcgcccgcaggaggcgaccatctacacggtggcgcgcgaaacgccagtcgccggccttaccaaagcagcacccgaggtgctcgacgcgatcgccgagcgcgtgcgcgccctcggcatcccctgccaggtgagctactagcccacaaccgcccagggtagtctttttgggacggggctttttagctgccccttatcccatgcagggtcagccaaaagagccccatcccaaatgagctggtctgcgggtgggctatactagctgcggatgaaaggaagttagccatgtatgacaaaggacccgtacccggccgcaacgacgcttgctggtgcggcagcggcaagaaatacaagaaatgccacagcgctttcgacgagcgcctcgagcgcctgtgggaggagggctgggaggttctgcctcgcacgctctacaagactcccgccgatatcgagggcatcaagcgctcggcagccatcaacgtgggcgtgctcgattatgtgggcgagcatatcgccgcaggcatgaccaccaaccagatcgaccagatgatctacgactacaccgtcgagcacggtggcacgccggccgacctcaactacgagggctatcccaagagcgtgtgcacctcgatcaacgacgtggtctgccacggtatcccctgcgatacggacgtgctgcacaagggcgacatcatcaacgtggactgctccacgatcctagacggctactttagcgactcgagccgtatgttctgcatcggcgaggtctcggccgagcgccagcgcctggtcgatgtcacccgcgccagcgtggaggcgggtctggcggccgtcaagccatggctgccgctctccgtcatggccgaggccgtgcaaaagacggtcgaggacgccggttttagcgtggtgcgcgagtacggcggacacggcatcggtaaggagttccacgaggacccgtttgtgggctttaccaccgaggcgcccgatgtggacaccatcatggctccgggcatggtctttaccatcgagcccatggtcaacgccggagcgcccgacatcaagatcagcaagggcgacggctggtgcgtgcgcaccaaggacggcagcgattcggcccagtgcgaggtacagctcgtggtgaccgaggacggctacgagctgctgagctggtagccgtggatgcgccgggcttcacgatggatatgttaaccatcgcgaagcccggcgtttttatagcgttttgcctgataaaacctgccaaaataaacctgtcccttttttggcaggttgagcggagaggactgcctgtgaacatcctggttttgctgcccgtcaacgaccgtcatcgcgcaattcttgagtcgagcgctccgggcgaggactttatctacacgagcgccgacgccgccgcgcgcaagcaggtcgccgatgccgacgtgatcctgggcaacatcgaccctgacatgctcacggcatgcgagcatctccagctgttgcaattgcagaccgccggctatgacgactaccttgccgccggcaccgtgccagccgacgccaaactgtcttgctcggtgggcgcctacggccaggccgtgagcgagcacatgtttgccatggtcctttccatgatgaagcgcctgcccggctatcacgacttgcagcgcgagcatcgctgggaggatttggggccggttacctcgctcaaaaatgccaacgtgctggtgctgggcgcgggcgatatcggcggccactttgccacgctctgccgcagcatgggcgcacacgtccgcggcatcaagcgccatccgctcgtctatcccattgtgtttgagtacatggacggcatggacgccctccccgagcgcctggccgaggctgacatcgtcgcatcctttatgcccagcacacccgagacccgcggcctggcgaacgccgagttcttcaccgcgatgaaaccgggcgccttctttgccaacggcggccgcggcgatcttgtggtcgccgacgacttggttgcggcactcgagtccgggcaccttgccggtgctgcggtcgacgtcaccgaccccgagccgctgcctgagacaagcccactgtgggatgcgcccaacatgctcatcacgccgcatgtctcgggctggttccacttggaggctacgctcaacaatgtggtcgacattgccgcagagaatctgcgtcacctgcaagccggcgaaactttacgttgttggatcgagcattagggttccgccgttctaacgaacggcggaccactcgacgctgcgagcccgccgtttggccaatctgccgttcaatttcaaaggcgcgaccagaaggtcagcgccttttcatttcacggcaccttggcgcaaacggcgggctctcgctgacttttgttcggccagtgaggtctagagctatttgagcgttgctaagtaattttttgcgtcttctacactcattgctgcgacgggtgcgtgtaaagagagcttgacatcgttggtgaccaggagatctgcctttgcgcgtatcgctgccgcaatgattaaatcgtcttcgtaatcgctatggagctcacgctgcctgctcgccatccatatatcgctcaggtcacagggcactggcgtggcaagctgcgacagcacgctaagacaatcccatgcaagcgaagtcgctaccgtagcggcatactgggaaagcgaaccatgctcgcgccgataccatgccttatgttcgcttgaaatcaaataaaacaggtctttggacgatgtcgccgcgtacagcaaatcaacctgcgccgtgcatgcatcgcgtaaaaactcaatcgccaccgaacgaccacgtcgtgagggaatgaagtaatcgagccacacgttggtgtcaaccaagatgcgctctggagtctcactcatagagccagctcatctcctcgccatagcgatccgcataggcattccgtttgagctcttcgtcgtccgatggctgagccttgaccatatcgattcccgactcacagcaagcggcagcgaacagcttcgacccctgatccatgagctcgagcttacgtttggcggccttttcgcgctcgcgctgttccgcccgggcacgactgggcagcaggatatcctcgagcgcaccggggcgatcggccagcgacgctgcaagctgccagagcgctcgcaccgcttggctcggcgtcataccggccttggagagagcggcgtccccactccttttaagatcggcatcgagacgtacgttgatctgagcggctgttgtggtcataacccctccttaatacttcaaaactatcataaaactctatggtagatacgtaaagcatgtatagcatttataagcattagccgtactctgtacacaaaaagccgccgaggcacactgcacctcggcggctacgcatcaccaatccagttcggtttcaccctttgcattcgcccagataaaacctgccaaaattaacatccctttttggcaggttttagagctccacactttcggcgccgttgatggttaggttgcgctcgtagaaggcggtgagggcgcggatagcgtacatcacgtcgcgcacgccgccggtctcgtagctcgagtgcatggcaagctgcggcaggcccacgtccacggcatgcatgctcgcctgcatattggacagattgcccagggtagaaccgccggccatatcgcttttgttggcaaaggcctgcgtgggcacgtcggcgtcatcgcaaatggcctggaacaccgcgcggctaaaggcgtcggtgcagtagtgctggttggcggcctccttgatgacgatgccgccgttgagtaccacctgattgcgggcatcgcacttctcggcatggttggggtgcacggcatgtgcattgtcgcagcttacaagcatcgaggcggcaagtgcgcggtggtacgactcgtcgtcaaagcccaacgatccgttgatgcggcgcagcgcgtcggccaagaacgtcgacatggcgccctgcttggtctcggagccaacctcctcattatcaaagcagcagaagaccgaaacgtcgtgcgcgttctcggcacccaaaaatgcctgcagtgaggtgtaggcgcaggccaggtcgtcgagcttgggcgtcgagatgaactcgtcggcccagccccaaatgcgcgcatcctgacgattgaccaggaacagatcgcggcccaggatctgctcgggctcaacgtccagttcgtcagcgatcagggcgtcaaaatctccctgcttaaggtcaccggcgctgatgagcgggcacagatcaatggctcggttgggagcaaagtcctcgttaacgccgcggttcatgtggatggcaaggctcgggataatagcgacctcgcgctcggtggcaagcaggcggctctcaatacggtcgccctcgcgcaccagcacgcgtccggccagcgcgagcggacgatcaaaccaggtgtagtcgatcataccgccgtaagcctcggtgttcaggcgcagcgtttcgcccgcgccgtcaagctcgggcacggccttgaccttaaacgtcggcgaatcgctgtgcgacgccgtgagctgaaaatgatagtcaccggcaacgccgtcctcgccccacgtcgcggccaggtcctcgcccaccttaaaggcaacaacgctcgaggtgttgcgctgcgtgtaatagcgcccgcccggctcgatatcccacgccgcattctcgggcaggtaggtaaagcccgcctcgtcgagttcggccataatggtcgctgccgtatggaacatgctggggcacgcctcgataaagtcgataaggtcgttggcggcctcgatatcgtcggccgtcacatgcgcgcgctcgggcgtttcctgatccgtcatgctctcccctttcgctgggctgatggtcccctccagcatacccccaactgaccggcctgtccgacaaatcgaatgccaaacaaagccagacgctccaaacagaaaagtcgatgctcttgcgttacaggcaaacgacaattgaattgacaagttaaccagtggtaatttctggtatttttgtttactgcctttaactttttgcggtaagcaacatgagttctatggcagttacctatcatgtgcgacgcacatgaccactgtccatccgggtgcaacaggaaaggagagcagcacccaacgaccgatcgatagaaaagaggttctatgcacaacgataacgctgtgctgcgcaagctcaacactgtgggcagcaatgcctgccgaggcgcactcatcgccgcgatgaccgtctcgatgatgcctaccagcgcttttgccgcagcagcaacaacggagaccggctccgaagctaccaacaacgcgccgatctccgccaccagtgaggaaacgaagtccctcagctccgagtatagcctgagtgccgtctctgacgacgccgcatcctcctcgaccagctacgatttgactaaaatcgcagatggtacgtatgagggcacggccacggccgactcgaaggacccgctcaataaagctggcgacgaatggaacgcagctgatggaaagtatgacgtcaacgtcagcgtaaccgtcaagtctggcaaaattgccaaggtcgaagtcgccgactacagtagtttgggcgacgatgactgggaccgcatggacaaggccgttaacggttttagcaaaaaaggcacgtcctataagggcatcgtcgagcaaatcgagactgccggcaacactacctcaatcgatgctgtttcgaccgccacgatctcgtccaacgccatcaaggctgccgtcgataatgccctgcaagctgcctatgacgagcagaatccgtcgacccctgcgaccgacgagtacacctacggttacgctggcctgacgtgggccgagtattgggctggtgaaaacgtgcaggcggcagggtcctccgcttcgtcgagcgagctcgattcccgcaacgaggccgacaagggcgcttttgacgtggtgacccgtgcaacctttaaccacggcctgcatcgcggcagctatcagtgcaccgacgtgatcaaaactgccgagggcgtaaaaatttacccttcgtattatcccgacagcaagtcctttgttgatgtcgatggcaacgtcttttctattgacagcaaggctaagaccgtgacggcggccgacggcacggtgtacaccatgacgggtcacgaggtcacgggactcaagtacgttcccgtcaaaatcaagaccagcgacctggaggcttttaaggcgagtcacagctttgtcgccaatggcgagacgctcgccggcggctacggcgaaaataacctccaggcctactccggcctggttgcgtccgtcgacgccgacaccaacggccttaagaccgtgaccaacaacaacggaaccttcagcttctcggccgccgccaccggcaccgactcgggcatcaagggtcaggagctcaagaccgccacgggtattgaacccacggttaaggacgcgagcggctcctacggcgagttcctgcgcgtagacctcaacggcacctatggcgacctgggcgccaatatgcaaagcgtcacctggacctattacggcgacgacgcgacctgcaccaacgcccttgccacctacggcaccaagttcgcggccgacaactggatgcacaagtccatgggcattcagctgggcctcactaaatccgagcgctgccagctgcccaagggcaccaacggcaccggctactggaagcttaccgtccatgccttgggctacaacgattacacctacaccttccaggcgaccgatgacaacatcgtgggcgccaaggagccggtgaccgacgccaccaaggcccagctgcaggagctctacgataaggcgacgtccctcgataagtccaagtacaccgaggactcctggaccgcctcgtccatcgaggccgaaactgtcgagaccaaggacctgctcgccaagaaaaacctgggcgaagccgaggccgccgagcagatcaaacacctgcagggcgcgctcgacgcgctcgtgagcctgtatccccaggccggcgactacgtgctcatgaacatcccctacagcgatttctatgcctccgagagcaataacaagggcactgatgtcgtaacttcggcaactaagcagaagacgcgttcgacgctcgccgccggcagctatcatgtcaacgccgacggatccgatatttcgggcgtgacgtttgccgtcaaggtaggtgaaggcgatatcgactggtccaagttcacccgcgtgaccgacgacagcttggtaaccgtcaccacctcgatcaaaggcaaggagtccacgacgacctacacgggcaaggacgccctgtttgagtctgcgaactactcttactacgtgctgcctgccggcgaggttccgaccaattacaaggagctcaccgccgattccaagggcaacctaagctttggcgctgtcaagggcaaggaagccaccgaacttgcaaacgtcaccgccgactttaagacctccagcaagtacggcgactacgagatcgactttaagaacctgcgcgagcagatggtcgacgccgacggcaaccaggcgaccgtatacggtgccgtggtcaatgccgccgatgcggacggcaccaccgagggctatggcatgcgcaccgtcgagaacatctggaagggcaaggagattgcctggagctgcggcctggtcaacgagtctcacggcagcccgttgagctcgcggcactacaagtccatgatgggcaagaccatcaagagtgtgacgttctacacctctacgggcacctacaccgttgccatgaaccagtacgtccccgtcaaggcctccaagtccgagatcgacgtcgaggcgaacgccaaggccgatgccgagaccgccgaagtcaaggcgacgctgccggcagacttcaaggtcgagtacaagctcgacgacgccgatgtcacggtcgacaacggcacgttctccatcaaggacctcaagcccggcaagcacaccctcgtggcgcgcgacgcctcgggcaagtatgccgatgtgacgagcgagttcaccgtcacgaccgacaagaccgtcgccaagtttgacgagggcacctcgaagatcaccgccgccaacgagggcgacgatgtcgagaactttatcggcaacatcaccacggtcaacgtcaacggcaccgactacgccgcttccggccgcggttccgtcaaaatcatcaacgccgacggctccatcaacctcgacgccgtcgccggcggtcagcagagcgccaagcctaaggccacaggccagcagcagggcaccaaggtgtttgccaactacggcacctacaccatcaaggtgacctccaccggctacaacaccccgctcgagttcacctttacccacaaggccgaccgcaccgacctcgataaggccatcgatgcagccgaaaagctcgacaagagcgccttcaccgccgtctcctggaacgccatgagcgacgccctcagcgccgccaagaccgtccaggccaacgatgccgccaccgatgacgccatcgcccaggccctgaacgcgctcaacagcgccgtggccaacctcgccgccaaggcgactgatgaggccaagtccgcgctcgccgacctgatcgagagcgccggcaccgtcaagaacgacggctacaccgacgcctcctggaacgacttccagacagcactcgatgaggctaagcaggttgccgcctctgaggacccctccgccagcgaggtggcttctgccgttgacaagctgaaggccacccaggacgcacttaccaagaagggcacggagggaaagcccgccggtggctccacctctacgacgaccacgacgacgaccaccgataccaagaaggccaatgcatccaagaaggacgcaagcggcctccccggcaccggtgatacccagatcgccacggtcggcatcttcgccggtatcggcgccgccattgcggccgccggcgtcgccatccgccgccgcatgcagcactagcgcctaaaacgcgcgccacgcgctcgcaacgcaagcgcccgcagccccaaccagggctgcgggccttttctcatactcgaccacgggagaccacccacaaatggacaactaccaacccaagcactcaaaagccaaggcgctcggccacggcctcgccacggcaggcttcatcgtgccctcgatcgccgtgggcgcaaccgtggccctcgtggtgtcccagtacaccccgctcgtggccaagacggtcgccgccacgcccgcgcaagaggccgcaggcgccgacctcaagaccgtcgacacctccaacgtccagaaggagacggcaacgccggcaaccgaatcgctcgacccctcggcctatggtatggacgccgcaaacctcaaggacggcacctatgaaggcacaggtaccggctttaggggcagtatcaccgtgcgcgtgaccatcgcgggcggcaagatcgtggcaatcgacatagtgtcgtctgcagacgacccagcctactttgggcgtgcccgggcgatcacccagtcggtgattagcgctcagtcgacgtcggtcgacactatctcgggtgccacgtattcatcaaaaggcctgctcatggccatcaaaaacgcactggtcaaggcatcgggcgggcttgccgaggctgttgcccccgcccctgcggccggcggctcctccaataagccccaccacaccatcgaccccttcacgcccgccggcggctacgcagacggcgtctacaccgactccgcctggggatacagcgaggacacgcccgtcagcgtgcgcgtgaccatcgcgaacggcaagatcgccaacatagaactcgtgaacacgggcgacacgcccgagtattggagccgcgcctggaacgcactccccgggctcgtcatgcaaaagcaaagcgtcaatgtcgacactgtgacaggagccacgtattcgagcgagggcatcctgggcgccatccagggctgccttaagcaggccgcagccggcacaaaggaccccgagcccgcgcccggccccgaccccgcgcccaacccggacccctcgcccgacacgccagacgaggtccactacgccgacggcgactttacaggctacgccctctgcaaaaacgaggaggacgacgaagccttcagcccctactacgtcaagctcaccgtcaccgttaaggacggcaaggttaccggtatccacgatatcgagggtgtaggcggcaagcctgacgagagcctctccgacgcgcttgatccctttgacgaggataacgagccctacctcgataacgccatcgacggccgcaccttccgcggtaccgtctacaccggcatccccgagcagctgctcgcgggcaccgaggctggcaagatcgacgtggtggcgcgcgccacctactccagccgcgccatcgccaacgcctacaccgacgccctcgcgcgctcggccgcggcttataagaacgcgaacgacagcaaaggcgacaaggcagacgcttctgacaagacaaacgcccccgatgagcctacggccaacccgaccgccgcaaacggggccaccgaggaggctggcgcccatgcgtaacccgtttgccctccttgggcgccacctctggcgcaaccgcaatttctatctcaaagccgtcaacgccgcggccgtcgtcgccatcgtagcgggctacagcagctgggccgcccaggcggcagaggccgacgcccgcacccaggcggaggctgtccaggccgagcgctcgcagacgcgcggcgcctacgacaccgacggcaccttcgagggcagcgcccagggctacggcggcactgtcacctgccgcgtgaccatcgagaacggatacatcgaaagcgtcgaggtcacggaccacgccggcgagacccccgcctactttgcgcaggccgagggcctcacgcagaccatctgcgatgcccagggaaccaacgtcgacaccgtctcgggtgccacgttctcgagtgccggcatcctaaacgccgtcaacgcggcgcttgagcagagcaacgccggaggtacgcagtaatggccaggactgcatccaccaagacccgcggcgcaaagcgccccgcgggaacccttgaaagcctgcgcaacggcgcaaacgtcatcgcgcaccccaagaacaagatgcaggagcgcctgcgccgacagtacctccatcgcggtgtgcgctggtgcgtacagttcggctttctcatctgcttcccggccgcctggaacgccgccttcaacggcgtcaagtacatcttcacgcagctcgggagccatgcacccatcgagctcaccggctttttatccctgcttttggccctcttggccttcacctgcgtgttcggccgtttcttctgcggctttgcctgcgccttcggtacgctcggcgatatcgtctacgcgcttgcaaccccgctgcgccggacactccgccttgagggcaagggcgcgcaccggctccccgcgggcgtgcagcacgcgctccagctcgtcaagtacgccgtcctcgtgggcatctgcgccctctgcgtgatgggtatctggccccaggtctcgggcgcgagcccctgggtcgccttcgccggcatcactgcgcgctcgctcgagggcatcgcgcccacggcctttgccgcgcttggcgcggtcatggttgggatggcctttgtcgagcgtttcttctgccagttcctctgccccttcggcgccatattctcgctgctgccggtgttgccgatctcgcttttcaaccgccgccgcgaaagctgtgcgcgcggttgcaaccgctgccaggacagctgcccggtacgcatccaccccgagcgcgccgacctgcaatcgggcgagtgcatcgcctgcgggcgctgcgccgatggctgccccatggccaacgtgacgctcgcccggctcgacggctttaagcgcgatcaagcaaccgacgatgccagcgagctcgcgcagagcaacacccgcaagcgcccgcccgcagggcccgccattcgcgggaccgaggttgcgctcacgctcgtcaaggctgccatcctcgccgcgctctgctacctgctcatgtagggcacgcgcacccgcggcccggcaccccgtcaacaccgagtcgtgcaggcgcaggctcatccgtaacgccaccgaccagaaagctcaccatgatccagaccccccacaccatcgaccgccgcacgtttatcgccctcgcaggcggggccctcgtctcttgcgccggtgcacttaccggctgctcgggcacgcagggcgactcgggctctgtaaccgcgtccaaagcgggctccgcgggctccgacagctcgcccaaggtgcagagcacgacgctctttgtcttcgacactgtcgtgaatatcagcgcccaatgcagcaaaaaggtcatggacgaggtcgccgaccgctgcacctactttgagaacaagttctcgcgcaccgtggagggctcggatatctggaacatcaacaatgcaggcggcaagcccgtggaagtcgcgcacgagaccgccgaggtcatcgaagcagccatccgctacgccgaggagtccgacgggctctttgacatcaccatcggcgccgtctcgagcctctgggattttgacaacgaggtcaagcccgcagatgaggacatccaggcggcactgccccatgtcgactatcgcaccatcacggtcgacggtaccaccgtcaccctctccgaccccgaggccaagctcgacttgggtggtatcgccaagggctacatcaccgacgacctcgtggcgctctttaagaagagcggcgtcagagatgcttccatcagcctgggcggcaacgtctacgtgatgggcaaaagctttgacggcgacgcctggaacgtgggcgtgcaagaccccaacggcgcgcaggacgacgtgctcgccacggtcaagacgcgcaaccgctcccttgtgacgagcggcctctatgagcgcggctttgagcaggacggcacgttctactaccacatcctcgaccccaaaacgggctaccccgccgccaccgacctcaagagcgcctcgattatgaccaagaaatccgtgcttggggacgcctactctaccatcctgtttttgctcggccacgaccgcgccatggagctcatcgaaagcgatgagcgctttgaagacggcgttttagtcgatatggacgatcgcgccaccaagagcgacggctcgacgttcaagatcttgcaggactaggagccatgatggtcaagcgcaaaggtgcgcgcgatgggcgcgacaacaaaagactcaacctcatcctggttttggcgatagcggccatcgcctgcgtcggcttggtcgccacgcgtctgatgggagcaaacacgaacgccgacacggccacagtcgttatccgcgatggagagcaaaacgtctacgagcttcctctgagccagaacacgaccaagagcgttacgaccgacttgggaaccaacctcatcgaaatcaaagacggccgcgtgcacgtcgaggaagcagactgtcccaaccaggactgcgtgcaccagggctggattgacgctgccggggagcaaattgtctgccttccgcacaagcttaccgtcgatatcgtcgacgcgagcgccgagaccacctacgacgtagtggggcgctaatccgtggagatggtcgatatcgaacacactcgccgcctggcgcgcgtttcgctgttgtgcgcttgcgcattggtgctgtcctatctggagaccatgattccgctgcccgtcgcggtgcccggcattaaactgggccttgccaacgtggccgtagtcgtcgcactctatacgctcgatgccaaaagcgccggtgccgttgcgctcgttaaggtctttgcatcgggctttttgtttggttcgcccatgatgctcgtctatagcctaggcggcacggtcctcgcctttatcggcatggtcgcccttgctgccgtgccgggtgttggcttggtgcccgtgagcatgcttgccgccgtgctgcacaatgtaggccagctgggcgttgccgccatggcgctgcagaccccggcagtctttatcaatctgggcgttctgggcgtcgccgcctgcgtcaccggcggcattacgggcgcggtggcagaaggtgcgctcgccggtattgagcaagccgatgacacacgtccctccgtcgattgcgctgcacttgccgccaatatcgtggcaggagagcgcatcgcctttgtcggcaccaacggcagtggcaaaagcacctgtgcactcgagcttgcggggctgctcaaagacgtgaacgggcacgctatgtgcgtgcagggcaccgtaggccttgcttttcaggatcccgataaccagatcgtcgctccagtcgtgcgagacgacatcgcctttggactcgaaaaccgcggtgtcccccgcgacgaaatgcgttcagaagtcttgcaggcactcaacgagcttggcattgtcgagcttgagcaacgcgatgtcgccacgctctcgggcggccaaaaacaacgcgtggcggcgtcgggattggttgcgctcaccccttcgctcatgatttttgacgagacgaccgccatgctcgacgagaccgcccgcgaggccgtcaatgatctcatcgatcatctttgccagcgcgatgttgccgtgatccagatcacgcagttgctcgacgaggtcgcgcgcgccgaccgagtcgccgtcttcgaggcgggcgccatcgcatacctgggtaccgtgcaagatcttgccgaccagcgcgatctgctcattcgatgcggcctggaggaactgtgtcgttaacctgctcaaacataaccgtccgctatcccgaagcagacgcctgtaccctatctcgtgtttcgttggaaattaggcccggcagcgtgatcggtatcgcaggcacctctggctccggcaagtcaacgctgctgcgtgcccttgccggagcgcttgccgtgcaggcggggtctgtcgtggcggacggcaccgcgcttggcacacaccccacggcggatgaacttcgtacgtaccgcaaaaccgtggcactcgtgcagcaacgccccgagcagcagttttttgccgccacggtctttgacgaggtggcgtttggcccccgcaatcttggactggacgaagccgaggtcaagcgacgcgttggcacatcgctcgccagcgtcgggtttgatctcgccgctatcggcgacacaagcccctttgcccattctggcggagagcagcgccgtatcgccgttgccgatatgcttgcactcgagacaccgtatttgctgctcgacgagcccagcgctggactcgatccccgcgcccaccggctgctgctcgagcgcttggctcaactcgcacgccaaggccgcggcattgtaatcgccacgcacgattcgcgtgtggcgagcatctgcgacaaggcctttcggctgcaggacggcatgctgctgccgcaaagttccgagggcatccaggtgacatccgttggcgtgacggccgcacgtcccgtggaaaccggacatactccgccagcgtccaaggcggtctcgtttggcatctttcgtccggggtcaagcctcgttcacctgctgcaccccgccaccaagcttgtattctgcatgctctttatgattgccggctttatcgcccagcagcccggcgcccttgccgccgtcgcgctcaccgcattcgcctcgctcgccgcaagcggcagctcgatgcgtcaggcacttcgtgcccccaggccatttcgctggcttatggggtttgtcctggtcttcaacgcactctttacggcatcggggactctgctgctgcaggcgggacccgtgcagatcacctcgggaggtctgctctttggcgcgctctgcgtgctgcgttttgccctcattatgctgggaacgtcgacgctcatggcgaccacctcccccaccgcactcgccgatggcgccgcggcgcttctgaggcccctcgcccgttttggcctgcgcaccgacgatgccaccgtcgccatacagctcacgcttcgttttgtccccgtgcttatcgaagagttcaatcgtatcaaggccgctcaggaagcgcgcttggcgcgctttgacagtccctcgcccctgcagcgtgcacgtgcttttattcccgtcatcacgcccttgtttagcaacgcgctgcggcgctctgacacgctcgcgctcgccatggtcaaccgcgaatacggagcgcacccggctgtcagcagaacctgcctgcgcagctatcgctttgaccgggcagaccttgctgttctggcgctcggatgctgcatcgttgcgattgcgctgctctagggctcggtatgccatgccactcgccggaatgcggcatatggtctgtatgacatttgcgataatgcctatagcatcgctttgagaggagtcctcatgaagccacgtatcattgccatcacctgcggtgttgcaggaaccgccgtcggccttgccgctgccgccggcatcgtttaccgcaagcaaatcaagtccgccgcgtcgctcaaacgcttgaccggctacgcggatggctatgacctgtacgcaatcgacattgcctacgactacgatcttgatcgcatcatcgccgctggcgtgcgcgacgaccaggcctacatcgatgccgtggtggcgcaggtgctgcccggtgtgccggcacatgtccaggcgccccagtttgcctgcagcgcttttgtcgccgtagatgccgaaggccgcgtgcgcaccggtcgcaattacgactttaaggacgacacctcggcgctgctggtgcgcaatcacccgcgcgacggctatgcctccatcgggtttgccgcccttaacaacctgggcgataacactccgcttgactccgtcgccggacgcgccgccgcactcatgggcccgtttgcccagctcgatggtgttaacgaatgcggcgtgtccgttgccgtactcaccctggattccaagccctgtgaccaggacacgcaacgccccgtcatcaatacctcgctcgccatccgtctggtgctcgaccgcgcggccaccacgcaggaggctgtcgacctgctttccgcctacgacatgcacgccatggcaggacgcgattaccacttctttatcaacgacgccgccggtgacgcgcgggtggtggagtgggatccgcgcgatcccgaccgtgcatgcaaggcgacgcccgtacgccaggttacgaacttctacgcctgctatggcgacgaagtgctgcccaaccaaaagaatggcgagctgggccatggtaaggagcgcgccgtcgcaatcgccgatgtccttgacgcccatgtcggtgcccaagacgaggcagtcgcttggaaggccctacgcgctgcggcgcaagagcccaatccggaagacatcaccagcaacacgcagtggtcggtcgtcttcgacaacaccgagcccgctgccgccatcacgctgcgccgccactggggcgacatcgacgcctttgcgctgtaaggagccaggcccgtcgaccttacgctcgcctgacgttgtttacatttctatacgcttgagctaacacgttttacccccgtatcaacagtgtacgggggtaaacttatgcgcatgttataacttgcccggaaggattcatcatgctcaggatcggtcttcttaccagtggcggcgactgccaggcgctcaacgccaccatgcgcggcatcgtcaaaacgctcatgaccaatagcgaagagcctatcgagatctatggttttgaggacggctaccagggccttatctacagcaggttccgcgtcatgacgcccgccgattttagcggcatcctcacccgcggcggcactatcctgggcacgagccgcacgccgttcaagcgcctagacattcccgaggccgacggtgtcgagaaagtgcccgcgatggtccacacctatcacaagctacagctcgactgcctgtttatgctgggcggcaacggctccaccaagaccgccaaccgtctgcgcgaagagggcctcaacgttatcgccctgcccaagaccatcgataacgacacctggggcaccgagttgacgtttggctttacgagcgccatcgacgtcgccaccaagtgcatcgacgacatccacaccactgcctcgagccacgggcgcgtgttcgtcatcgaaatcatgggacacaaggtcggatggattccgctgtacgccggcgtcgcgggcggcgcggacgtcatcctgatccccgagatcccctacgacatggataacgtcatcaagaccatcgagcatcgcatggaaaccggcagccgctttacgatcgtagccgtcgccgagggcgccatctccaaggatgacgcggcactgtccaagaaggagtacaagaagaagctcgccgaacgcacgagcccgtcaatcgtgtacgacatcgccaaggagatcgaggccaagaccggccgcgagacccgcgtcgccatccccggtcacacgcagcgcggcggtcagcccgatgcccaggaccgcatctttgcgacccagtgcggtgtcgaggcagcgctcggctgcctacgcggcgagtttggctacatgattgccctgcgcgatggcaagatgtgccacatgccgctcgaggatgtcgccggcaagctcaagtacgtcgatccccaaagcgacctggtgcgcgaggccaaagcgttgggcatcagcttcggcgacgaatagcctcggctggaatccaccccatcgggccctccgaccccgcccgacgtatttcgatttggctcctcccttgactccgtcaaaggtcgccaatcgaaatcgtcgggcggggtcggagggccctgcgtttacatactcgccggggctattcgtcttcttgctgcgggtgcctggtctgaaattcagttgcggtgaaatagttcctgcttagtccgcaaatggctgaatccaaaaactattccaccgcaacttactgagtgggggctcttggctgctacttgcactaacatttgtcctgaaatggctggtcgttagggattgctaccggtagttgcggtagggttggggcagattctaactagaaatggtggtcgctaccggttgttctcgacatactcgagccattcgattacggtcacctcacgaaaggaactgccatggatcttgcaatggcgcagcggctcgtcgatcgacgcaaagctgccgggctttctcaggaggcgcttgccgcccaactgggtgtgagccgccaggctgtcagcaaatgggaacgcagcgaatcctcgcccgataccgataacctcattgcgctcgccgcactgtatggcgtgtcgctggatgagctgttgtacggggagacagttggagacggcgacggcggcaccgaggcttcggatgagaccgaagagactgagaactccgctgacaatgctcgctgtggtgacaagccactcgtcgacatttcccttgagcacggcatccacgttatcgatcccgataagggcgaagaggttcacgttggctggaatggcatccacgtaaccaacgatcgcaagggcgaagaagtccatgtgggaccgggcggcgtgcacgtcgatacgctcgaggatgatgggcatagcgtgcataccaatgccgacggcaccgtcactatcgacggcgatacgttttcaagctggaaggaggcacacaacaagctcgaccatcatggcaagcacttccacaccaagctcggtcgtgcgtggaacaagtttcccttccccgcagtggtcgccctcgcctatctggcgctcggcgttgtctgcggcgtatgggccacgggacttttcctcgtctttttgattcccgtctactacgcaattggcgactttatcgatcgacgccgcctgtctaagctcgtcggcagcgtctatccggcagctgccattgcctggttcctctacatgtggctctgcctgggacagccccatcccgcctgggtaatcctcatcaccatccccgtcgtaggagcactcatgcactggtgccgaaaacaatggaagcaccgcaagcaagcctagtttgccccgtcccgccggcaagccccagccgacgaccctccccctaagttgcggtgatatagttcctatttaaggcccaaatgaccgaatctaggaactattccaccgcaacttagcaagacatccaaggagctggcatgaggatcgccgaggtttcaaaggagtatggcatttccgccgatacgctgcgctattacgagcgcatcggcttgctgcctcgtgtgcatcgcaacgagaatggcattcgcgactacgatgagcaggactgcgcacgtatcaagttcgtaaagtgcatgcgcggcgccaacgtttcaatcgaagcactcatcgagtacatgcagcttctagagcaaggcgacggcaccatggcggcacgcaaagccattctcgaagaacagcgcgaccaggtcaccgagcgtattgccgaaatgcaggccggtctcgatcgtctcaactacaaaatcgcccactacgacgacctcatccacgcctgcgagcagaagatagcaaagtagcaaacgccagaccgcccataggctgcccggcgtttgcccagataaaacctgccaaaataaacctgtccctttttgacaggtttgacgagcggaggaaatatgcgagacgtagccgaaagcgactggaaactgtttaagaagctactccctgaatggcaagagcgccatatggaggagctcatcgaccagtacgtcgagatactgaacggcagcggcgaagcgtccagtagattttgggcactagaagaacgtatcaatagggacaagctgtcctcaggcgtaatagcaaccgacattcgccgcagcacaatgcaccgcgagatagccaacttacttatcgacaacgtgatcactcttgacgaccttgacggttttaccgaggaaattaagagctatgcgcagcactggattgatcagtaaaggtgccaaacaacacacgcgcccatagtcaaacaaagtaacaaacgccgggccacctaattgttgcccggcgtttgcccagataaaacctaccaaaaatgaacctgtccctttttggtaggctactcggcgcttttgagggcgccgaccatgtcgatcttgttgagcgttcgattggtggcgaggttgacgatgattgtgaacgcaaaggccagcaccacggcaagcacgtagctcaacggttcgacctcaacgtcaaagtagagcgacggcatctgcaggatgtacgtaaagctctcggccagcaagccgcccagcggaacgcccagcgcggcaccgattgccgtcaaaatcaacgtctccttgttgacgtaatggtgcacctcgccgcggcggaagcccagcaccttaatagtcgccagctcgcgctcgcgctccgagatgttggtgttggacagcgtaaacaccaccacaaacgacaggcacgccgccataaaggtcacgagcaccacgaccgagttgatgatggtgaagttggcctcgtagttttcccaatgctcggccgtgctcgaaagcgtcagccatccgtcgcttttaagttgcttgctaaacgcaatctgatcggccgacgaacccttgagcagcgcaaagatgccgttgagacggacgcttcgaccaaacgcacgttcataggtactctgcgtcatatagagcgtgttgcccaggtagttgagcgaaataccgctcacctcgacatcggcgacgttgagcgacgaatcctgaacctgcgccgtatcgcccggctgaatccccagcaccaactgtgagctcttgctcagatacacgtctccgtcgcgcaaagcgagcggctctttggactcgtcctccaaacacacgtagtcgtccaagtcgctcgtacggtcatcgggcaccacgaccagctgcacggtctcgctcttgccgccaaacgtaaaggtgacgttgtcggtcatgatcggcagcgtcgaggtcacggtcacgtcggagtccttggccgcgctgcgctcgtccagagctgcgcacgtctgcgtaaagtcatcggggttggcgaccgccagcaggtcatagcgcgtaatgtgcccgtactgcttgggcgaaagcgccaccgacgtgtcacgaatacccatgccgcagattacgagcgccgtgcagcccgcgataccgaagatagtcataaaggcacgctttttgtagcggaacagattgcgcgcggccaccttgttcaaaaagcccatgcggcgccaaataaagccaatgcgctcgaggaaaatgcgcgagccggcgcgcggggccttggggcgcatgagcgaagccggggtctcggccatctcgtggcggcaggcgataatcgtggcgcctaccacgcccacggcaaacagcgccaccgaaacaatcgaggacacgatgtcgtatgaaagcagcatctggggcagcgagtacatgtcatcgaacaccgtaaacaggaacagcggcaggccgacaaaaccgatgatgttgccgagcacgccaccgatcaaacaggcccacagcgagtagtccacatatttggacagaatgcgcccgcgcgaatagccgagtgccttgtacaggccgatcagcgtgcgttcctcctcgaccatgcgcgtggcggtggtgaggctgatgagcacggcgacgataaagaagatgaacgggaatacggtggcgatggcctcgatcgaggaactatcgctctccacgctcgaatagcttgcgatgttgccgcgatcctggatataccaggtgcattcgcccaggtcagagagctcggcgcgggcatcggcaaactgctggtcggcggcggcgcggcgctggtctaggtcggcttgcgcctgcgcgcgctcctcgctgccctcggccatgcgattgatgttgtcctgctcgattccaaagaccatattcgcctgacgctcagacgcgtccaagttcgccggcgtgtcgaccgtcagctccttggcacgcaccttctcgcgctcttcgcgaatcttatcgatattggctttgacctcgtcaatctttgccgtataggcatcggaataggaattgaggtcctttgctccctcgacgaccacgtgaatcgcggaataggatgacgacgtcgcggcgtcctcgctcacgtagaacttgtagtccgcggccgaggcagcacggaaagcgttgaccgtcgagtccgagctcacgtcggtgggatcgagaacctcagccgtgatggtgtaatctcccgcagcgaactgatccttggcgctctggttcgacgagttcgcgtcgttggcggcaaagctcaccgtatcgccgagctttttgcccgatgccttcaaaaagcgcgaagttaccgccacttcgcccgacgtctcgggcaagtcaccgcgcaccaacaccggctgatcaatattctctttagagaggctctgcacgacgacacgctcgcgcgccgtgcccacggcggtgtaggcggtctcggtatagatgccctcggccgtcttgacgccgtcgacctcttggatggcggcaaggtcatcatcggtcaggccataggtcgactgcacgttgatatcgtagacattctgctggtcaaagtaggcgtcgaccgaatcgcacaggtcctcgcaacccgcctggagaccgcacatcacgctcacgccaagcgcggtaatgaccacaatggacaggaagcgcttaagacttccgcgaatcgtgcggtaaatgccgcggcgaaacaccgtcggcaccatgtcgtttgagctttgggcagtgcgataggtcgtaaaatcctgctcacgctccgcatgcgcctcgttgccgccttggctgttttgacgatcttggtccatgggcgctaccactcgatcgtctcgataggcacgggattttgctggaccgtctcactttccacgcgaccactcttaaagcggatcaggcgatcggccatgggcgcgagcgcggagttatgcgtgatgataatgaccgtgatgccctgctttcggcaggtatcctgcagcagctgcaaaatctgcttgccggttttgtagtcgagcgcgcccgtgggctcgtcgcacaggagcagcttggggttcttggccagcgcgcgggcaatggacacgcgctgctgctcgccgcccgaaagctgtgccggaaagttgcccaggcgctcgcccaggccaacctggcgaagcgtttgctcggcatcgagcgaatcggggcagatctgcgccgcgagctcgacgttctcgagagccgtcaggttgggaaccagattgtagaactgaaagacaaagcccacgtcggcgcggcggtactccacaagctgcgcctcgttggcggcactcacgtcgcgcccgtccaccgtcacagtgccggaggtcgccgtgtccatgccgcccaagatgttgagcgccgtggttttaccggcgcccgaagcgcccaggataatggcaagctcgccacgctcaacggtaaaactcgcgccgtcgagcgcgtgaatgcgggcatcaccctcgccataggctttaatgacgtctctgaattcgatataggccatcgattgattcccatctggtcggataactctttagtattacccatttcgcaccgaccaaaaagggacaggtttattttggcaggttttatatgggggaatggcgggtgttggtagagcgacaggcggcagaagggtcatcaacggagtcaggccacccgtcaaacgcaaaggatttatgtcagccgtcaggcaaatcagtcgaacgggtgttcgtttctatgatatgatgctgacagttacacgggtccctacgcagaaaggcggccgccatggcgttcgactttaaaaaggaaagcaaagagctctatagacctgccagcaagccgagcatcgtaaccgtcccgcccatgagctatgtcgcggcgcgcggaaagggcgatccaaacgccgaaagcggcgagtatcaaaacgccctgccattgctttacggtatcgcctacaccatcaagatgtcgaagaaaggctcgaggagtatcgaaggctatttcgactttgtggtgccgccgctcgagggcttctggtggcaagactctcccggcagcgacatcgattatgtgcgcaaggacgacttcaacttcatctcgtgcatccgcctgcccgattttgtcacccaggccgactttgactgggccgtcgcggaagctaccgccaaaaagaagctggacttttccgcagtcgagctgcttaaggttgacgagggtttgtgcgtgcagtgcatgcataccggaccctacgacagcgagccggcaaccgtagacaacatgcatggatttgcggcagagcagggctatgccctcgacttttccaatacccgcctgcatcacgagatctacctctccgacccacgcaaatgcgcaccggaaaagctcaagaccgtgattcgtcatcccatcaagcgcaccgaatagcgtgggacaccacccggcggatcagattgaggctagtcggtcgacaacctctaggacatccggcggcttccttgacgcgattcgtcgcatcctataagtttgttttgctaaagctggaaagcctctcaacgatgcgcaactccagctctttttttcattctgcataatcaaaatgggacgccgtttccgtagacgatgccatccggaaactgcatcccactctgaggcgatattctgggtcgcggtttccgcttgaagcatcatccggaaagtaattgaggcgtcttatcgtcagacaagaggtgccgtgaaaggacagcgactcgtcctttcgcggcgcctcattcatgcaaagcgctcgagcgttattcctcgtacgcgccctcaagccgaagcagccgctctttgcgatcaagcccgccggcatatccgttgagcgatccatcggccgcgaccacgcgatgacagggcacgatgatcgaaatgggattgcgcgcaaccgcagcccccacagcacggggagacacaacggggtcctcgtttcccggaacacgatgcttggccgcgacacgctgggcgatctcgccatacgtagcgacctcgccacgcgggatagaaagcagctcgaaccaaacctcacgctgaaacgccgtgccgatcatatgcaacggcggcgtaaaccgaggctcctgaccagcaaaataagcattcaaccaagcccaagaacgctcaagcaccgctgaggctgcgccattcgccggattcaccgaagacatcccgcctgcaccggaaaccgcgtcggcaccttcgacgtgctcggcattttctttgaggagcgtagagccaaagtgctcctgtccctcaaaccaaagccccgtcaaaccgcggccatcagcggcaagcaggatttcgcccaaaggcgaagcaaacgtcgtcgtgaccaccagcggctcctttcaaaactccgcaacataataccgcgaattgtgcagacaaccctactcggccccaaagtcacctcaggcagcaggcgcgaagcgccgccgctgccgcacgatcccaaagtccccgcaggcagcaggcgcaacgcgccgcagctgccggccgcgccccacagtcccccaaggtggcaggcgcgaagcgccgtggccgccgccgggaccagggcccgcaacagccacgtgcccccacatcagcccagcggccccaaccaacaacggccccatcgcaggccgctcgcagcagcgtcaccgcaggcgggggccgggcttagttttcagaacactccgcagaccagtgtggcgccttgtccgcagctccgaaggagcaggacaaggcgccacacatggtcgaggacgttctgaaaactaagcccggcccccgccggacaggtccaccgctactcgcagagcagcttagcaatctggacggcgttggttgccgcgcccttacggatttggtcgccgcagcaccagaaggtgatgccgcgcgcggcctcggggttcgagatgtcgcgacgcacgcggccgacccaaatcagatcctggtcggacgtgtccatcggcatggggaagcgatcgtgcgcatcctcggcagccatatcgtcaactagcttgacgccaggagcggcagccagcgcagcgcgggcctcctcgaccgtaatatcgcgctcaaactcaagcgtaatgctctcggagtgcgaacgcagcacgggcacgcgcacgcaggtgcagttcacgcgcagctcgggcaggtgcatgatcttgcggccctcgttctgcagcttcatctcctcggaggtgaagccttcctccttgacgccgccgatctgcggaatcaggttgctcgccagctgggcggcaaaggcgcgcggctcgggaatctcctcgccacggcccagagcggccagctgggcctcgagttcggccatgccgggagcgcctgcgcccgaagccgcctgatacgtcgagacgatcatgcgcttgacgccggccagctggtgcagcggccaggtggggaccaggccgatgatggtcgcgcagttggggttggcaatgaggccgtggtgccacttgatgtcgtcggcgttaatctcgggaacaaccagcggcacctcgggatctaggcggaaggcatggctgttgtcgaccacgacggcgccacgcttgacggcctcgggcagcagctccttggcgatatcatcgccagcagcaccgagcacgatgtcgcagccctcaaaggcctcggggcaagcctcctcaatcacaacctgctcgccgcggaactcgacggtcttgcccgccgagcgtgcgctcgccagcagcttgagcttaccgaccggaaactcctgctcgttcaggcactcgagcatctgggtgcccacggctcccgtcgcgcccaaaatagcaaccgtgtactgtttcatgcttccccctttaaaggttctggcttttgcccgcacgcttagcggactcaatagtgtgccccagtttatacaagaacggggcggacacaaaacccgccccgccgaaacgaaaccgaaacgaaacgccccgcagtagattttcaggcatgtcccagaaatctaccggagtggcccctacttgtgcagcgcggccagggcgggctcaagcggctcggaaggctccaaatcggagaccttgacgatgccgttctcgtccgagaaggcgcggtagatggtctggatcgccagatcgaagtccttctcctccacgccgatgatgatgttgatctcgtcacagctctgcgaaatcatacgcacgctcacaccggcctggccgagcatgccaaacaggtggccggaaatgccggcacgaccgcgcaggttgcggccgacggtagcgataagcgccagaccctcgacgacctcgatctcgagcggctcgacttccttctgaatgtcgcccacgagcgagtacagcgaatcgtgcacatcctcttcctgcaccacggcgccaaagcggtcgacaccggtgggcatgtgctcgacggagacgtcatagcgctcgaacaccgaaagcgcgcggcgcataaagccgacgcggggcttggtacggtcgcgggcgacgttaatggcgacaaagccgcgcttgccggtcacgccggtaatgatgggctcggcctcgccctcgtcggccgtctcgctaatgatggtgccggggtcctgcggcgcgttggtgttcttgatgaccagcggaataccggcctcgcgcacggggaacacggcctcctcgtgcaggacgctcgcgcccatgtacgaaagctcgcgcagttcctcgtaggtaacgcgcgcaatgggctgagcctcgggcacaatacgcgggtcggcagaatagaagcccgaaacgtcggtccagttctcgtacaagtcggcgcccaggcacttggccagaatggcaccggaaatgtcgccgccgccacggtcgagcagtttgatctggccctcgcgcgtcgcgccgtagaagccgggcatgacaaagccgccctgctggccgtactcctgaaccagctcggaggtgcgattcatgctgagcgaaccgtcatgatggaacgccacgaccgtcgcggcatccaggaacggcaggtccaagtactcggccatgaggcgggcggtgaagtactcgccgcggctcacgagctcctcggtagagtaaccgcccgagcgggcgcgctcggcaaaggccgcaaactcctcgcggatgggataggtgagcccaagctcgtcagcgatatcaaagtagcgctgaccgatgtcctcgagcagctcttcgcacgacacgtgatacttgacgtgcgcgttgaccaagtagagcagatcggtcaccttggtgtcgcccttaaagcggcgaccgcaggcagaaaccaccacaaaacggcgggcagggtcggcgtcgacaatggccttgatcttcttaaagtgttcggcgtcggcgaccgacgagccgccgaacttggcaatcttaatcatgggcttgaggttacctttctaaaaagcctctgcgaacctactttgcgtgctctgataccatggtttcaccgattgggaccaaggcatccgaggagcagtgttatatgggaacttatcatagtacacgaggacgcactttatcgtgctcaagtaaggtggcaatccgtaccggcatcgctcccgacgggggtttgtttgtatcggacgagctgggaacccagcagctcgatatcagctcccttgcagataaatcgtactttgaaatcgctcaagatgtgttgggaatgttactgaatgattacacggccgaagaaatttcggcgtgtgtcgacgaggcataccgcggcacgtttgcgagcgaagaggtcacgccactcgtcaagcttgacgcggcaccgggctccgacgccccgcagacctatgtgatggagctctttggcggccccacgagcgcctttaaggacgtcgccctgcagatgctcccccgcctgatggcccgcacctccgccaaggacggcggcgccgagcgcatcatgatcgtcaccgccacgtcgggcgacaccggcaaggcagcactcgccggctttgccgacgccccgggcacgggcatcactgtcttttatcccgagggcaaggtcagccgcgtccagaacctgcagatgtccacgcaggagggcgacaacgtcgctgtctgcggcatccgcggcaactttgacgacgcccagagcgccgtcaagcgcatctttgccaataaggagcttgccgagcgcctggaggccgctggcaccgtgctttcgagtgccaactccatcaatgtcggccgcctggtgccgcaggtcgtctactactttgccgcctatgcgcagctgctgcgcgccggcgccatcgaggctggcgacgccgtagagttctgcgtgcccaccggcaactttggcgatatcttggccggctactatgccaagcgcatgggtctgcccgtcgccaagctcgtcgtggcgagcgacaagaacaatgtactcaccgactttttgaccaccggcgtctacgaccgcaaccgtccgttcttcacgaccatctcgccgtcgatggacatcctcattagctccaacctcgagcgcatgctgtacttcctgtccgacggcgactgcgagctcgttgccggccttatggagcagctcgcccagaccggtcgctacgaggtgcccgccgagctgctggccaagattcagagcgtgtttggctgcggctgggccagcgaggacgaggtccgcgccgccatcaagagctgctgggacgccaacaactacgtgatcgatccgcacaccgcctgtggctatcacgtctttgagcaggtagctcctgccgagggcgccaaggcccgcgtgctgctttcgaccgccagcccctacaagttcccgcgtgcctgctgcgacgccctgggcctcgacgttcccgaggatgactttgaggccatgcgcgtgctcgagcaggcaaccaacacggtcgccccgacccagctcgccgaactcgagtccaaacccgtccgcttcgaagacgtctgcgacgtcgatgagatggcaagctacgtcgagtctgcagcaaaacgaatgagcaccaactaaaccccttattaagcgccggcgaaagccggcgcaccttcttttatcagaaacccaccgggatgatgacgaactgacatgcgggtctgcctgtttagttcgtcgcgagttccgcacgagccggaaagcacttaatgtgctttccgagcgagccaggactgcccgagcagcgaactaaacaggcagaccgcccaggagattcccatgatcaagatcaccgtccccgccaccagcgccaacctaggcattggctacgacaccctcggcatggccgtcagcctctactcgcacttcaccttcgagcgcgccgacaagctcaccatcacgggctgccccgaggagttccaaaacgagaacaacctggtctacgtgagctttgtcgatgccttggccgcctggggcgagccggccttccctgtcgccatcgacattcagactgacgtgcccgtcgcccgcggcctgggctccagctccacctgtgtcgtcgctggcatcatggcagccgccgcgctgacgggccacaccgtcgaccgcgccgagctcgttcgcatcgccaccgaggttgagggccatcccgataacgtcgcccccgccatcctgggcggcgccgtctgctcctttacgccgacggactcgcttccccagtgccttcgctacgaagtgagcgacaaactgcgttttattaccgtaatcccgccctacgaggtgcatacgagtgaggcgcgcaaggtcgtgccgcaggagattccactctccaccgccgtatggcaaatgggccgcatcgccggcatgacgcgcggcctggagaccggcgaccttgacctgattgccgccgccaacgacgaccgcatccaggagccctatcgccgccgcctgattcccgattacaacgccgtgcgcgacacctgccttaatggcggcgccaagaccatctggatcagtggctccggctcgacccttatggctgtaaccgatgacactatcgtagccaagttcctgcaggtcaagctgcgtgagcagttccccaaatgtgacacgcatattctgacgtgcgacacggaaggcgctcaaatcgagtacctgtagacatcctcctcatatacctgtccgggacggtcgggatgttccctcaaaatcgtcctcgcgcatgaaggccccttgtcctgctcctacggagcgacggacaaggggccttcgcgctgcggaatgattttgagggaacatcccgaccgtccctgcgcctaccttgctgaggatgtctacagggacccacgctttgaaggggcgccgggctgatggtttggctttttattggtgggggcccttactgggatgggacccttactagaggcaggcctcggcgatgcggcgcttgagttcatcgataccggtgccagtctgggagcttgtgatgattacgttttcggccgggacgttgagctgctttttgatggctgctgcctggcgggcctgctgggtgcggctgagcttgtcggctttggtgaggcagacgataaagttgaactcgttgccctgcaggtagtcgatcatgtcatgatcgagcttgctggggtcgtgacgaatgtcaaccagcgatacgaccaggttaaagctgcgctcggagtcaaagaagtcgccaataagctcggcccagcggtcgcgctcggccttggagcgacgggcgaaaccgtaacccggcaggtccacgaaatgcacgtcgtcggcctcaaagaagttgatgttgctcgtcttgcccggcgtactggaaaccttgaccaggttcttgcggccaaagagcttgttcataatcgacgacttgcccacgttggagcggccgacaaagctcacctcggggcaggtggactcgggaatctgcgaaaccttgccgtagctggcgacgaacttggcaagctggtagttaatggaatcggccatggacactccttggtcgtaggttcttacaaaagagcgcgctattgcgcagcagcaatgcggcggacgatatcgagcgtgatgtcacttgcgacacgcgcgtactcgaacagatcgaactctcggtcgcaaattgcatcgtacgcctcgtcacaattatcgctgatagcgcgcaacaccaggcaatcgacaccatttttggttgcgacatgggcaattgccgcgccctccatgccgacacaatcggcatgcgtcgcctcgatagcgtcgttgcgcatggcggcgcccgtcacaaagcggttacccgtggcaatcgtgccgaccaggaattgtttggctccctcgttcgaagcggctgcatttgtcgaagcatcaacaaacccacgctcagcaagcacgtcgacggcaatatcgaccagcgcgggtgtcgagccaaactcctcgagccccggtgcggactcggcgataagcgcggtatcggtatccagatagcgtaggcgtttgccaatgaccacgtcgtcgatatggagtctggggttcaaaccgcccgcaatgcccgaaaacacaacagcctgcggagcatacttgctaatgaggtgctgtgttgcagcggcggcgttcaccgtgcccatgcccgccgttgtggcgacaactgtcaggccgtcgagctcgccgctcacaacggtcaagcctgcctcccgcgcctcgcaaacgtcgctcagctcttccttaatctgcatgatctctttttcgagcgcaccgataatcgcgatggtagccataccattccccaaacctatacgaaattctcaaccacggtatggtaccagcattttgtttgacctcgccaaacgaacacgctaagccagtgcagctcgcgtatcaaacagcgcctttgcaatcgcggccgtaacctcgctcgagcggtcgctccacggcatcgatgtcatgacgctcatgacataggtacagccatcgatgtcgatagcaggcatttctttccaaagatattcagtcgcgtttaaggtgtctctaaacaataaacaggcgtttctatgcaaaaacaccgattccgttgcgcatctttgcccaaaacgcagttgcggtgaaatagttcctgtttgggcggcataagccgaaaaacaagaactattccaccgcaacttgacggggctctttagcaatcaactaggtgcccgggagcactcatttaagtctgtccccaatgagtgccgctagccgatggcgtttttgagttcggcgcggcgctttttcatgccagtcatgacggcgttgcgcagctcgggcatgcgcgcggtatccatctgcggcacgccctcgagcttatagggaatccccagctgctcatacttgacaacacccatcgtgtgatacggcagcatctccaggcccaccacgttgtgccacggcgcgatgaggcggccaagcttctcgcactcctccaccgtatcggtaatgcccggcaccaccacgtggcggataacgaccttaatcttgcggcgcgctaactcatcaccaaaggccagaatgcgcgcaggatcgcacccggtcagctttttatgctcgaccggatcggcatgcttaatgtcgagcagtaccatatcggtctcgttgagcacggcatcgaacttctcggaatgctgcgggtcaaacgcgtaaccgcagctgtccaggcaggtatgcacgcgcccatcggggttgttgtgcatagtgtggaacaggtcagccaaaaacgcgggctgcagaagcggctcgccaccggacaccgtaataccgccgctgcggtaaaactcatggttgctctggaactcgtccatcagatgctcgacggtcaccatggtgccaccgttgactgaccaggtatcgggattatggcaatacgcgcagcgcatgggacagccctggacgaacaccacgaaacgaatgccaggcccgtcgaccgtgcccatcgtctcgatcgaatgcacgcgacccaaggcaaatgcagagtcctcgggacgagcatccacaccctcgagcgtcatctcagccatatccgctaccttgccttccctacttctagctaaattaatgccagagccattctagcccatgcgtttagtgctgaagcgttttagcggcaattgggcagcgtcattttgatgtcaaacgacaacggcgggcaggttgtcgctaccctgcccgccgaagcagtagatattgattgtcgctaccgtctacgccttgagcgtgagcaccgcaccgaacgccgtcggaccgcagtggctcgaaatgacgccgccaacctgagtccaggtaacgtccttaaagccaagctcgtgcgcatacgtctccatgtcatcgcgcagctcttcggaaaggcccaccgaatacgccaggccaatgtgcgcgtagtcgatatcgcccttggcaatcatatggtcgataaaggcgcgagcgcatttgagcatggaaccgcggaactttttggttgccacaaacttgccgcccgtcacctcgatgcacggtttgatcttgagcagatgggcaccaaggaacgccacgttggacagacgcccgccggccttgagaaaggcgaggtcggtagggacaaagcccagcagaacgcgatccatgacggagttggtaaaggcgaaaatctcgtcaacggtggcgtccggatgagcctcgatatacttagcggtctcaacggcgacaagcgactggcccaccgacacaaagcgcgtatccatggagaagacgtaatcgcggccctttgccgcaatcttcgacgactgatgcgagcaggtcgtaacctcggaatacgcaagatgcaaaatggtcgcatcgggccgctcggcgtggatgcggtcgtacacatgcgcaaaatccgccggcgagcaaccgctggtcttgggcatcacaccaaactcgttgcagcgcgagtaaatctcaagcgggtcgatcgatccgtcttcgacggtctcgtcaccaatcgtgacatgcatgggcacgcgcacgatgccatagcgctcgcagagctccggcgtcacatccgaaccagactcaaccacgattacgtacttgcccattatcatcacaacccatctcgacgttggcttttgaatatgtgacgcacgtccgccgtcctgctgcagaacggcctccaagcgccaaagagacgccgccccttgcacacaacaaaggacagcgtctccctggaaaactccgtgcttatctgagattctacacggtttattaaggagtgttacttattccgcaaacggtagctatacgcgataaacggtagcaagcaagaatccagaacgctcaacccattaggagagttccgcctaaagggtaactacacaggaccccgccggggctgtttgggctacctcccaaaatattccgcaggacgcaagaagccctcgccgcacgaagtgcgcagcgagggcttcttgcatgtccgaggacgttttgggaggtagcccaaacagccccggcgatcctgcgggagttaaacccctttagaacttgttgtggaaggtacgcgaaatgacctcgtcctgctgctccttggtgagcgtgtggaagttcacggcgtagccggaaacgcgaatggtcagctgcgggtacttctcggggtgagcctgagcgtcgagcagcgtctcacggttgaagacgttgatgttcaggtggtggccacccttctcggcgtaagcgtcgagcatgtggaccaggttatcggcctgagtctcggaaacttcagaaaccttcataatgtgtctccttcgatcgataggcgccggccgaaaccggcgcactaatcagtaatcgttattgttagtatagcactaacaatagttactcgcccagctgatcaaggtcgatatcgccaaagaacacctggtcctccttgccgagcgcacccgggatgatggagaaggtgttggagatgccgtcctgagcatcgcggaacgggagcttggaaaccgaagacagcgaagcgatggcgccgtggctatcgcgcttgtgcatggggttagcacccggggcgaagggctggccagccttgcggccatcaggcgtagaaccggtcttcttgccgtacacgacgttggaggtgatggtcagaaccgaggtcgtgggcacggagttgcggtacgtgtcgttcatgcggatgtactccatgaactggtgcacgacgtcgtgagcgatctggtcgacgcggtcgtcgtcgttgccgtacttggggaactcgccctcggtctcgaagtcgacgatgatgccgttctcgtcacggacggggtgaaccttggcgtacttaatggcggacagggagtcggccacgacggaaaggccagcgatgccggtagcgaaccaacggtgcacgtgcttgtcgtgcagagccatctggatgcgctcgtagcagtacttgtcgtgcatgtagtgaatgatgttaagggagttgacgtagacgccagcgagccacttcatcatgtcgttgtacttggcaacgacatcgtcgtaatcgagcgtatcgccctcgacggcgcggtacttggggccgacctgcttcttggagacctcgtcaacgccgccgttgagtgcatacagcaggcacttggccaggttggcgcgagcaccaaagaactgcatctccttgccgatgcgcatggaagaaacgcagcaggcaataccgtagtcgtcgccgtggtaaacgcgcataaggtcgtcgttctcgtactggatcgaggagctggcgacagaagtcttggcgcagaacttcttgaagttctcgggcagacgggtcgaccacagaacggtcatgttgggctcggggctggtgcccatgttctcgagcgtgtgcaggtagcggtagctcatcttggtaacgagcgtacggccgtcgacacccatgccgccgatggactcggtgacccactgcgggtcgccggtaaacagggcctggtactcgggggtacgggcaaacttgaccatgcggagcttcatgatgaagtgatccacgaactcctggatctgctcctcggtgaaggtgccgttggcaaggtcgcgctcagcgtagatgtcgatgaacgtggaggtacggccgatggacatagcggcgccgttctgctccttgacagcagcgagataggcgaagtacatccactggatggcctcctgcgtgttggtagcggggttggaaatgtcgaaaccataggtctcggccatcatcttgagctcgccgagggcgcggatctgctcctgcagctcctcgcggtcgcggatgttgtcggcggtcatgaccgtcggggtggaagccttctgggcctccttgtccttgatcaggtagtcgacaccgtacagggcgacacgacggtagtcgccgatgatgcggccacggccatagccatcgggcagaccggtgatgatgtgagccgaacggcaagcgcgcatctcgggggtgtaaacgtcgaagacaccagcgttgtgggtcttgcgctcgaaggtgtagcgctcgacgacgttctcgtcgatcttgtagccgtgctggctggcagcctggcaagcgatgcggataccgccgttgacgtgcagggcacgcttgagcggcttgtcggtctggaggccgacgatggtctccatctcgcgatgggcgttatcgatgtagccagcggggtggctcacgatacccgtgacggtcttggtgtccatatcgaggacgccgccctgctcgcgctccttgagcagcaggttgagaacctcgccccacagctccttggtacgctcggtcgggccggcgaggaacgactcgtcgccctcgtagggggtgtagttcttctggatgaagtctcggacgtcaacctctcccgtccagatgccttccttgaagccttcccatgcctcctgcattgtgtaaccacgctcctagttacgtgtaatgcggcgctctctcacaccgctgcttattgaattcttgaatgttcggcttgcacgaccggcttcttccgttttccgccacgtgttgacgcaggaaaaacgtttgtccaccttggcgctgcaaccctaaacccaagatttcacccgtttgagaaggataacatagcgaccctctccatctgggctgttatatgtttctttttttatatcataagagcgtttttgacaaatccgcaggaaatgcgtgcgcgggcagataccgttcaccgaattgtctgatatttccccttgcctttatacgcctgtcgctctagctgttatgccagctttagctgggtaaagcgactcagagaccctagcgacaacagggcggccacgaaggaatatcccccgtggccgccctaaagcattggcttgttgtgagcgttgatttgttgcgcgtggcgttacgcggcggcggcagccttgtcggtcgcggccttcttgctgtcgccgtgatcctggccctcaaagtgcttgtagcaccagctggtgaccagcggggtgaggatggccgtcacgatagcgcaggctgcgacctgagccgtagccgtcgcgagcaccgcgccgccgtacatggcttcgttgacgcttgccatggcggcaggcgttgccacgttggcaccggcgcagctggagattgccgcgcccgcgacacccgtaccaccggtgagcttatcaaccgcgataacgggaatggcgaagaccaccgagcagataacgccaagcagaatgccggggaggccgccgttgataagctggccaaaagtcatggtcgagcccatggcaaagaagacgagcacgatgatggcggaaagtgccggtgccatcatcttcttaaagctggggaagaggttgcccagaataatgccgacgacgatcggcaggatggcgcccacgagcgaccagccgatcggagcctggccggcagcgccgagcacgatcatcgtgaccggagggccgacaaccagcgtggtgatggcaacggcgccacgctcggcctcgttgcccatggtgcccatcagtccagcgtacatagcgttgttggcacccgtgcaagcggccagcatcaccatggccgagatgccaaacaggttgtcgttgaacacataaaggatgagcagcgacacggcaacgaccacgatctgcttgacggcgatgatgatggcgccgcgggcagcggcggcaggagcactcttaaacgaaatcgtcgtaccgacgatgagcaaaaatgcgcccacgagcgggcctgcaccctgctgggtcatgccaagcgtaaagctgccgagcgttttgaacaggtcagggaacagcgtgttgagcaggcagcccagcaaaagcggcaccaaaatattggcacccgggatggaggacatcttaaagaacggctcctttgccgccggcgcctccaccgcagtcgattcactcatatatatctcctttggatgcatgcgaatcgtagccgcacgcgcctatgtcagaaagaaggcgacggtcccgagtcgcaggggccgtcgccgaataatcgtcgtggggtattacccgtccaggacgatgccgccgtcgcagtcaccgatctcgccgttcacgaagctggcgaggtcggaagcgaagaacagcaccatctgcgcaggctcgctggcctgggcggcgcggcccagaggaataccgttgatgatgcgctgagagttctcgtcagagagaatcgaggtcatatcggtcaacgtgagcgacgggcatacagcgttgcagcggacgccgaacttgccgccctccttggcgactgccttggttagaccgttaacaccggccttggagctggcgtaggcagcggtgccgagcaggccaccaccgatcttaccggcaacagagctcacgttgacgatagtgccggcatgggccgccttaaagtgcgggtacacggcgttcatcatggtaaaggtaccgttgaggttgatgtcaatggtgcgacgccactcggtgtcatcgatctcgtcgaacttcttggtgctgatgacgccagcgcagttaatcaggatgttggtctgcggcagatcggtgaaaatctgctcgacggtctcgcgcgccttgggtgcatcggcgacatcgagctgatagaacttgttgccctcgccaagctcggccacagcggcctcgcccttagcagcgttccttgcgatgagcgcgacgtgtccgccgcccgcaacgatacccttggcaatctcgaggccaatgccctgagtgccaccggtaacgatcgcggtcttgcccgtgaagtcaaatgccatgactccatccccctttatgtaaggtgtctccttgcgggaagttggagcatcgcacgtggcgattatatgagtcccagtcgtcatggtggtgacaacccctcgcctaaccgcgtgcatgatagttctttaaaacgcttcagcaattgaatgattttaagtctttatgcgctctttatattgcccactgtatgaggtccacgtatgggggtatcatcttccaccgaaaatagtttctagtgttaggggttttcggtggaagatactgatttccgtgagcttgggcgtcagctccttaccgagttcggcagtatgtatcagcgcatttcacgctttgcggacaaagccctcggcggcgagatggccgtcatgcgcgccctcatactcgccggtggttcgctcacaccgagcgaactcgctgatcgtgcctgggtctcgagcgcccgcatcgccaatatcctacgcgctctcgaggccaagggctgggtcgagcgcgagcactcaaagaccgaccgtcgtcgcgtacacgtcacggtgaccgacaaaggattccaggatctcgaaatcaaacgtcgggaattcgagaagcgcaccgcggctttcctcgagcagctcggcgaaacagatacccaagagatggtgcgccttctgagacgcgccaacgaaattatcgaccgcaatcaagaaaggagagatgccgagtgaggattctcaagctctttaaaaagcatatcctggcactgttcgcagctatcgtacttatcgtaatcagctgcaacgctgatctggcactgcctacctacatgagcgacatcgtcgacgtgggcgtgcagcagggaggcatcgcctcgcccgtgcctgacaccattcgcgccgaatcgctcgacgaccttgaactctttatgagcgccgaggatgccaaagttgtggaggccgtctttagcaaggcggacaaaaacggtattcgaacgtacaagggcaccgaggaggagcgcgccgacggcggcaagattgccgacatcatgagcctgcccgagaccgtcgtgctcgccttcaaccagggcatcgacgccgactccatgggcgacatgaccggcgcatccaccgaggcaagcgatggcggcgccgcccaggccatgcccacccccgagcagatggcggcaatgacgcccgagcagctcgccgagatgcagcagaaggccgcagcggcgcagaatatgcaaaagcagattgatgccgacggcggtaagatcaccatgaagagcctgcgtctaggcgttgaaggcggcctaatcgaccagggcaagctcgtcgagggcgccaacgatatggcggacaaaatgggctccatgtcgggctccatcgtgacccaacgcgccgtgagctatgtgcaagacgagtacaaggcgcaaggcatcgaccccgccgacgtgcagaacgcctacctgggccgcatggcgaccacgatgtttggtctgtgccttgtgtcgctcgtcgccaccatcctgaccggtgccgtggcttcgcgcaccgcctgctccatcgcccgcgacctgcgccgcgagaccttcaacaaggtaatgcacttctcgccggccgaggtgggcaagtttagccaggcctcgctcatcacccgctgcaccaacgacattcagcagatccagatggccgcaaccctgtttatccgcatgtgcctgatggcccccgtcatgggcatcgtcgccgtcatgcgcgtcctggccaaccacaccggcctggagtggaccatcgccgtggccatcatcgcggtctcggccgttgtcggcgtgctcatgggcctcaccatgcccaagttcaaaaagatgcagagctttgtggaccgcgtgaaccttaccgcccgcgagctgctcgacggccttatgcccatccgctcgttcaaccgtgaggagcatgagctcgagcgttttgacaaggcttcgctcgacctgatgaccacgcagctctacaccaaccgcgccatgagctttatgatgccgctcatgatgctcgtcatgaactgcatcaccgtgcttatcgtctggtttggcgcgcagggcgtgtccgacggcgtgatgcaggtcggcaacatgatggcgttcatctcttacactatgcagatcgtcatggcgtttatgatcctcaccatggtttcggtcatcctgccccgcgccgaggtcgcagccgagcgcgtggaagaggtcatcacctgccccacgagcatcaacgaccccgcctcgcccaaactgcccgctgccagcgcgccgcgcggcgagctcaccttccgtgacgtgagcttccagtatcccgatgcccgcgccgacgtcattagcggcgtaaacttcaccacgcacgccggccagatgctcggcatcattggctccacgggctcgggcaagtccacgctcgtgcagctgattccgcgcctgtacgacgtcacgggcggcagcatttcgctcgacggcgtcgatgtgcgcgacatgaccctttccgagctgcgccgccgcattggttacatcccgcagcagggtcgcctgttctcgggcactgtcgagagcaacctcaagtttgccagcgacatggtgagcgatgatgacatgcgccgggccgcgcgcatcgcccaggccgaggactttatcgccgaacgcgagggaggctacgactcccccatcagccagggcggctccaatgtttcgggtggtcagcgccagcgcctggccatcgcccgcgcgttggccaaaaagcccgaggtcgtggttttcgatgattcgtttagcgccctcgactacaagaccgacgctcgcctgcgcgaagagcttgccaaaaacgttaccgacgccgcgctcgtggtcgtggcccagcgcatcgcaaccatcatgcacgccgaccagatcatcgtgctcgacgacggccacgtggtgggcaccggtacgcacgaggagctgctgcgcagctgcccggcgtacctggagatcgcacagtcgcagctttccgccgaggagctggggcttacccaagaagaaattgcagccgtcatggaaggaggcgagcgctaatggcagacgagaccaagacccaaattcccaagcccacccgtcagcgtggacccatgggccgcatgggcggcatgcgtcgcggcgaaaaggccaaggactttaagggcaccatgaggcagctgctcggctatatcggccagcacaagattgccgtgtttgccgccgtcgcctttgccgtgtgctcggtcatctttaatattgtgggacccaaggtgctcggtcaggttacgaccaagctgttcgagggcctggttgccaaggtcaacggcaccggcgatgtcgactttaactggatcgccaagacgctcggctttttgctctgcctgtatctggcaagctctgtctgcagcctggtccagggctggctcatgaccggcgtcacgcaaaagatctgctaccgcatgcgcaaggaaatcgccgccaagattgccgtcgtgccgatgagttacttcaacggccacagcaagggagacgtactcagccgcatcaccaacgacgtcgatacgctgggtcagtcgctcaaccagagcgtgacgcagctcatcacgtcggtgacgcagattatcggcgtgctcgtcatgatgctttcgatcagcctgccgcttaccggcgtcaccgtgctcacgctgccggcagccgcgattatcctgaccgtgatgattcacttctcgcaaccgtacttccgcgagcaacagcaagtcctgggcaccgtcaacggcattatcgaggaggactttgccggccagaacgtcattcaggtgttcgaccgcgccgaggcctcgattgaggagttcgaccgtcaaaacgaccgcctctttattagcggctggcgctcgcagttcctgtcgggcctgatgatgccgcttatgagcttggtgggcaacatgggctacgtgggcgtcgtcgtggtgggcgcgcagctcgcgctgaccggcaatgccacgcccggcgacatccagagctttatccagtacgtgcgcaactttacgcaacccgtgcagcagctgggcaacgtgagcaacacgatgcagtcgatggctgccgccaccgagcgcgtctttgagttcctggccgcgcccgaggaggagcagaaggccgacgcgcagattcccgagaagcgccccggccacgtggtgtttgaccatgtcaagtttggctacacgcccgacaagatcatcatccacgactttagctgcgaggcgcagcccggccagaccatcgccatcgtcggccccaccggcgccggcaagaccacgctcatcaagctgctgcagcgcttttacgacgtggacggcggttcgctgcgcgtcgagggcgtcgacgtgcgcgactgggaccgcgcggcgctgcgcggcgagtttgccatggtactgcaggatacctggttgtttaacggtaccatccgcgagaacatccgttacggacgccccgatgcaagcgatgccgaggtcgaagccgctgcacgtgccgcacgctgcgaccactttatccatacgctcgccggcggctacgactttatgatcaacgaggagggcactaacctgtcgcagggtcagcgccagctcgtgaccatcgcccgtgccattttggccgaccgcccggcgctgattctggacgaggcgacctccaacgtggacacccgcaccgaggagcttattcagcgcgccatggacgcgctgatgcagggtcgcacgagctttgtcatcgcgcaccgcctgtccacgatccgcaacgccgacgtgatcttggtgattcgcgacggcgacatcgtcgagaagggcacgcacgacgagctgctcgctcagggcggcttctacgccgacctgtacaactcgcagttcgacgaagcggcgtagggctggcgccgatctgctttatatgctcgtaaacgggggcgcaggatgacctgtgcccccgtttttgcgtttcgtgacgctcgaaatgtctcctcggggtctttgctgacggacctttttagaccccatggtcaaaaaagagcaaatatgagtactgttacctttttagtagcagcgaaaaccgccccaaatgggccccttggagcttttatacgcctgcaaatcgttcgaaacgcccgataccggggtagcgcgcagagatgtggtgtaagaggcggggcatgccccgcctcttctctcgtcggctggcagcccgccgtcggcaacggcggcaccgccggcacgaccggccaggcccgcgccgtcgaggcgatcgccgccgaggtctcctcgccggtctccggcggcctgtcctacagcgcccacgtctcgggcgtcggctggcaggacgaggtctcgggcggcgccgtggcgggcaccaccggacagggcagggcggtcgagtgcgtgaagatgcgcctgaccggcgacctctccgagtactacgacgtgtggtaccgcgcctacgtgcaggactacggctggctcggctgggccagcgacggggcccgcgccggcacgaccggcatcggctaccgcgtcgaggcgctccaggtccgcatcctcgcgaagggctcggcggcaccgggccccacggagggcgcgtacagagacgttgctgatgagaaagtgattggcgttccgcggatcagactcgttacttggcttacccaacatcaatatgacggctactacctcgggactccatattccactggattctctattcctacctgcacctatcccaatggtgagaggcgttgggatggatactctggtatgaattgcaccggttttgtcgcccacgcatggtcgaaatgcggcggcaatcttgcagcggtagccgcaaataataaccattctccttgggctggaggccccggtggcggtagctatatcaatgcttggcgtttttacggttatgcgattgattccggctcaaaggtttatgagttcaacaaggtgcaggatctgctgaatagtgggttggcaagaaagggcgacgtcatattctttaagactgctcctaacgtcgattgccatatcgggtttttctggggcgacaatccccgtgataataagatgtggcactcctcatcgcccgccaatcagatttcgtctatctacaactattcaaatccggccgagatcaatcagcatgtttgtctgattaaatagctgatggttaattacctttatcggcttggcccccgtcccccccaatctagtagactctaaaccgttgctagattagggggattttccatgaaacaggaggccacttaatgtggcctccgtcgtgagcaggactgtagagcaggaaacctaagccggtgtccccgctctcccggggccggcagaatctagttgttcagcatgcggtcgaagcttcccgagtcgccatcccgatagtcggccgtcatcaggatctcctgcggaattcgcccgccctcgcgcagcacgttgcggaactgcacgcgcgtgaccatgggcagatctttgatcgtcgccgccaggttctgcggcacgccctggttggcagctgcgggctcgcactcgccgccggccttcacgcggcgcttatgctcggcgagcatggcacgatacatgccggcatgcaggcggatctcaacgacattggcattgcgagcctgctcgacgatacgcgcgccttcgcgatcgatgtcgcccacgtagtagacgtagttaaagcgatagccgatctcggccagatagtcatcgagtgcatgcgagacgcttgccttgcagccaccgccgaagatgacaccgcctaccttagtgccaaaaagcttggcatgcttgcggccgcgcaggagcttgacgatctcgtcgtaggtgtccaggttctcgaccataatgaacggcttgtcggcacccagcgtaaagaagcccgtaaagtgcacggggcggttaggggcgaccttgatcgcctgcatgctgatgcccttttcggtcatacgcctgatcagacgctcgccgtgcttaccgtcaaaggctttctcgtcattgaagatctggtaggcgcgctggcgacgcgaggcaatcggcgtatcggcgccgcgattctgctcaatccaagcctggatgattgcgatctcctcggcaatcttgcgattggacatctcgttgtgctgagtgcgctgcggagcctttttaccgtccttgccctcgaccttaacgatctgagtctgctgctccttaatcttggagagcgccgtgggcgtgggaacgaccttgagcagttgcctgcccaaaacgcgggccagggcaaataccgaaacctcgccgtgagcagtcgtctcggcctgccgagcagcagcatctgccgcggcagactcgggcttcttctgagacttgcgcttggagtcgccttgagcgccgcgctcgcccttcggcgtagacgcctgcttttgcgagcgctcggacttaccctccttcgccgactgacgcttgggctgctccaccggagtgtctgccttcgcatcttcgtcgcgcgtcgttccctgttcggcagcagtctgggcatttgagccgcgaccgctacgatgacggcgacggcgaggcttgctcgaagtgccctcccccgtctgctcgctcgcaggctgctggccctgaacctcaacatcggacgcaaccttttgctcaacaggcttctgttcacgaacttccgactcagcgggcttctcggccttctcggttcgcgcctccggaacctgatcaaccttctcctgacgctttacgggatacgcgcgacccacaaagccacgaccgggacgacacgagcccgaggtcttcttggccggctcgtcagccgcatccacagtctcgacaggcttttcgacttcgcgcgcggcatcctgctgctcagccttaaagtgcgcaccgcgacgatgcttgggctcccgaggctcagcggacttttgctctttcacagactcctgcggctcggcgacaggctcgttctcgacagcctcgatatcggccccgtccttttgagccacggcacgacggaaacgctcctgctgggcacgacgctgcgcatcgcgcttgccgcctccgccaaagccgcctcgccccgccttggcggtgaaggcgcgcacgacatgctcatcgagtagctcgtcagtatcgacatgctcacgcggggcaacctcctccacagcgggcatctcaacggaatcatcgacggaagcctcttctgcgacctcggcaggctgctcctggacatcgtgaatctcagcattgatggtatagaacgcggggcgcccgttaatgccgctgccctcgatcttggtcacaatctttgccgcgataagctcatcgcgcatcgccttggtatcgcactccttatccacggagcggaaaatttgcgccagagcgctcgacttgatcttgagcgccttgcggcagagcaggtcgtaggcaacgagcttggcccgctcagcagaaagcgacgtctggctactcagacgctcagccaaagcatcgacattgttttggttatcggaatataccgtcttggccacggggcccctttcatatgcacacatatacgtctacatggtacaacgcgcgtgcccgtccacgcaaaacatctgcgagaacacccctggcatcgcccgtcttcacaagaaaaaagaccgggcccgcgttctgcggacccggtctttccgagtcatagagatggaggattctatccgtccgatcgactaggccttggcggcctcggcgtcggcaggagcctcggcggcagcggcgcgaccatactcggccttgcccatctcggaccactcgggctcctcgtcgggcatggaaccggcctccttgccgaagaactccttgaggcagttgacggcaacgatgaggcccaggaccatcagcaggacagcgaagacgagctgcaggcccttggtggcggcgacggagacggcagccgtggtggcggtagccgggatggtgccgaagaagccgtaggcctggacggcggtcatgcagcccatggcgctctggaccagcgaggtgaaagtgcagcagagcaggaaggcgacgggcacgtagagcatccagcccttgcggccggtgcacttgcagaacacggcgagggtgatcatggtcatgccgccgagcagctggttggaagcaccaaagagcggccagatgttagcatagccaccaaaggcgagggcgagaccgggaagcagggtgacgaccgtggcgaaccaggggttgccgagaaccttcatgtagccggccttggagtcgatggccagagcgtcgttggtctgggcaaagaactcggagaaggaagtacgggcgatgcgggcgacggcgtcgagcgaggtcagggccagagcggagacgttcatggtcatgaagacggtagcgagcgtgccgtcaacgccgaaagcctgcataccgcgggagataccagcggcgaagatctggaacggcgtggaagcgacgccggcgttgagggcaccggtaccggcggtgttcatgtcggagaacatgatgccggcgacgatgatggcgaggatgccgacgaaagactcgacgatcatggcgccgtagccaaccttgacggcgtcctgctccttctcgacctgcttagaggaggtaccggaagaaacgaggctgtggaaaccggagagagcgccgcaagcaacggagacaaacaggaccgggaacatcatgccggaggcagtggagaagccggtgaagaccggagcagtcatcgtagcctggccgttaacacccaggacgacgatgccgagaacagcgcagacgatcataacgatcatcatgatcgaggtgaggtagtcacgcggggtcttaagcatctggatgggcatagcgccagcgaagaccaggtagaccataacgacggcgaaccactggaacttgtccagatagaccgggaactgcataccgacggcaaacatgagaaccatgaggaccacgccggtgacgaactcggcagcgccggtgaggttgaacttcttctgggcccaaccaaagacgatagcaacgaaggtgaacaggatggagatggtaccagcgcagccggcggcataggacttggtgaagtcgacggcaccggtagcagcgccagaagcgtcaacggccggggtgaacatgaacgtcttgcagaccatgtcggtgaaggcggcgatgacgatgatgcagaacagccagcagaacagcaggaacaggcgacggccggtcttgccgatgtacttctcgatgagctgagcgagcgacttgccgttgttcttcatcgaggcgtacagggcaccaaagtcgtggacggcgccaaagaagatgccaccgacgaggacccagagcacgacgggcagccagccaaaggccatggcgacgatcgtacccgtaacaggaccggcaccgcagatcgagctgaactggtgcgagaacgcggtgaaggcggagacgggcgagaagctcttgccgtccttcatgcgcttggccggcgtgagggcctctttgtcaacgccccacttgttggccagccagcggccgtagcccagatagccgcaggcgagcaccgccgcagccacaaccatgagcaaaactccgttcattacatttcctcctctaaaaagaacttcccagacataaaaaaatgagggccgtcggttgcgctcgacggccctcatcttcatcagccgcccgttatcgtacgggctagctgtatgtgctaacccgcatcagataattactacgctgataatgtttagctgatgcgtgaacatgtctaagaaatcctcttcaatcatgatgcgaacgatccgtgcgtgttcacatcccccagtggatgaaaagcagtatgaaactttagttacctaaagtcaacgcaaatttgtaatgaattttcaacttttttgaaattctcggtataaaacgccactgacctcggactttatcctgcgacagtttttgcatgagagacgtccctgtgcgctgcgggggccgggcggcatatatgaactttcctgctctacagtcctgcgcaagacggaaagcacattaagtgctttcctttgacctacaacagcgcggttaacagccgcgtgctctaccattgagctaccgaggaataggtgcgtgctctcaagcaacgaagtttattatacggacgaatcagctcagggcaagaacttttttaagaatttttccgacctagtcattggggacgtccccaatgaccacatgaaagcgcccccaagcggatgtgcttgagggcgcttcttgcttgcgaggttatgactcgatgtagtccttcagcttgctgctgcggctcgggtggcggagcttggccaaggtcttggactcgatctggcggatgcgctcgcgcgtgacgccaaactcacgaccgacttcctcgagcgtgcggggatgtccgtcgacaaggccaaagcgcagttcgataaccttgcgctcacgatcggcaagcgaatcgagcacctgggtgagctgctcctgcagcatagagaagctggccgcatcgggcggaacgatagcctgggagtcctcgatgaagtcgcccagctgggaatcctcttcctcgccgatgggggtctcgagcgacacgggctcctgcgagatcttctggatctcgcggacgcggtcggcgctcatatccatctcggcaccgatctcttcgggggtcgggtcgcggcccaggtcctgaaggagctgacgctgcacgcggacgagtttgttgatagtctcgaccatgtgcacgggaatacggatggtacgggcctggtcggcgatagcgcgcgtaatggcctgacggatccaccacgtggcgtacgtggagaacttaaagcccttctggtagtcgaacttctcgacggcgcggatcagaccgaggttgccctcctgaatcaggtccaggaacagcatgccgcgaccgacatagcgcttggcgatggagacgaccagacgaaggtttgcgctgatgagcgcctgcttggcttcgaggcccacgttctcaatgcgcgtaagacgacgcatctcggcacgcgtgagttcgagctcaccagcatcggcagcctcgagcttctcggtagcctcgagaccggcctcgatcttcatagccagatcgacctcttcggaggcggtcaacaggtcgaccttgccgatctccttgaggtacatacggaccgggtcgccggtcagcatcaccgtggaggcatcgatgccacgcacgcgggagcgtgaacgggacgtgcgcacggtgcgcttcttcttgttcttggaagaacccatctcagcgtcggcctgacgggccatcttgagctcgtgatcgtcgagcgagccggaatcgtgctcgtcgtcgtcatcgaaatcgtcggtatcggtatcggtatcggtatcgtcgacacccatgggggcgtcgtcgttaccgctcgcggagataatctggatgccgctgttgcgcagcgcggaatacaccgcggtgagctgctcgtcagaaacatcgatatccttcagggcgacctgaatctcgtcctcggttaccgaagtcctgtttgagccgttgcccatgagctttgcaacgtaggattccagcccagtacccgtgctctcagtcttttttggcacagattctcccttcatagtccacaggactcaatactttagcacacacattgacgtctatacccaaaaagagggctggatataggcgagaatacgctggttgaccacaacatctaggcttgttcggtgcctgcggcctccaggccgatcaaacggaaagggtccgccacgccgccgatcgacttttgcagttcgcgttgacgctgcgaatcctgcgcggcctgcacggtcagcgcgcgacgggcctcatcatcgagtgaacggtcctggcgcagcttggcctgtgcggcacgcatgcgacgcttgatggtgtagagctcaagcgtatcaagcataaacacgatgttcgtctcggtggggtgcttgctcgtcgcggagatgcgcccggcactcacaagcgttgccgcatcgggacacactgagcgcgccgcatccatgcaggctgcaggatcggttcccggcggcgttgccagaacggcccatgcaatggactcgtgacgcgggtcaacccactcgatggagcagatgcggtcggcatacgtgcggaacaggtcggggtagctcgtgagcatcgtcaacagctcgcgctcccctgccaaggacttgcgttcaagatcggtaagaaccatcggcgcccccgcagccggtgcgcccgaaccgtcagccacaggcacagcgcccataccatcaggcacatcgatcggcggcaggtcgtcgacgacctccacgggcgcggcgccgtaggcatcgagcgggacgtagtcgtacggctcttcttcgaccggcgcggacaccggcggcgtcgcgcccgatgcccaagcaccgcgaccggcatcgcgagaacccgacgcccgaccgcccgcgctaccggaccgctcagtctgtgcccgctggcgctcatagttctgctcacgacgtcgttccgcatcctcgcgcttggcgacatcgcgaaacacacgacccgagctcgcgcgcaccgtctccagatccaaacccagcagatcggcaatctggataaagtacgtgtcgatcatatagctgttgcgcaacggatagataagcgtcagcgcatcttccagcgccttagcgcgaccgcccggcgtggtgatgtcactcgactcctgcagcgaacggtagacaaagtccataagcggctcggcagcgtcgatgcgcgtctgcagtgcctcgccaccatgtgcggtgatgaactccatggggtcgttgccgtcggggagcaccacgcagcgcaggtccatggaatcctgctcgataaactgaatcgcgcgacgggcggccttctggcccgctgcatcgccgtcgaacatatacacgatgcgcttggcaaagcgagtgagcgtcttgacgtgatgctccgtgagggcggtgcccagcgtggcgacaacgtttttaatccccgcctcccagcaggcgatgcaatcggtatagccctctaccacgatggcggtatcctgcgcgacgataaactccttggcccaattaaagccgtagaggtttcgctttttatgaaacacgctcgtctcggctgtgttgagatacttaggatggccgtcgcccataatgcgaccgccaaaggcaatgttgtgaccctgctcgtcaaagatggggaacatcacgcggtcgtaaaagcggtcggcaagctgcccgcgcccgcgactcacggcaacgttggcgtcgatcatctcctgcggggtaaaacccgcctgggacaggtgcgacaccagcgcgttacggcccggtgcaaagcccaggcagtagcggcggcagacgtcgccgcccatgccgcggctggcaaagtactcgcgcggacggccgtccttaccgcgcatgagcatggtgtggtagaactgggcggtctcggcgcacagatcgtagatgcgggcacgcttggtgccgcgctcgcggcgatctccggtgtcatgcagctcaatacccgcgcgatcggccaagtaacggattgactcgggaaagctcaggttctcgcgcttcatgatatacgtgaaaacgtcgccaccctcgccgcaaccaaagcaatgccacacctgcgtggcggggataatgtggaaggacggcgtcttctcgccatggaaggggcagcatccccaaaactcatggccgcgaggcttgagctcgaccgtttcctgcacgatggcaaccaggtcagacgcagcgcgtacctggtctttttcctcatcgctaatcacggatgctcaccccctgatcgcccaagttgtgacgaatatcctcgatattaccctcgacggtcgcgatcaactcatccagcgaatcgaacacgcgcgagggacgcagccagcgcgtaaacgccagcgaaacggaagcgccgtacaggtcgcccgtataaccaattaaattagcctcgagatgcgcagatgccgcatcgtcagcatacgttggcggcaggccgacgttcacagcagcgggccacgcggtgtcatcgaccagcaccagaccctcatacacgccatcggctggcacctgaatgccgtcgggaacctgcaagtttgccgtgggaaagcccatgccagaaccctcgtgacggccgcgaataacaccgccacgcaccatatacggacggccgagtaacccagcagcaagctccacatggccctgtcccagctcatgacgaatgcgggtggcgcaaatggcctcaccgccctcgcaaagcaggtcgtgaccatacacgtcaacgccgtgctcggaaccccaggagcgcatctcggcaacaccagaagcaccgccacgacccagcctaaagtcactgccaacgcgaatcgatcgaatgtcgaccagacgcgacaccagcgagagaaaatcaacatggtcaagcgccgcaacctcagacgtaaagggaacggccaccaccgcatcgaccccggtctgagccaaggcatgcagacggtcggccgtcgtcatcagtttttgagcgggcgaagggctcaccacgacgtccgggtcgggatcgaaggtaactactaccgccttgcagccatgggcacgggcatcccggacaagcgccgcaatgagctcctggtgtccacggtgaacgccgtcgaacacgccgatggcaatcgatgcggcacccaagtgctcacactcatcaaacgtatcggcagcaacgatgcgagcctcgtccgactcgcccgcgaaaaagacacgcgcgagctcatgagcggacaacatcatcgaacaccgccgattgcctgcggaaacacgtgctccataacaaagcggccactctcaatgcgggcgagcgccttgagtcccccatcgagcaccagcgcaaacagcgccttcgagacatcgaaatcggcaagcgcacgctcaacgggaatgcgacggccgcagagcaggtcgtcggcaagattgcccggcaagtcaacacgcatggcgcccaaggccgcaatgggatccagggcaaagccagcggcggactcgggagaaagctcctccaccgcatgacaggcgccaatggaaacaacaccagatgcggtgcgacgaagtgcggaaatatgcgcggcgctatcgcaagcgcggcccaggtcgcgagcgagcgcacggatataggtgcccttgctcaccgagaacgccacggtccacacacacgtatcaccttcgccgcccacggcaatcaggtcggcggcatagacctcgacggggcgcggaggtaggtccaccgcattgccctcgcgagcagacttgtaggcgcgaacgccattgaccgagatagcagaaaacgccggcggcacctgcatctgcgggcccagcatggcggccaagcgctcacgagcataggcaggatcgcggagctcgttggcaacagccaccgtgcggaccgcctcgccctccgcatcatcggtattggtctcggcgccaaacgaaatatcggcgacgtagcttttggtatcgagcgtgagcatgcccagcagacgggtggcctggcccacacccaccaccatgacgccagatgccatggggtcgagcgtgccggcatggccgacacgccgctcatggagggcgcgtcggcattgcgagaccacatcgtgggacgtgcagcccaccggcttatcgacagcgagcagcatattcagttgtgaaggcgtacgacgagccatgtaccatccaaaaagttaaagctcgacggtcaccgaagcgggatcctcccctaccagctcggccagcatgggaagtgccacggtgagcgtctcgagaattgttccgttgttggaaaagccggcggcggcatgatgcccgccaccgccaaaattggcagcaatctcggacacatcgaggtcgcccttggagcgcaggttgccacgcaccttggtatcgccctcaatgccctttaagaacatgcagacctcgacgcccatcaccgaacgcaccacatcgaccaggccgtcgcactcgtccgaggtgacgccgcaggcttcaaggtcgctctggtaggcatagctatacgccacgcgcccatgcgcgaccgtcttaatgcgacccatgacaatggacttgaggtgcaaaaactcaacgcgcatgctctggtagacctcgagcgcaacgcgcgccggatcggcaccgtgcgccaccaggcgcgaggctgcatggaacgcggcggcatcggcgttttggtactgaaaacggccggtatcggtaaccaagccacacagcaggcaggtcgcaacgccatcacgtgcgacaatgccgcaattgtccaagaagcggtcgatgatcatggcgcaggccgcggcatcgacgcgcctcaggctcagctcggcaaactcctcgcgcgccggatgatgatcgaagcacaccacatgcttggagcgacgaagcacctcggcggaattattgaggcgctcgacgaccggcacgtccaccgagatgaacaggtccggattgccggtatacgcagatgccggcaccagacggtcggcaccctccataaagcggtagatgcgcggaaccgggtcatcgtctgccagcagcagggcaatgtccttgttggggaaaaacttcatgagcgaaaggcccagacccaatacggagcccaaggcatcgccatcgggagaagtatgtcccgaaatcgcaatggaggacgcaccctcgatgagctcgaggatgcgtcgctgaatatctgcagactcgcacgaggcgaggtcggcggaattagtcatctaaagctgcctcctgggcggcatccgctatcggatagccgtcctcgtccttttcgatcgcaagcgtggcgggaacgttttccagcgcacgcgtgatgcgctcggcctcatcggtcgagcgatcgatgcgaaaatcgagctcgggcgtgacacgccaatcgagcgagcgagccaacaggctacgaatgcggcccttggcgcttgcgagcgcctccatgacctcgtcgtagcggctcgcatcgcacgacacgaacacgcgcgcgaacgaacggtccaccgcgacctcgaccgcggtcaaagtaaccaggtcgagacgcggatcggaaacctcaaagagcaggatataaccgagcttctcgcgaagctgctcgcccagacggcgggttgcctgcgtttgcttcatagcgctaccccctactcggtacgggcaacctggtcgatacggtaaccctcgatctggtcgccgggcttgatgtcctggaagttctccaggccaatgccgccctcggagccgctcttgaggctcttggcctcgtccttgtagtggcgcatcgaggcgatcttgccgttgaagaccacgataccgtcgcgcaccaggcgcacggaatcggtcgcggcgatctcgccctcttcgacgcggacaccggcggcgataccgactttgggcaccttgaaggtgtccaggacggtcgcggtacccgtggagacctcgacctcggtgggcttgagcatgccgatacgggcagcgtcgagctcctcgagacacttgtagatgacgtcatagcaacggatctcgacaccctcgcgctcggcggcggagcgggccttaccgtcgggacgaacgccaaagccgatgatgatggcgttggaggcgtcggccaggacgacgtcggtttcgttgatggcgccgaccgcggagtggatcgtgttgatgcgcacctcggactggtccatcttgtcgagcgagtcctgaagggcctcgatggaaccctggacgtcggccttgatgatcaggttgagctccttgacctcggcgtcggcgatggtctcgaagaggttctcgagcgtcacgtgcttcacgcggctctgctcctcgatacgggccttgagcgaacgctcgtcggcaagggcgcgagcctcgcgctcgtcctcgaacacgcggaactcgtcgccggcgttggggacggactgcaggcccaggatctcgacggcgtcggagggaccggcctcggtgacggcgttacccttggggtcgagcatggcgcggacgcggccataggtgaggccggcgaccagcgtgtcgcccacgtgcagggtaccgcgggtcacgagcacggtggcaaccgagccgcggcccttgtcgagcttagcctcgaggacgttgcccgaagcgaaggtgtcggggttggccttgagctcgagcacgtcggcctggagcagcacggtctcgagcaggtcgtcgataccgatcttctgcttggccgagatgttgacgaacatgttctgtccgccccactcctcggggatgatgccgtactcggtgagctcctggcgcacgcggtcggggttggcgcccggcttatcgatcttgttgacggcgacaacgatggggacgccggcggccttggcgtggttgatcgactcgatggtctggggcatgacgccgtcgtcggcagccacgatcagaatgacgatgtcggtcaccttggcgccgcgggcacgcatggccgtaaaggtggcgtgaccgggggtatcgatgaaggtgatcttgcggtcgttgatcatgacctgcgaagcgccgatggcctgcgtaatgccgcccgcctcgccggcagcgacgccggtgtgacggatagcgtcgaggaggctcgtcttgccgtggtcgacgtggcccatgacggtgacgaccggggcgcgcggcttgaggtcggcgggatcgtcgtagaacgagaaggtgttctcctcctcgggggtgatgatcttgatctgacggcccaggtcgtcggcgacgagctcgacgaggtcgtcggacatggactgcgtcatggtgagcggcgtacccagcaggaacaggcgcttgatgatgtcgttggccggaacgtcgagcgcctcggcgagctcctgaacggtaacgccctgggaaaccttgatggcgtcgagctcctcggggttcacgccctgggccagcgcctcctctatcttgcgctcctcctgagccttggcagcctcgcgctcgcgcttctccttgcgcttcttgcggcgaccggtggactcgcgagaggcctcctcgacggcggcacgagcctcctcgagcaccttctcgcggctgtactcctcggcctcgcgagccatgcggctatagtggtcctcttcgttgttgtgaccgcccttgcgcttcttgcccttgccctgcttatcggggttggggaagtccatgccggcagcgacgttgttgctggcgttggtgcgatggctgtgcggacggctctcggaggcgttacgctcggagttgttgtcggaggcgttgcgatcgttacgacggccaccgcggcggtcgttgttgccgccacgacggttaccgcgctcggcggcgcgctcggccttggccttgtcctcggcgtccttcttctccttgagcacggtctcctgtgcggcgatctggtcgagcagggaacggaagcgcgaaccggagtcggaagcgggaacggcgcggcgctgggcctcgcgggcagcctcctccttctcgcgggcaaggcgctcctgctcggccttcttcttggcctcggcctcggcgcgggcagcctcctcggcagcctgggctgcggcaaactggcggcgctcctcctcgcgtgccttctcggcggcgatgcgctcacgctcggcctcggcggcgcgtgcagcctcctcggcggcagctgcctgctcctcggcctgcttggcggcctcgacttcctgagcgcgagcctcgatcaccgaggcgagctgcttgcggaccatggcgacataggcgtcctccaaggtggaggaagcggacttagcgggaatcttcatatcggcgagatgacccatcagttccttagaggtcatgccgaactctttggccagggtggacacacggacttttgccatatgacttcacctaccctttctggcaccttgggtgcctagagactgaacgagcgtgggagatgcgccgggacctgcccggcgcgaccgcgcgctagatcaggtcctccgcatcatcgaaggcgtcggtgtcgtggataccgcagaaacgggagccgggacgggcctggttgcggcactggatgccgtcctcggacacgtactcgcagcgacggacgtcctcgtcctcctcgtcaccgatcaggtcggcggcgggctcctcgtgaacggggacgttcttgaggatgtcggcggcaagcgtctcggacttgatgtcgatgtgccagccggtcaggcgcgcggcgaggcgggcgttctggccctccttgccgatggcgagggacagctggtcgtcgggcacgatgacgccggcgtaggccttctcctcgtcgatgaggacgcgggtgaccttggcaggcgacagggcgttggcgacgtagacggcaggatcggcatcccacaggatgacgtcgacgcgctcgccacggagctcgcccacgacagcgcgaacacggctgcccttggggccgacgcaggcgcccacgggatccagacggtcgtcgagcgagtggacggctaccttggaacgctggccgggctcgcgggcgatcgacttgatctggacggtgccctcatagatctcgggcacctcctgctcaaacagacgacgcatgagctcggggtgggtgcgggagatgacaatcggcggacggctgtgctcgccacgaaccggctgcaggttggagttggggtcgcgaacgtcgatgatcacggccttgatgtgctggttgtgcaggtagcgctcgcccatcggacgctcattgcgctcgttctcgtaacggcgctggtcgaagtgcggcagctcggcctcgacgccctcgcggatcttgacgatcgtgaagtcgggcgtggactgcagcacggtaccgctgatgagatcaccgatgcggccggagaactcctcgtagatctgctcgcgggcggagttacgcacgatggcgttgatctcggccttggcgtgctgggcagcgatacggctcgtgttcttgggggtgacgtcgatctcctcgaactcggtgaagttgccctcctcgtccatggaatcgtcgatcggctccaggcggtagacgtagatcttgccggtggtgcggtcgatggtcaccttggcgccccactcaagatgcaggatctcggcatagctcttggcgagcgactgctccaggcggtcgatcaggtagagctggtcgatgtgcttctcctggcaaagctccatcagggcggacatcatgtcggatgctgccatcttactttccttccttcgcgggcttgaagtcgtaggtgggcttcaacttgcactttttaacatcagagaaatcgagggtaacggactcgccgtcctcgagctcgagggtcacgtcggtctcggtcgcagcggcaatcttgccggcgtacttgcgacggccctcggtggcggtggaggtgagctcacagttctcgcccacaaagcgggcaaagtcgcacgggcggcgcagtgggcgcgccatgcccgggctcgacacctcaagcgtatagctcgaagagatagggtcgagctcctcaatcacatcgccgacccacttggtgttggccgtgacgtcgttgagagacaggctctgaccctcggcaccctcgatacgcacgcgcacgcagggggccttggtggcgcccacgagctcgacgtcgacgatgtcgacatcgtgctggggagcgacggcctcgagcgcgtcgatgatcgcctgctcggtcttggtcttgaccattgcggcacctccatccatacaaaaaagaagcggggccgaaaccccacttctttcaattacaacttcatttgcaagcaaactataccaatagctgcggaaacgtgcaagcacagtacgaatctgcaggtcagcgtgcgcacaggttctccacaagaataggacaattgaccgaggaaccacatgcggcgcgccctcaacagtcccaaaacgggccatgcgtcccaatccacaggtctgttcggaccccaagggcattcctccccgagcccttatcgatcagacttacgctaagggacattccgcaacaagccggccagcaagtcgcacaacgacgaacctttccaaatcctctacggcaaggaggcacccatgaaacgcctaggcaccctctgcatgactgcgctcgccatcgcaacgtgctcgttggccctcgtgggctgcggcaaaacgaacagcaaaaccggaacatgcgaaccggatcccggcagcaccaaagccatcgaaaaaaccgaacccccggtgagcttcgacaaaatagacgaggacatcgtcgatccccagggtttgggccccgatccccaagaacagttccccatcgacctagaggcggacgagaacgtccatgttacctgcgtgggcaaggacacggatggctacggcgacgccgtattggtctttgcggtgacaaacaacaccgatgtcgacatgatgtttggcgatgtggactcctatgcctacgtcaacggcgtggtccgcgatgtgcgcatgcgccagcaggtcgcagcgggcgaggaaacgcgcgccatgctcacctttgtaggcaccttcgacgacccggactttgatgtaaacaacgacctcaacgacatctacctcaatatctggatgttcgaagaggcaacgggcaacgtttactttagggacctggtacacatcccgtagaagacggtgcgacgcactgactaagcaggtcatacaacacaaaacgagggacgacccaaccggatcgtccctcgtcttttatgcgtcagttaagcgcgcagtgcttacttgaccaccaggttgaccagcttgccgggcacgcagatggccttgacgaccgtcttgccctcgagccacttggcgacggcggcctcggcggcagcctgcatatcctcattggaggcattgcggcccacctcgacgcggccgcggaccttgccgagcacctgaacgacgatctgcaccgtgtcctcgatggactcggccaggtcgaactcgggccaggcggcggtataggcgttgccctcgcagccgagagcctcgtgccacagctcgtcggcccagaacgggcagatgggggcaagaacgctcacgatatccttagccacgccatagcacagcgccttgtcacgggaagcgacctcagtggcgttgaggtaggcgctcgccgcgttaacgagctccatgacggccgagatggcggtgttgaactggccgcgatcgaagtcctcggtgcacttagcgatggtgcggtgacgctcgcgatagagcttcatcgcggtctcgtcgagcgcggacttgtcgaaggccacgttggcgtcgccggactggacgagctgccaaacgatacgccaggcgcgcttgatgaagcggttggcgccctcaacggccttgggatcccagtcgaagtccttctcgggcggggcgataaacaggatcgccagacgcatggtgtcggcgccgaagggctcgatgaccgagctcgggggtacgacattgcccttggacttggacatggtgtcgccgttctcgtccttgaccatgccctggcacagcaggttggtaaagggctcgtccacactcaacagacccaggtcgcgcagcgccttggtaaagaagcggctgtagagcaggtgcagaatggcatgctcgatgccgccgatgtagttatcgacgggcatccaacggtcggcagcctcgcgggagaaaggcagctcggtgttgtgcgggtcggtatagcgcaggtaataccaactggagcaggtaaaggtgtccatggtatcggtctcgcgcttggccgggcggccgcagaccgggcaggtggtctcgtagaactccttgcactcggcaagggtctcgccggcacccaggtcaaggttctcgggcagcgtcaccggcagctgatcctcgggcacgggcacgatgccgcagtgctcgcagtggatggccgggatggggttgccccaatagcgctggcgggaaatgagccagtcgcgcagacggaactcgaccttacgacgaccgcagcccatggcctcgaggtcggccacgatcgcagcctcgccctcggagtgcttgccgccgcgcataccggtgtacttgccggactggacgagcgtgccctcggcagcatgggcgcaatcccagtcgacggtctcggcatggaaggtatcgatagtctcgccgttagcctcgacggctgcgcggtcgtcatcgtccaggatgatcggcacgatcggcaggtcgtacttgcgggcgaactcaaagtcgcgctggtcgccgcagggaacggccatgacggcaccggtgccgtagtcggcaacgacgtagtcggcaacccacacagggaccttctcgccgttgaccgggtttaccacatagcggcccgtgaaggcaccgtgcttttcgagggtgccctgggcacgctcgacggcagagatatgcttggagtcctcgacgatcttggtgacggcctcctcgtactccgtgccctcgacgagctcatgcaggccggcgtactcgggagccaggacaaagaaggagacgccaaaaagggtgtcggcacgcgtggtgaagacggtgatcttaccctcgtcgccctcgatgggatcgccatcctggtcgcacagggtaaagtcgacctcggcgccctcggaacgaccgatccagttggcctgcatctgcttgacgcgctcgggccagccggggagcttctccaggtcatcgagcagctcctgagagtactcggtaatcttgaagtaccactgctcaaggtcgcgcttctcggactcggtgccgcagcgccagcacttgccctcggtgacctgctcgttggccagaacagtcttgcaggtggggcaccagttgaccgggttcttcttgcggtagaccaggcccttttcccacagcttctcaaagatccactggccccagcggtagtagtcggggctgcaggtcttgaccatgcgatccagatcgtaggagaagcccatgcgcttcatcgtggcgagtgcctggtccatgttcttatacgtccaggcggcagcctgcgtattgtgcttgatggcggcgttctcggcgggcaggccaaaggcgtcaaagccgatgggatgcagcacgtcgtagccgcgcatgcgggcctgacgggccatggcatcgccgatggtgtagttgcgcgcgtgacccatgtgcaggtcgcccgacggatacgggaacatctcgagcacgtacttcttgggcttgctgtcgtcggtgtcgacggcaaagaggttggagtcctcccaggccttcatccacttggactcaatggcctgtgcgtcgtaagcagggatctcgtccttatgatctgtgcaatcgcacatatcagctcctttgttatctaggttggggcggggcgttcttacctttactcgctgctgcggacagtcctgctcgcacgaagagcacattaagtgctcttcggctcgtgcggaacttgcagtgagcaaaggtaagaacgccccgccacatcgttaactcgcatgatgatagcaaatacgacaagcgagatgcctgcgacttgcaggcatctcgctttatctaaaaagagtatgtacagggaaagcacgcttcattggatatgagccatcaaagcctcatgaaatgaacgatatacccatctgagttagatcaaacaaaacctagttctcaagctcagcctgttcggccttgttagggtcaaagaagaaccaagtgagcagaccggaaaccgcaatgccaacaccatggatgataaagtagttgatgatggcctgctggctgtacaggtaggtaacgattcccggaatagcagcaacgcccataccggtactggcagcatgaagcattgcgccacaccaaccagcgcaggcacctccgcaaagagcgaacaggaacggcttgccaaacttgaggttcacgccaaagattgccggctcggtaatgcccaggaatgcaggcagcgatgcagccatatagaagccacgctttttagggttctttaccttaagaccggtaaccaaggcggcggtagcctgggccataatgccaccggaaatcatggcattgaaggggttgaaaccggtggtagcaagatagtcagtttcgagcgcaaggaagatgtggtgcataccggtaaccacaatcgcctgctgcgttccgccaaggattagtccacccagaccgaacggcaacgcgataacgaacttcgcggcagccaaaacagcgtgttccacggtctggcaaacggggccaataacaagcatgccaagcaagccggcaatgaggatcgtagtaaacggagtgatgataagatccagaacatccggaacaacgttcttaagagtcttctcggtctttgcagcgatatacgcaacaacaagagcgggaagcaccgagccctgataacctacaacattccactcaagaccaaacggatggaaagtaattgcctcaaccgtacccttaaccacatcattcgggttaggaagaagcgggttcaccagcatgagaccaaggacgatgccgatgacggggctaccaccaaactgcttcatgcccgaccatgcaataagcacgggcagaaaggtaaaagcagttttcatcagaatggtcgcgatcgtcaaaacgttggggtccatctgaacgccaaacgagttgatgcagttaatgaagccgctaaaaaggcctgttgccactaggacgggaataacgggaataaagatatcgcccaaaatacgagagagcttcttggggagcgacatgccggcatacaggtcggccttaatatcggtgttaacaccgccctgattctcgcccgcgacaatatcgtaaacacggttaacaagaccggtgcccaaaatcacctgatactgttcgccggcgaagaattggcctttgacgccctcaatatcttcgattgttttctcatcgaccttggtcttatcatgaagcgtcaaacgcagcctggtcgaacaatgacccacggccctgatattgtctacgcctccaactgcagcaacaatgcctttggcaatggccttatcatcagttttcatggtctatcccctttcaaggaactcaaatacaaataactccgggtcgcattacggtcgagcagcggaaccatccggaagtctgcaaagaagccaactcaaatccttatcgacgggagggaactctgctgcgagattctcatcgatatccacaccgataccgggctgatcgttcagatacacatagccgttctcaacgactggcatgcccgggaacacacgatacgtgttctccttaatgctgcagctccactcttggataccgaagttcggtgaggaaatggaaaggtgcgtgttgaccgcatgcccaataccggacatatcgccaggaccatgccaagcggtgcgaactccattaacgtcagcgaaagcaatgatcttgcgaacgggcgtgattccacctgcctgactgatgtggagacgaagatagtcaacgcttcgattctgaacaagctgcatccactcatgcgggttgttgatgagctcgcccatggcaagcgggcaagtcgtatgagcgcgcacctgatcgaaccatgcgatttgctcgggagcgagcacgtcctcaaggaacagcaggtcgaattggtccatttgctgcgcgaagcggattgcctcggaaggcgtcaaacgctcatggacatcatggcacagctcaatgtcgtcaccaaactcgcgacgtaaggcagtaaagccctcaatagccgtgcgcatatacactttgggatcatagtatgcaccgggtagcgcatctttaggcttattctcaacaggaacgtttccgccatagccaccgatttgaacgcggattcgattccagcccgcatcgacgcgctgctggaccaaatcgattgcgccctctatcgtctgtgcatcggcatgaatatacgccggaacagcatcgcggcatttaccaccaaaaaggtcatagagcggcatgccggccatcttgcccttaatgtcccaaagtgccatgtcaatgccggaaagtgcattgttccagatcggcccgtttcgccaatatccagaaacatgtgcagtctgccagatatcctgaattcgcgcaggatctttacctagcaaaaagggcttcagatagcggtcaaccgcatgggcaaccgcctcataacgctgcgtaaacgtagcgcagccaacaccgtagatggacgggtcattcgtctccaccttcaccacaacaaggttaatgccctcgggagcagtgcagatgggacggacgtccgtgatcttcaaggaatccatttcgtcccttcccgattcaccgagactcgcattcgttcgcggtctcgtttaatgaggccaagtgtaggaggcgaatatcccagaaagacctgagaaagacgatataggtacatcgtccgtggttgggacgaattcccaccagctgggaaatttccacagctcgtttacctgcggaaacctatcgatgcgctcgtttgtattcggaatacttcaagaacaagatgctgacaagaagaaaataagcgtcgagcacttcgtaactatgtccgccaccaatcggtaggctctcggtaccaaccaagatgctctcatcagcaagatgagcgatatcgttatccagatagctcgttaccgcaataaaaggaacgtttctggctttgagatttcgcgcaagcgtagttgcattatcggattgtccttttagagaaaagacaaagagaagatcgtcttgagtcaaagcgcccgtaagagctgcggtctcatcaacgccttccacgacgtagaaatattcgtcaccagccaaaaacacgcgacgcatctcttgagcaaccgcacgttggagcgttcccgtgccgtaaagaaacacctttgagctctgctcgataagcctgaatacaggcgtgaaatcacgcgaaagaaagtctttaagcgattttaagacaatggcggtataacgatcgagaaccgcagcgtcgactatatcgcgagcatcagcttctacttcagccttgagggcgtatttgaactcagagaatccacgaaaccctaggcgctgagcaaagcgtagaacggcagattttgatgcgttgcacttggccgctagatcaacaagcgtcgaattagcagcctcgtagcgatgcattgagatatagcgccaaatgtcacgatctatgtcgcccaaatcgacgtaatggtcacgaaccagctcgtcaattttcatctcttatctcccctataaaaggcattgcaacgcaaacaataaaacgatagccgatttattcgaactagaaaagaaaaagtgccgtccgcaaatgaagcgggcggcacccttgattatcgacttcatccgaacacctcccacattcatccgcacatgtacggatgaatatgggaacccgataccctgagggccggaccggccggccccgggagatcggaggacggcatgtccggaaagaggaggaagggttccaaggacgcgaaggactggacgctcggtgagcagaaagccgtggccgaggacatcgccgcgaagggcgaggcattgcctgcgtacgccaaggcgaaggccgccatggatgccggcatcaagttctcgatggaactgaccgatggacggaccctcagataccgcattatcggcatcaaccacgacgaccttgtcgacggtagcggcaaggcgggcttgacgttccttaccacctcgaatagctttgcttcccgcgtgaacgccacggacaccaacgccggcggctgggagaagtcggagctccgtaaggaaatgaactccggtgagatctggaacctgatgcccgtcgatttccagtccaaggtgaaggccgtcaagaaactcacgaacaacgtcggcggcggcagcgcaaacaagaatgccgccgtgacggcgacctccgacaggctcttcctgctcagctactccgaaatcgtcgagaccccatatagcgattggtctgactattcatagattgaacaagagggaacccagtacgaggccttcaagggcaaggtgatgaatagccactcgggcaaccctgccattgccacaggcggcggttcgtgggagcgttcggtgcttccagacaactctgtgcgcttcctctatgtcgacaaccacggcacgccgtcgagcaacatctttgcgtcgagctatggttacgtctgccccgcctggtgtttctagtttcttttggtaaccgcgcgaacgattgtcgtcttgaagcatagttatcgggttgaggagaaaatgggtcatacagtggctcttagagcgcctgccgcgctcctccgccagtacctctgcggcgtcctcgtgtagagcctcatcctgcttggcgtttcgagttcgggaagtacgcggtgggtggataattgactcactcagatgacggcgctgacgggagcggccatggcgatgtgcgagattgcggtcaagttcgatgaggacgaaagagcttcgattcgggataatgcggacgccgcgggcatgtccttttccgagttcgtgagaagggccgcgctcgagaaggctgaggacatggcggacaccgaggcctacaacgaggccttgggcggggtccggcttatagccggatcccgcttttctatggctttcattcgtctgtctaaaggtatgaagcggttgactcgataggaatgcgggcaacgcccgaagcgggcgtcatggctgctctcagagcgcctgactctttcccccgccgctaccgttgccgcagcggcacgttacgggctgatcggttcgctctaacgtacgctcctgcatgcaatatcaatccccatacgaagggagtgtcgcatatgtatgcagcggcgcagaaccttcggggggggtatctcctagaggtgcccgcctccgagcccaatctatcatcgagtatgtcctgatcatcgcggtaatcggcctggtcatcgtgttggcgggaccaggcgtggccggagccatccgcaaccagttcaacctggtcggcaacacggtgaacaatgggacgaccggcggcaccgagggaggcgcgtccggcggcggctccacaggcgccgattccgcgaccgtccaggcggccgtcgccaaggaagcgaaggactggacactcgacgagcaggaggcggttgccaaagacctcgccaaaaacgggacttcgtctctcgcctatgccaaggcaaaggctgcgatggacgctgggacgaagttctcggtgaagctgacggacggcaagacgctgacctaccgaatcatcggtatcaaccacgacgaactcgcggacgggtccggcaaggcaggtcttacattctttacaacatcaacgaatatctcctcacgcatgaatcccgatggcaagactatcggcggttgggagaagtcagagctccgcgggaaaatgaactcgggtgaaatctggaacctcatgccctcagatttccagtccaaggtgaaatccgtcaggaagctcacgaacaacgtcgacagcggtatcgagaacaaggacgccgccgtgacggctaccaccgacaaactgttcctgcttagctattcggaaatagttgataaccccgaagtaaccgaaaatggcgctaaatggccgccgaacagttggctcagtaaagaagggactcagtacgaagtgttcagaacacccgagaataaaagtcaacttgggaattctttgagtaacggcgacgccttttgggagcgctctcttcgtccgacctactataatccgacggattttcttgatgtcctttcaggaggttgggcatcaaatgctcaaaacgcaaaatattcaaaggttgtctgtcccgcctggtgtttctagcttgtcttctagcttgtctagcgaaaagcccgcgcgaagtgaactgcgccccaaatcttggacgccctaaatagcgactaggccgcgagggcctgattccggtactcctccggggtcaggcccttcaatcttacctgcctccggctcgtgttccagtggactatgtattcctccaggtcgcgtttgaaatcctcgaacgtcttccactcgcggcccctgtagaactcgtccttgacgtggccgaagagctgctcggtggcggcattgtcgatgcagttcgccttcctggacatgctctggacgatgccggcggcctcgagcctggatgtgtacgaggcgtgctggtactgccagccccggtccgagtgcatggtcggggcggcgccctcggggatcttggacagcagcccgtcgagcatcctcgcctgctgggccatgtcgggcgtggtcgatatgtcgctcgccacgatctccttggtgcagaagtccagcgtcggggcccagtaggccttgccgccggccaccttgaactcggtgacgtccgtccccagcttccgccacggggccccggcgtcgaaatccctcgcgatcacgttctcgaacgtcctgccgacgacgcccctgtacgagttgtacctgtggtaggccgtctcgcgtctgatgccgcagcgaatccccatctcgcgcatcatcttgagcacggtcttgtcggctatcacggccccctcttccgccctgaggcacatcgctatctgccggtgcccgcagccgttggcggtgcgcgagaagatctcggcggccgcctcccggagctcggggcgcgtgggcctcggcgggtgcgcgagggcgtagtagtaggtcgaccgcttgagctcggcgcatgcgagcaggtgcccgagcgcgtgcccctcggcgcgcagggccgcgaccgcttcggccttcgccctggtcagagcccgtccctctcgaccagggcgcgtaatttttttaggtaggccacctcggcctcgagtctacggcaccgctcctcgagctcctcctcgcgggtccgcggcctcgccctggaaccgctcggccggcccttgggcctcgggcgcagggcctccgcgccgccccggcggtatagcgcgcaccacttcttgagcggcgacatcgacattatgccgaacgccgccatcgcctcggtcttcgtcatgccgccgtcgacgacggcggaggcggcggcgaccttctgctcgtatgtgtacctgccctgctttccgtccatgcgcagcagcacctcgctcccgaacgcgcggtatatctcctgccatcttctcacggcttccgcgggaagcgaaagggcaatcgcggcagatttatacccgtgcccgagctcgaagagccctatggccgccttcctggcctcgacatcatgcttcaccctcaaatcaacgcgcataaagaaagcctcccatttctcatgtccaagaaatgggaggcagttcaaagtcgtgcgggcttttcttttggcaaccgaacgaacggtttgaagttcgtggcacaggtaatcgggttgaggggaaatggggccatgcagcggctctcagagcacctgccacactcccctacgagctccgttgccgcagcggcaagaccggtgcagaaatctgaaatagccctaccctcgagccgtatctacaaaccctgagcgaagggagccgcatatgcatgcagcggcaattaaccttcgggggggggcgtgcgacgggggcgaggcgaatggctgagcggtatcgatatgcgggttcaacggtattatattgactacatagattattaacttgcttgacttgtaaacctagtcgtcctgtcatcatattcaacttcgaaaaaaggggaatgagggcatcccgatgcatcgagtattactggaaccccggcgatacgctgaatgatttgtgacgaatagtcatgtccatcaagaaggctcgacgcttcgggcagctcgtcaatcgatatatcaattcttggagacatgtattcctaccatttttaaagaaacaacggcggtaatcgctatcgcgattgcgccaataataccgagcgccatctatttatacttgatttaaggcggagtggaatgtgggcgcgcaaggagatgcggaatcgatgagagcctcaaaaaaaattactgcagtgttatcatctttcatcctctctattcttccatttctgattctatggacggcttggtcagtcctccctgatacaattcccgctcattggagtgggggtgtggttgatcgatggggtaataagcttgaattgctggttgttccgctgttttctctgattggttctattgcaatttctgtgtaccttattgtttccacgcggcgaagagagttcgcggatttctctgttcgaatgcgacgggactttgttgcgtgctatatttctagtcttcttttatcgacaacctgctcagtgataattgccgtttgggttcagttgattcttacgcaaagcactgcagttgatgggggacttggactatcgatcctgtattcccttcccgggctatatgtgatcttgtgcgctttgccgcctttttatgcgagcggcgagagcaaaaaggcagagcgcctgataacagttcttattggcggcgcggagattgttctttgtggaatagtgcttgaaggttcggctgcctcttatgcgatgattggactgatgattctgttctgtgcgtttgagattgtgtcacaggtaagggatagccggtccttatgagttgaattacgcgcgtgcggatataaagggtggcatgttaaatttgttgaaagctctgacatgcgctgtcgacttcattaaaatcgattgccgatcaagtcttcctatatatgcgagccccaagaaactgcgctgtgaacctgagtcctctatcgatcggcccggtgcaccgggccgctgtcctcgagccggcaacagcttgccggtctcaaaacgtatgccgtccggcacgaccgacggccgagtcttgcgccccgttcgggcagcgccagaaccccgtgccggaacccatgcggtcgattgcaggggaattcagccgaggccatcgaggagccgacctagggacggcgccctcagtcctcgaaggatttcaaccgccccttaaaggctcggattgatttaacggttgattcaatccggcagaatatgccgggcatggaccggttgacacaatgtaaggtaaaaagcagatgcggccgtacgccggtgcggggttcgggtgatgtgatagaaagaaatatacgtattacatctaaccaagaggtgcgtcatggcaaccgccaccgcagccctgagaatccccgaggaccttgcgaacaggtacgaccgcctggcgaagtcgacgggccgcacgaaaaacttctacatgacggaggcgcttgccgcagagataggcaggctcgaatacgagtacggcctcatgaattatccgggaagcgtttggttgcgagccacgccggtgtgagggcctgagtcgtcaggccccgcacagggggaccgcgatggtggccaccgcgccgcccgaggggctgttggcgagcgagacggagcccccgtgggcgctcgcggcctcggaggcggcgtggaggccgagcccgtagtggcggcctccgtcgcgcgaggagcgggaggagtcgtctgtgaagaggcgctcgcagccgcgttcgagggcggcgggagagaagcccggtccgtcgtcggacacctcgatgacgaggtgcccgcccgcgacgtcgcaggagaccgccacgcgcgagcgcgcgtgctcggcggcgttggccacgaggttcgcggcggctcgcgtcagggcggttcggtcgagcggggcctcgggcgcgcccgcgacagcggggcccgtggccgcgtcgagtgtcacgcctcgcgaccgggcgatctgggcggcctcggcgaggacctgctcgcagagctcggccggccgcatgggggccctctccgccccgccggacccgcgcgaggcctcgatgagcaggcgcacgtagccgtcgagcctttcgacactgccggctatgtcgcgcgcggcggccgcgaggtcggcgtctttctcgttttccagctcctctgccacgaagtcggcgttggcgcgcagcacggtgagcggcgtcttgaggtcgtgggcgagcgacgccacctgctcgcgctgcccccgctccgcggcccagcgggcctcgagcgactcggcgagggaggtccgcatggcgtccatcgcggcaaggacgtcgttcacctcgcgcacgttggtgctgccgaccgcgaagtcgagctcccccgcgccgacgcgccccgccgcctccgcgagcggcgccatcttgcgcgagatcacgcggctcgcgcggcgcgccacgagcgcgagcgcgagcgcgcttcccgcagcggcgccgacgagcatgaggttctgcgggttgggaagcaggccggcgaggtcgcgcgagacccactgcggcaggtactcgctgacgagtgcgcaggccccgccgcccttgagcgggaacgcggcgtaggtgaggcccgagcccccgccctcgatctccactgtgcccggatccgcggcgagtgccgcacgggccatttccgtcgcgtcctcgagccgcgtgccctcgaggtctgtcatcagcacgtgtccgtccttgttcaggatgaggtagcggtacgccgtcggcacgtcctgctgcccgcagacgccgtcgcgtgccaggccctccgcgacctcgcgcgcattggccggcccccagcttgcctcgtagacgaagcccgcgttgatcgccgcggagagcgccatgaacgaggcgagccacgccgtggcgaccgccgcgaacgcgtaggcgaagtagcgcgcgatgacgaaggagagcggcatgcccccgcgacctcgcgccccggtcctcagagctgccacttgtaccccatcccccagacggtcgcgatcggatcggcgccggcctcggagagtttcctccgggcgcggctgacctgcatggatatggccgcgtcgtcggcgtcgctctcccagccgagcaccgcctcgcgtatctgcgcgcggctcatgacctgcccggggtggcgggcgaggtactcgcagatggcgtactcggtaggcgtgagcggcacggcctcgccgcccaccgcgaggccgcgcgcgccgaggtcgatccgcacctccccgaaggagagggcgtgcgagcgcggccggcgctcacggcgcagatgggccgcgaccttggcgcgcagctccgcggccccgaagggcttgcggacgtagtcgtcggcgcccaggccgtaggcggccacggcgtcctcctcggccacgcgcgcggtcaggaagacgatgggcccgtcgaagtccgggcggatctgccgcacgagctcgaaaccgtcgagccccggcatcatgacgtcgcagagcacgaggtcgaagcgcgagaggtccatccccgggaccgccgtcgggtccgccgccctgacgacctcatggccgtcgcggccgaggacgcgcgcgagcgcgtcgaggatcgcccgttcatcatccactgccagtatcctcgccatgttcgacctcctgaaacttccgtcgaaattgtactagcgccgcgctcagcggtccagagccctgcgcgcagcgccgacccccagccggcgtcgagcaagtcattcccgcccaggacgagcgctgcggagaggaggacgagcatggcggcgagcggcctcctacgcatccgccctcccgtcctcgaagcggcagaaccaggcgagaaggacggcgtcggctaacagggtgagcacgaggccagcgagcgcagtcgtgaggagagggcccgccgcgcgtgctgcgtcgatgaaggcctccaccccgagcgaccccaggcgcgcgggccaggcgagcggcacccagctcaggggcgtcgccagggcaccggtgagctcgccggtcatgaggccgtgcgcaagtccgcccactgagaagaacgcgaggagcatacccgccgcgccggcgccgatggcggcgttgcggccgaggcgcagggccacgccgagccccagcgcgtagaggggcaggctgcccagcacgatgcccgcccaggcggccgcaagcggagcgggcccaagcggcaggcgcccggcaacggcgagcacggccccgaacacgccaagcgccacggccagcgcgcccgcgccgagcgccgcaagggcgagtagcttcgccgcgacggcgcgcccgcgcgaggggaccgccgtgaggttggcgagacgcccggcagcgcgctcgtcgtccacggtgagcccacagacgatggcggacatgagcggcatgagggcgccgaggaactgggcgtaggcgtccgcgcccagcgccgggtcccatcgggttacggagaagtactcgccgcaggcaagaccggctgccaggccgcagacgaggtgcaccgccgtgagcggggagcgcgccaggcgcagggcctcggagagcagggcccgcgggagagtcatgcgcggcgtcgggtcggagagtcgtgtcatggccatcacctctcctcggagcgcgcgaaccaggccgcgcccgccgccgtgagcgcggcgaacgcgagcgcgctgaccgcaaggcccgctagcgtgagcatgccgtccgccgcgagcgccccgccgagcgccatgtccgccgcgagtggctcgccgctcggcagcacggggatgaagctcgtgggtatgaccatgctcgccgacggcggaaagagctgcggcagcggcaccagcgaccaggcgaacccgcccacgagctgcgcggcgagcgggcagaagatgcccgcgagcattccgagccgcgccgtgaggaagagccctgcggggatcatccacgccgcggtcaccgtgttggcgagcgcgcagaggagcatcgtgagggtgcccgcggccgtgaggccctgcgaggagaacgccgatcccgcgaggtagatgccgaagaccacgaggttcgagagcgtgcagagagcgaggcaccagagcgccttggcccaccaggcgcgcccgagcgggaagcccaggcccagaagcccccgcatccgcgtgcgagcgtccgcccgcgcgacgcacgccaccacgagcgagagagacacgggcaggaagagcgcgtaccagtagttccacgcgctgaagatctgcacgccccggtagggcatcgcgccgagcagcggcatcggcagcgccatgagcacggccaggcgaaccggtgccgcgtggcgcgacttcagggcctcggcgcgcaggcccgcgagcaggtcgcctttctcgcccgtcatgccgccacctccccgcgtgctcgtcgcccttcccggcagaaactcatgaagagttcctcgaggtcctgcccgggccgaagcgcatcctcgtaggcgaggcgccctccgcagatgatgccgatggtgtccgccatctgctgcacctcggagaggatgtggctcgagacgatcaccgtcgtgcccgccgccgcgaagccgcggatctggtcgcgcagctcctcgatgccgatggggtcgaggccgttggtgggctcgtcgagcacgagcaggcgtggccgggcgatcagcgccagcgcgagccccaggcgctgccgcatgcccatcgagaagcgcccggcgcgcttcttcccagtgtctgcgaggtccacggcggcgagcacctcatctatgcggctctcgggaaggcccagcagcgtggtgcgcacgcgcaggttctcgcgcgcggtgaggttggggtagagcggcgcctcctcgatgaggctgccgattgcgtagaggtcctcgcggcgccaggcgtgcccggcaaagaggatctccccggccgtcggccgcagcatcccgcagatcatcttgagcgttgtcgacttgccggcgccgttggggccgagcagcccgtacacctcgccctcgcggatatgaaggctcacgtcggccacggcgtcctgcgcctggtcgccgcggccgaagcgcttggtgagcccgcgcgtctcgagcatgtaatccatgggcttatcctttctcttccgggcgcgcgggccgagtcgccgtgcccgcgcgccttacctttcgggttcaccatccatgatggggcgcgtttctaacgaagccgtaacggccgttgggctcttttggtgccagcccttctcgacccgtacgcatttgcttaaagcaacaactttcccgatcgatgtaatcaccgaatcaaaacgtgtacaccagccaccaaagatgccgaaaaatgtcgcttttggaggctgatgtacacaaatgcagaatccagcgcagcccagaggcgccctccacatgtctggactctctatggctgcgctggatagacatcgctggaacgggtatagtatcgaaagttttgtcgttaaccagcgggggagtcctgtggacatcaaaaagaagatcaaaaaggagcttatcggcacttccgattacccgtcgaataagatctttacgatctccaatttcatcacctttacgcgcctgatcctcaccctggtatttctgtacctgtttgtgacggataacaaccgtgtcatcgccatcgttatctacgccgttgccgcctccaccgactggatggacggtcagatcgcccgcatgactaagacggtctcgtggctcggcaaggtcatggatcccatttgcgaccgtgcgctgctgttcaccggcgtacttggactggtggtccgcggagagctgcccatctgggtctgcgtactcattattggccgcgacatctatctgggcatcggcacgcttatcgtgcgtcattatcaccgtcgccccatcgatgtggtctttcccggaaagattgccacggcgctgctcatgaccggcttctcactcatgctgctcggtttccccgttattgacggcctgcaccttttatcttcaacccttacggccttcccgggcctcaacggaagctcggtgcccctcggcatcttctttgtgtacggcggcgtgatcttctccatgctcacggctgtcatctactccattaagggcggagtggccattaaacaggctctcgcgcatcccgaggacgaggacatcgactttctgaaccctgaaatcgaagactgattcgttggggtatgattacgtacggttcattatttgcggcacgtccgcgataagttaggggttgtcatggacaacatggttaacaatatgcctcagaatgataagactgctgacgctacctgcgtattccgcgtgccttcaagcgacgtcaccgttcccgacctcatggccaacgtgcgcatcaccgcccccgtcctgtccatcgtcaagggtccgcagactggtgccgcctttgagctcgaggacgacgtgaccaccatcggccgcgatcccgcgaacggcatcttccttaatgacatgaccgtttcgcgcagccacgcgcgcattattcgcgagggcctcggcgctcgcatcgaggacctgggctcgctcaatggtacctgggtcgacggtgccattgtcaatgcagccccgctgcacgacggttcttccgttcagatcggtacgtttacgctcatctaccacgagagcacgccggagcgcatcgaaaccggtgagtagggcatggccgaacgcaactatctgagtatcggccaagtcgtcaacctacttcgaggcgcataccccgatctttcaaactcaaaaattagatttctagaggatgaggggctcattacccctcatcgtacgcctaagggataccgtcagtactctaaggaggacgttgatcgtctggaggtcatcctgcacttgcagaagacccgctacatgccgctcaacgtgattaagcagcgcttggaaaacgccacggacctgtcaacgctcgcctacgaggtgggcttgctatccgatgttccgctcaagacggagcccaaggagactaagcaaaagctgcatcccatcgagaccattcccgatatgttgggcgtcgaaatttcgtttatccgctcgctcgccgagaacgacctcattcgcatcatcaagagtccgcagaatcgcgagcttgtcgatggtcgcgattttccgatcatccgctactgctccgagctgtcgcgcttccatatcgagccgcgcaacctgcgtcagtacgtgtcttccgccaaccgcgagtcctcgatgtttgagcaggtgcttgtgagcatgctcggcatggatacctccgatgacgagcgcgacgccaagctcgagcgtgcgtttaagaagcttcacgacctgacggagggcgtgcacaccgcgctgctcaagaaccgcgtttttgagtcgctcaacgccgtggtcgaggacgccgacatcgatgcactcgatgaggaaatcactcgctccgagtccaccaaggccaaaaacgaagagatagccgcgccggcttcgcacaaggattctctcgtcaagccgctcaaggtcgtccccccttcgcaatccggcaccgccaccgcgggcaaataaccgctgctgaaatttcgggaacccattgaaaggtcatgcaatgtacgacttcgaatctcaaatcgtcgacatccccgactatcccgagcccggagtcatctttaaagacatcacgccgctctttggcaatcccgaggcgctcaaagccatgaccgatgccctcgccgagcactttgccggcatgggaatcaccaaggtcgtgggtcccgaggctcgcggctttatggttggcgtaccggtagctgtagcccttggcgccggctttgttcccgcacgtaaaccgggcaagctaccgcgcaagactgtgagccagagctacgagctcgagtacggaacggattccattgagatccatgccgacgctatcagctctaaagataccgtgttgattctggacgacttggtcgcgacgggcggaaccgtcgaggcaacaggtaaactggtgcgagatatgggcgcaaagcttatcggttacggttgtatccttgagcttgcgtttctcaacccgcgcgagaagctcacgccgtctgatgacgatgtggagctctttagcctggtgacggtggactagccgttacccttagttactggaaaggaagctacatgcgcacagcaaacacgcacaaaaacatggcacgctgcgctgctacggcaaccctcgcttgtgttttgggcttgggcctcgcggctcctgcctacgccgataccgcatccgaccttgccgctgctcgtacgaagctcgagcagatcggtacccaaactcagcagatttacgatgagctcgccacgcagacgcaggcgctcgatcagactgccggcgagatcacgcaaaagcagcaggagatcgccgatggtcaggctaagctctcaacctatgtcgccggcgagtacaaaaccggcggtctgagcctgcttcaggttctgacgggtgtcgatgacctgagcgatatgctcaaccgtctgttctactacggcaaagtttccgataagcaagctcagaccattcaagaggtcaaggagcttaagcagcagctcaccgataagcaggccgagcaggagaagaacgtcgccgcgacgcaaaagaaggtcgacgagctcaatgcccagcaggctgaggctcagagtgtcgtgaactccctggattcgcagctgcaggccgagctcgctgccgaggccgaggccaacgctgcgctgcaggctggcattaatgctagcaccgccgaaaaggccacggtgagcaacgacaccgccggtacgaccgagaacaccaacaatggcggccagaccaacaataacaacaaccagggcggcaacacgccggctcccgcaccgcagcctgcccccacgcccgctccggctcccacgccttcggcaccgagtcagtctgttgatggtggctccgttgtttcgcgcgcctacagcaagctcggctatgcgtattcttggggcggcattggaccgaacagctttgactgctccggttttgtaagctattgcctcacgggacgctactgccgtctgggcaccacggtcgacttcatgggttggacccgtgtgtccgatccgcaacccggcgatgttgtggttaactcctaccataccggcatttatatcggtaatggtcagatgatccatgcttccgactacaaaacgggcgtcatcatcagctccgttgccgccggcatgaacaacaactatatcttcgtgcgctactaagtcatcttacacagcgtgtgaatgtggacctcgtggcttaaagtcgcgaggtctattcttttgtctctaatcttgtacggctatctagtattcaaaactagatagccgtacattcggtttgcaagaaggctataattgttgaggaacaattagaaaggaccctctatgagctgggcacttatctcagattcaagctgtaacctccgcgattggcaaccgaccgcgccccataccacctttgcatttgcgcccctcaaaattcgagtgggggagcgtgaattcgtcgatgacctttcgcttgatgtacatgagctcaactgcgctgttcaggcggagacgaacgcttcttcgagcgcttgtcccagcgtaggggagtgggccgagctcttcaaattggccgacaagaccatctgcatgccgatctctgagggcgtgtcgggcagctacaacgcggcagccacggctcgcgatatggttcttgccgaggagcccgaccgacagattcatctagtcaattcacgcgcagctggcggcaaaatggatctcattttcttgctgttcgaccgctatcttgtaagcaacccggatgtctcattcgaggatgcttgcgcatacttcgatagccttgaacagaacagcaaaatcctcttcagtttgtgcaattacgaaaacctcgccaaagccggacgtatccctaaggcagccggcgtcattgccaacaagctcaatatccgcattttgggcacggcgagcgaggccggtaaaatcgaactcgtcgggcacacgcgtggcgaaaagaagatgctcaacaagatcatcgacaccatggaagccgagggttttacgggcggcgaggtcatcatcgatcacgttgagaacgaagctggagcccaggcgcttactgaccgcatagtcgagcattggcccggctccaagaccatcatcatgccctgcaacggcctggattcctattacgccgagatgcacggcctcatcatcggctacggcatgggcgtagcttcgggcaagtaaagtccaaccaagcaaaaatatgggcgggacaaagcgacagatggctctttgtcccgcccgttttatacgtcggctagctattaaacccattaaactttagatagctcatcaggtacgctttcgaaacgaaggatgaaaccgcactgcgcacaagcagcgactcacgcgttacctgatgcgccgtatcgggaaccggcgtctgctcgacggaaaacgccgaacgaatcgatgcctcgagctgatcgaccacataatcgaaggccgtcggggcatcgtagctcaaacgctgaatgttaaagagtgcctgcaccgcagcaataggtaagacctgcttaaagaggcagatagcgatcaggcgggcaatctgctcgcggccatattgctttttgaccggagcaggcaccaggccgaccttcacgtagttattgatcatcgatggcgtaatgacagggtgctcaacgcaaatggacagcggctccatccacagcgcaacatactcaataacctggtcgcggtagagcgtcacattgggcaactggtcatagcgcggcagactcaacgtattgagtttgcgcacgatttcggactgaataaatgcatcgggcagcacagtgggctgaatatcctcaggcttaatgctgaccgacgaatcggacatcggaataacgtgtttaacgtggttcataaaggtcctccgttcattttctatattgtattctaggttatctagttttacataccacatagccggcaagtaaaagtggttggacaacacattgatgcatcgtccaaccactttgattaaagatagcaaccttacataagatatattatcgtacttatccacggagaaacgcgtatgtgctcgttgccgctatggctccgtccgaaacagcggtcacaacctggcgtaaacgtttggaacggatgtcgccagcggcaaatagacctggcgtgcgggtcgccatggattcatcagtcagaatgccgccatcaggcgccagatcgactagatgctcaacaagctcggtatggggctgcgttccggtaaaaacaaagatgccaaacgagccgggctcaaatgactcggtatgagtctcgccggatgcattgtccttaaaggtaatcgtcgttggcatggcttcgcccgatagctccacaatactagtttggtacctaactgtaatattgtcctttgcgagtactttctgaacaacaccatcgggcgcacggaactggtcgcggcgcagcacgatggtcacactgttggcaatgtcggacaggaacagagcctcttcgcatgccgaattgccaccaccgattacaaaaacctgcttgccgcggaaaaacatgccgtcacatgttgcgcaatatgaaacgccacgaccgcgatacgtatcctcgcctgcgaaacctgccggacgcggcgtggcacccatgcaagcgataacgctcgaggccagcgtatcgcccatatcgtgatgcaccgtaaacaacgctgcatcggcatcgtaatcgatacccgtaaccatgctccatgcaacctgtgctcccaggccctctgcatgctgctgaaaacgctcgccgagttcggcgccactcaggagcgggaaacccggatagttctcgacctcattggttgtggcgatctgccctcccgacatgccctgctcaatcacggtcgtcgtcaggttggcacgcgcagcataaatagcggcagcatagcccgcggggccgccaccgataatcgcaacatcgatcggcttatcggtagtcatgaagcgtcctttcgtcgaaacgttgtcgttctttgcgctcatacccaaatttacgtgaacgtgacactcatgcactacaatgataaatccgtattacaaacctgaaggggagttatcgatggaccaggcgcagacgagtgacgacgctcccctgctcacgcacagcactccccaatcggagcaaaccacgctcctggctcagcaaaaacctctcgtgaccatcgtgcatgcctccgttggctcgggccacaaggccgccgcaaatgcgatagcgcaggcattcgacctcatccgcggcaccaatggcatccccgaggatattgagattgaagtgctcgatatccttgattttggacgtattaaattcgacggcaataagaccgcggcttcttttacgggagccacgcgccccatttacgacctgacctggcgatatacgcttacgggacatcttctctggggtggcggaacggcatggtcgcgaattatgttccccgccttcaacgaatatattcgtagccgcaggcccatagccgtggttgcaacgcacatcacagcagccaatgttgccgtgggcgcccgcgtaattacgggtatcgattatccggtcatctgcgtaccgaccgactacgaagtcgagggatggtggccccacaaggacaccgatttattctgtgttgccaacgaatttatggccgaaacgctgcgtccgcgcaaggtgctcgagacaaagattcgcattaccggcattcctattcgcgccggattcgacacggattacgatcgcgaggaagagctagctaagttcaacctccccaccgagaagaccgtcgtgctggtaatggccggtgccagtttgcctcaaccgtacgttcgctttcgcgcggagatggaccgcaccctccccttcctacgcagcttcgaagacatgcactttgtctttttgccgggcaaagacaccgaatatgccacccgcctcaaaacgctcttcgacgccatgaagctcgaaaacgtcacggttctggactatgtcgatgatatggcagcgcttatgcacggctgcgacctggcaattctcaaatcgggcggactcacggtcaccgagtgcctatgcgcacatctgccgatgattctgctgggcaagtcctatggccaggaaaaggccaacaccaccatgctcaccggcatgggcgccagcatgcatgtcaccaccgcacgagaactcatcgtaaccctgcgccacctgcacgaccatcccgaatcactcaaagcgctactcatcaacggcgaagttctacgccgcccccacgcagccgaagacatagccatcgcaaccatggagctcgtaggcaaaccccaaaagcgcaaaagagccttttgccgcttctactggggcggaaaacccgcgcatatccgctagcgtctttatgtccgcttacctgcgggaggcccctatatatcatcccatgctcaaacattctcgcttcgctgcgaaactgcgcgtgggacgatatataggggcctcccgcaggtaagctgcgtttacgtactagcagctataccagattccccaccactagaaccttcaaaggcgaaaccggaaaatctaaatacagtaagccaatgcgacaaagggattgttcctttgtcgcattggcttactagaatgtaaatattttttcaagcgagtagccgcccgcccgcctctcacacatatcgttccacgcgcagtttcgcagcgagcgaagcgaagcgagaatgtttgagcatggaatgatatgtgtgagaggcgggcgggagggatacgagcgcccctaggcgatgccgctggagccgaagcctcctttgcctcggtcggtttcgtctagttcgtctacttctacgaggttgaccgtggggacttcttggatgacgagctgggcgatgcggtcgcctttgttgatttggatgtcgttggtgggatccaggttgataaggataaccttgagttctcctcggtagtgggcgtcaatgaggcccggcgtgttgactatagacaggccctgcttgatggccaagccgctgcggggctggacgaagccggcgtagccgtcgggcagggcgatggccagcccagtagagaccagacggcgttcgaagggcttcaggacgcagtcctcgttggagcgcaaatccaagccggcatcagtgggatgggcgtatttgggaagctcgacggtgggatcgagacgctttatgttgacggtaatgttgggcatggaatcaccttagcttgtcgagctcttgcagaaactcatcgacgtctttgaaatcgcggtagaccgaggcaaagcggatgtacgccaccttgtcaatcttggccaagcgcttgagcaccatgtcacccaactcatgggacgtgacggccgtcagtgtgcgagagcgcagctcgacctcgatgtcatcgataatctcattgagcttcttagtgtcgatatcgcgcttgatggtggcgcgcatcaagccgacgagcagcttattgcgatcgaaccgctgcttagttccatctgacttaatgacctcgatagggtcctcgcatcgctcaaacgttgtaaagcggtagttacacgagcaacattcgcgacggcgcttaatggtgttatttgactcctgcatacgggaatcaacgacgcgggtatgtgccttgccgcatttgggacagcgcatggtacctcctcttaaacgataacaagggtaccatgcgcagcgcgataatgattacgaacgagcaggaaccttaagatgcgcaccggcggcgagcgaaccatgctccagatgattgacgctacggatcatgtcggaagtctcttgcgtggaaaggccttcgattggatattcttcggcaatcgaccaaagagaatcgccaggctgaacgcgaatggtctcgtaggtaatgttggaaacggactcggcatacgcggcgtgacgagtgctaaagaccgacatagcgaggacaaagaagagcgtaagcgcaacggcgacggcgacaatcgtcggaaccttcagggcaacgcgggccggcgcgactacagcctgctgattgcgcgcaggctttacggtcaaagactgaaagccggagcggccaccctgaacaaccgtaaaagtgggttctgcaggcgtctcgagcttaagggcgaggtttccctggaccatattcgttacgttcatcatgttctcctctcgcgtgttttgctgagaacagttttatcaagccgcgcggacaaaaatgtctagcgcgagaacgaatgttcggttattattatcttcgaacagttgttcctgtcaagcagaattcgaacatttgtttgacatgggtagagaggatgccctgatggctcgcaaaattaccaagcgtcagcagcaaatttacgacttcatcaaggaatatcagcaggagaagggttatccgcccagcgtgcgcgagatggcttctgccgtgggcctttcctcccccagcaccgtgcacgcccatctctctgcccttgaagcgcgcgggctactcaagcgcgatgccaccaaaccgcgcgccctggaactctttaacgaggatggttcctctgtctcaatttctaaatctgacgagcccaccgcacctcgcggaacggtctcgctgccgctcgttggtcgcgtcgcggctgggattcccattctggccgagcagaatatcgaagacacgtttactatcccgaccgaaatcgccactgatcagggttcctttatccttgaggtgcatgggagctcaatgatcaatgtcggcatcttcaatggcgattacatcatcgtccgtgaacaaaaaagtgccatgaacggcgaaattgtcgtggccatgattgatggttcggcgaccgtcaagacgttctataaggagcagggacgtgtgcgcttgcagcccgagaacgacgctatggagcccatctatgcgacgaaccccgttattttgggtaaagttgtcggtttaatgcgccggttctcgtaatgcaaaaacgcatcaccatctttgataccgtccgcgggtttacgatgatttctatggcaggatttcacgcttgctatgatctcgcctacctgtacggctgggatatgccctggtttacccagtcagtctttcaagacatctggcgcgccagcatcagctgggtatttttgtttatcgccggttggatgtgcaccctttcgcgcaacaatatcaaacgtgccgccaaatacgccttagcagcactcgttgtctggttggcaacaacacttgtctcagtcgacgattcggttaattttggcatcatctactgcatggccgcatgcaccggcatcgtagcgttgaccgatcccgtccttaagaagataacggcgagatggggcatgcccctatgccttatgttgttcgcaatcacctggagcatccccaaaacgatctaccctgtcccctacctggcgtggtgggatttccgagccctgggtttatctcaggtgattactaccccatcatcccgtttatctttatgtatcttgcaggatacttcgccgcacacatagcgcagggaatcgataagaccgtccctagctgggcctacgccaaccccctgccggcgctcgccagccttggacgccatgcactccccttttatctactgcatcagcccatcattctgggcattttgaagctcatctactcggtacgataacgctcaagccgcggtgcaatacgagccggcagtttcgccacaatgcgaacgccgtcctcgagatattcctcatgcagaagggttccctgctcatgcaccagcgtgatgagagcgccctcgcgatacggaatatcagcggagagcaacacatcggtggcagctgcctcgcgagcaatacggtcgacgagatcgtcgagtccctcacccgtctgggccgagaacagaacggcttcgggataacgacgacggaaactcaatcgatcgacgctatcgagaagatcgattttattgaatacggtcagcgttaaacgctctccggcgccgatctcatcaagcacgcggtcgacagcctccagctgccgctcatagtcctcgtcagacgcatctacgactttgagaattagatcggcacccaacacctcggacagcgtcgatttaaaggcatcgaccagaccatgcggcagcttttgaataaagccgacggtatcggtaatcgtcatgccgcgaccgccgggcaggcgatacgaacgcgtcgtagggtcgagcgtagcaaacagcttgtcctgcgaaagtaccgtagagccggtcagacgattaagcaacgtcgatttaccggcattggtataaccggctaacgcgacgcgaaacgccggtgactcaatgcggctcttggattgaacatcgcgacgctgttcaacctgcttgagctcacgacgaagcgcagcgatcttattacgaatgaggcgacggtcgacctcgagctgactttcgccctgaccaaaacgtgagccgatgccgccgcgcgtctgctccttggcgagatggctccacatgccacgcaagcgaggcaacaaatattgaagctgtgccagctgtacctgcaggcgtccctcacgcgtctgagcatgcaggccaaagatatccaggatcagtgctgtacgatcgataatctttaccggctcgcccacggctttctccaaataggattgctgcgagggggtcaggtcgtcgtcaaaaataacgacatcggcatccatgcgatgcaccaggccgcacagctcttcaaccttaccggaaccgataaacgatttaggatacggctttaccaaacgctgcgacaagcgtgccacgctctgggcaccagctgtgtgggcaagacgctccagctcatcaagcgagcgatcgagcggccatgcattgtcgcgccactcaacaccaactaaaatggcacactcgggctcgggtgccgtgggaacaagggggaaacgggccattaggcagcctcaatacgatgcaggatatcctcaacgacctcatcgatcgtacattcatccatatcaaaccacacgatacggtcatcgcgcttaaaccacgaaagctgacgcttggcataacgacgcgaacgcatcttaatgagttcgcgagcctcatccatgctcatcacgccattgaaagcatcgatgatctctttatagccaattgcctgcatcgacgtcagggcatcacccagcccctggtccataagaccgcggacctcatcgacaagaccctgctcaaacatcagatcgacgcgcagattaatgcgctcgtagagcacctcgcgattacgcgtcagaccaaaccatagggcatgataatgctcgcgcggaacactaaactgcgacttttgctgcgcataggagacgccatcatcatgcatctcgagcgcacgaatcacacggcgcacgttatggggatgaataacagcagccgattctggatcgcgctcggcaagcaaggcatgcagttcttcctcgccaatacgctcggcaagctcctgatagcccgcacggcgatcgtcctcaagttcacccgagggaaagtccatctcatcgagggcggccttgagatacagccccgtacctccgcaaaaaaccggcaggcaacacgaaccaaggagacgttcaacatgcgcgcgagcgtcagcctgataaagcgcagcagaatatgccacacccggctctacaatgtcgacgagacgcagcggcgccgtgcactcatcgggcgccatctttgcggtaccgatgtccatgccacgatagatttgcatcgcatcgcacgacagcacttcggacgaaagacgaactgccaaacggtcggcaacatcactcttaccaaccgccgtcggaccgacaatcgcaacggcggaaagacctgccccgggagaaaccattagcgcggctcgcccacaacggagccggacaaataccaggtcttggcaacgtcaacgtcaacatcaacgatcttaccaacaagctgatcgatgctgtaaccctcggggataggcgcatgcacggtctgattcttgggactcttgcccagcaggaccgcgtcgttctttttactcgttccctcaatgagcgccggaaccacagtatgaagctcaccctggttatactcgtgtgccgtggtctcgataaccttaaccagacggttgaaacgctcgagaataacctcatgcggcgtaggatcgtcaatctcggcggccggggtaccggcgcgcttggaatagatgaaggtataggcctgagcatagcggaccgtctcggcaagtgagagcgtctgctcaaagtcttcttcagtctcacccgggaagccaacgataatgtcggtcgagagcgcgatatcgggcatgcggttgcgaatgcgatcgacaaggcccagatagtactcgcgtgtataacggcgattcatctctttgagaatccgcgtcgaacctgactggacggccaagtgcagctgcggcataacggcaggcgtctcggccatggcgtcgatggtctcgggcaacaggtccttgggatgcgaagacgtaaagaagatgcgctccacgcccgtatcgcccacggcacgcagcagatcggcaaaacgcggcttgccaaacagatcgcgaccatatgagttaacgttttggcccagcagcgtaatctcacgcacgccctggcgcaccaaaccggtcacctcgtcgacaatctcctcgaaggggcggctcttttcgcgaccgcgcacgtacggcacgatgcaataggtgcagaaattattgcagcccgtcatgatgggcacccaggcgtgatactgagtctcgcgatgccacggcatgctcatggcatccgtatcctcatgctcattggtgcggatatgacgcttaccatcaagaaacgcctcggcaatgagctcggccacatgtgcaatggaatgcgtgccaaagatgacattgacgttatcgacgttggtgagcaggccctcgccatcgcgctgcgcgatgcaaccgccaacggcaaccacgcgcttgcccgaaggcgaaggcggcaggcttttgcaggaattgcactgaccgtacaggcgagtatcggcggcctcgcgcacgcagcacgtaatgaagacaacgatatcggcatgcgcgggatcgagcgccatgaggcagccatacgaatcaagcagaccgctcacacgctcggagtcgtgctgattcatctggcagccaaatgtgcggataaagtaggttttaccggcaagaatatcgcgtacggaacgctggtccatgtgcataagtcctaacgatggggagcgaaacaaggcaagcagaagctatgccacaggcttaacatcatccatgacgacgttatccatagcagctcgattgatctggtgaacgtagatagaaaggcggatggccgtgcgcgactccccgttaatgaggatgtcggagaacacgggcgcgcaggaaatatcaaaaccggttggaatcaaaaaaccgcgcgcgatagcaacggccttaatagcctggttgacggcaccggcgccgacacactggatgttgacgggtacaccatccttgaccatgccggcgatggcgccggcaacggacgcgggcgatgatttgcttgataccttcaggcaatccatgaagaaactcctgcatttaaaagtacgttttaactgcaataactgtatcgtaccgagtggactcggtaaaggcactattcctctttggcaagatcaaaggtcacggtgattcgatcacgcgaaacacggatctttgggtcgccgcaaaggttgaaatagtaccgggtggcaaggtcattaaagtcgcgttccacagcgcgcgaaaactgtgccatgtcatccttggcaatacgtagcccgcgacgatccttcgcgagatcgacaggagccggcgcatgcgaggacgaatcacgctcgcgcagcagacgcgcggtcacaccgcgaacgggcttaatctgccctgccaaaatgcgatgggccgtgcgctcggacatctcaagacccaaacccgaacaaatacggataaagtcctcggcatcagaagcaaggcctaaacgatcgacaaccggaagctcgctctcgtcatcaatgaacaggagacgagacgtatcgagccgacttgacgcttgagcataaagggtcgcggcaatctcagacggagaaccgagatagacatcgcaaccacgcaactcctcgagcgcaaactcacaagcagcgcgaataatattatgtggaccgcgagcgcagacataacgtccgtcctcatccttgacggcctggggccagctggactgatcggcacgctcactgaggcggtcggccgcaacgctcaccttgaaggctgaaccaagatcgacgccggacgtgaccacacgggcctcgtcggtgttctgcttaatcgaaaacaatgccatgccacgaccgtgaacgccccaacggtccatcttcatgctctcgagcttggaggtaacgcgggcatcaaagattcgctcttgcatatcctgcggaacgccagaaccgttatccagaaagacaagcgtgcggacgccatcttccttggtcgtggcgagatagaccttgtcggcgccggcatcgcgagcattacggagcatttcgatgacgatgtcctcgacatgctgaatgtcgtgcttagcctggcgccgctcggcctccgaaacgcggaggcggacatacccctcgccaaggttctcctcgacgcgaaggttgccctcccccgacatcgacgcgataaatgagatgagctcgttcgcgtcgctcatgttatttagcgatatcgacagcgcggctctcgcgaatcacgacgacgcgcacctgaccgggatactccatctcttcctcgatctgatgggcgatatcgtgagccaggaccgtggactgggcatcggagatcttgtccggctggaccatgacgtggacctcgcgaccggcctgcatggcataggtacgttcgacgccgtcatgggagttggcgatctcctcgagcttctcaagacgcttgatgtagttctcggcagactcgcgacgggcaccggggcgagaggcagagacagcatcggcggcctgcaccaggacatcgagcaccgtgttggggtcgacatcggcatggtgagcctcaatagcgtggacgataacgggcttctcgccataacggcgggcaagctcggcgccgatgacggcatgcgggccctcgacgtcgtggtcgattgccttgcccaggtcatgaagcaggccggcgcgcttggcggtcacaacgtccaggccaagctcggaagccatcacgccgcacagatcagagacctcgagggaatgctgaagcacgttctgaccaaacgaggtacggtagcgcagggcaccaagggtcttgacgatctcggggtgcagatcgtggatgccggtatcgaaggcagcctgctcgccagcctcgcgcacgcgctgctgaaccaggtcggcggccttgtgatacatctcctcgatacgggcagggtgaatgcggccgtcggcgatgaggttctcgagggcgacacgggcggtctcacgacggaccgggtcgaagctcgaaagaacgacggtctcgggcgtgtcgtcgatcacgaggttgacgccggaaacctgctcgaaggtccggatgttgcgaccctcgcgaccgatgatacggcccttgaggtcatcagagggaatgtgcacggaggtaacggtaacctcggcagtgtggtcggcagcgcagcgctgaatcgccagagacagaatctcctgggcggtcttgtggcactcggcgcgaacctgctgctcggactcgcgaatgatcgtggcggcctcgtgggtgacctcgccgcgaaccttatcgaggagctccttgtgggcgtcctcgcgggtaaggtcggcgatacgctcgagctcggaggtctgctttgcacagagctcctcgagctcacgggagcgcttctcgacctgaccggcctggctggacagctgatgctcgcgcttgtcgagagcgtcgttgcggcgatcaagggattcctcgcgctgcatcacgcggttctcgagcgtacgaatctcgttcttacgctgcttgtcctcggcctcggcggcctgcttgttcttgatgatctcctctttagcctcgagcagagcctcttttttgagggtctcggcctgacgcttagcatcaccgatcagggactcagcctgtgcgtgtgccgactggattttttcgtcggcctcgtgaagactaccctgcttggcggtgcgcatgtaggcaatggcggcgatggcacccaaaacgatgccaacgagcgctgcgatgataggcatgctcactcctttttatggattcgttacacaacaaagcgaaccgtccttacgaacggctcgcgacatttgagtaatatgggcgcagcttatgcgggtcggatacagataaacatataaacaaactcatcacagatgagcacatatcacaaagcaaatgacgctgtttatcgtacgttgaaccacaacaactgtcaaataaatgcccccaacacggcggctaaaacacggtgagcggcagggccacaaaacgcatacgcctaaaccgcacattcctcgcgttcggcatcgagacgtgccttaacggcatcggcggcgatatgatacgagaagcccttgcccatcaaaaaccgaaccagtttttcgaatccgcgcgtctctggaacacgccgcttggcgagcagggctgacgcacgcgccaaatcgtcttcgacggcaaaataatcctcgggataaccgggaatgtcatcgagcacgacatgacggcgcttgagctcggtctcgattttgcgctgtccccaaccgtgccgcttgcgctcctcgataaagtacgagcaaaagcggttctcgtctaaaaagcgatactcggtggcgcgctcgacggcgaaatcgattgcggtctggtgaaagccgtagcgagccagcttgtcacggacctcgcccgtcgcatggtcgcggcgcgataacatctcggtcaccatggtaagtgcacatttacgctcgacgagctgcaccgcctcacgaaagttgtcccaatcacagggaagatcggggcggtttttgacatacaggcgcgcgacccgcacgggaatccaaatggaccgctcaaaaccgccctcaagctcacaatcgatatgtgcgcaaggctttttggacgcatacccgctcgagaacgaggaggccgccttcttatcgggaaagacgaccgtggcctcggtcaccgtatacgacatgagcgcaaccgctactcgtcgtcatcatcgagcatggcggaaccatcgatggcgtaaagctcgtcaaactcctcaggcgcaggctgatcggtcagctcgacctcggatggagcatcgtcgtcaaactcaagcccgcaggcaaggcggaccttatgatcaatctcgtcggcgcaatcagggtgttcgcgcaggaacgccttggcggcctcgcgaccgttgccgagcttgtcctcgccataggcaaaccaggagcccatcttcttgcagatgccgcactcgacagccatgtccagaatcgagccctccttagagatgcccgtaccgtacatgatgtcgaactcagcagaacggaacggagctgccaccttgttcttaacgaccttggcgcgcacgcggttaccgataacctcatccttaagcttaatgctgtcgatgcggcgaatgtcgatacgcaccgaagagaagaacttaagggcgcggccgcccgtcgtggtctcggggttgccgaacatgacgccgatcttctctcgcagctggttaatgaagatgcatgtcgtgttggacttggacagcgagccggcgagcttgcggagcgcctgactcatcaggcgagcttgcaaaccgaccgtggtatcgccgatctctccctcgatctcggcacgcggggtcagcgcggcgacggagtcgacgacgatggcatcgatggcgccggaacgcacgagcatgtcaacaatctcgagcgcctgctcacccgtatcaggctgggaaatcagtacctcgtcgatatccacgccaatgcgcgcggcatacgtgggatcgagcgcgtgctcggcatcgataaatgccaccacgccacccattgcctgggcctcggccaggatctcaagcgaaagcgtcgtcttaccggaggactcaggaccgtaaatctcgacgatgcggccgcgcggcacaccgccgatacccagagcggcatcgagtgccagagcgcccgtagggatggcctcgacctcgagctcggggccaccgtcgccgtacctcatgatggaaccctggccgaatttcttctcgatctcggccttggtggtggcgatcatctcatcgcgctctttacccgtcgtgcgagcatgaacggtacgtacgggacctgaattcttggccatgaaaagccctcctcttaacaacctgcatcgataataaacgaacggctgttcgtggtcaaccgttcagataaatcatatgcaggcagtctttccaaaacccaaccaaacgccgacctaacactgaccaaatgcttgaccacaaaggggcaaataagaacaagaaaggcaaaaatacacctatgaccagcgcaaacgctaaattcgtcaggggtccctatctccacaattaaggggcccgaaggccccttaaaacacgtctattccatagagttaagcacaagggcaatgcgtcccaatgcctccgcgaccgcatgggcacgaacacacgaacggtcgccctcatagtggcagcgcacagagtccacgaccggcacttccccatcagccgcgcgatacgcccagccaatatagaaagtgccagccggatcgtcctcagtgccgccgccggggccggcataacccgttgcgctcactgcaatatcgctctggtacagctccagcgaacgcgccgccatctcgcgcgcggtctgatgcgacaccgcggtatagcggtcgagcgtctcctgatcaacacccaaaacgcgatgcttgatctcatcgcagtaggtcaccgcaccgccacgcagcaccgccgaggcgcccgggatatcggcaatcgtcgaggcgatcatacctgctgtcagcgactcagccgtcgaaaccgtcacgccccgagcgctcgcgcgctcgacaatatgacgcgccagctcctcgttatgtgcggaaatctgctcaaaagagtccgtcatacccaccagaacctagaccgaaaagacgatcttgcggcagttccagaagtactgggcgcccgagataacggtcaggacaacggcaacggcgtacaggaagcgcgacaccgagtagatgccgagcgtcagcgccagcgggccaaggtgcaagccggccatcgcaaagacgcacaggtaaccgcagatggagaccatcgtggtcgccgtcttgtacttgccaagcttatcggcggcaacgaccacgccggcggcactcgcaaccatgcgcagggcgcttaccagcagctcgcggaacaagatgatgaacacggaccaaaccgacacggcaccaaagtccaagaatagcagcagggccgagaatacgagcagcttgtcggcgatggggtccaagaatttaccgaagtcggtaatctcgttgcgcgagcgcgccaggtagccgtcaaccttatcggtgcacgacaggatgacgtacagaatgaaggcagcggcggcgagcgggccgtcgaaggtgctccaatctgtaccggcaacactcgtgtgagaaagcgccgacacaatcatgaacaccgggataaagacgatgcgaacgcacgtcacgatgttggcgggcgtccaaacactcgtcagttccttattgctctcgtttgccacgacgctctcctactccacaacatggccgataagctcatagcagaagctatcggtaaactcgaccgtcagaatatcgcccacagatgcctcgctggcatccagatgcaccgcgccatcggaatcaggcgcctggaaccaggcatgtccgatcagctcggcgccgtcctcggtctcttcgataccgtcgacaatcacctgggcgcgctcgcccacatgtgcggcagttgcagcaaaaccgagcgactcggccaggtccatggcctcctgggcgcgctcgagcttgacctcttcgtcgacctggccctccatcttggcggccaggctgccctcctcctgcgagtaggcaaagacgctcgtgtagtcgaagccgacggtgtccataaagtcgataaggtcgcggaactcgtcgtcggtctcggtcgggaagccaaccatggccgtggagcgaatcacaataccggggatgcgctcgcgcaggtcgcggaacagatcctcgagctcctggcgcgaaccggagcgacgcatggccttaaggatgcgcgcatcgcagtgctgcacggggatatcgatatagggcagcacctcgggcgtatcgcgaatggtctcgataagctcgtcagtcatgccctcgggctgcaggtagagtacgcggacccacacgttatgaggacgcaccgcctcagcaacggcctgcaacagctgcgccagattgcgcggctcgccctcggcgaggtcctcgtcggcaaagtcggtaccccagatgcccgtgtcctgaccgatcagaacgatctcgcgcacgccaccggcgaccaggtcgcgcacctcggagataatgctctcggcattacgcgagtgataacgaccgcggatatacgggatcatgcagaagctacagaagcggttgcagccatcggagatcttgacgtaggcgacagcgccctcgacggtacgcttgacctgcggaatataggcggcaatctcgcgctcgacacccagcacgtcatcgatgaccgccacgatgccgtcttcctcgtcggccttcacaaaggccgcaacttcgggcagctcgtcgggcaggtcgtcgccgtagcgtgacggcacacagccgcacatgacgatcgggcaggaacgaacgccgtcctgcacctcattggcaagctcgagcgtggtctcgatgctctcggacgttgcagaggcaaggaacgagcacgtattgacgatggcgatatcggcatcctgcggatcgaatgcctcctcgtagcccgcggcggtcagcagcgaacgcatacggtcggtatcgacctcgttcttggcgcacccgagggtgatatagagtgcggagcccaacggagtatccatgttggagagcggtcctttcgaatgaattagcggtagttggtgaactgcagcggctgaccgtagtcctggtcgcgcaggaactggatcacggtctgcagcgcatccttggaagcagaggaaacacgcagtttgtcggcctcgatcgtcaccttgaccttgagcttctgatccttaatgtccttattgatcttcttggcagtcgtctggtcgataccctcgacgatgtgaccgagcacgcgcacggtaccgcccgatgcagcctgaggcgcatcccaggacacggccttaagatcgataccgcgcttgatgagcttggagctcaggacatcgacgatctgcttggagacaaagtcggccggggcgttgatcgtaaagagcttgtcgcccttcgaaagctcgatcgtggcgccggagtccttcaggtcatagcgctgggaaatctcgcgcgtggtctgctggaaggcattgtcgacctcctgcatattgacctcggacacgacgtcgaagctggaatctttagccatggttaatcctttcgcttacgagcggcttagtagctgtcgtacgaatagtcgtctgaataaggcgtagtctgcccgtcggtggcggtatcggtgccgtccgtggactgggtatcggttccatcggttccgtcggtgccatcggtgccatcggtgccgtcggagctctcgccgtccttggagtcggtcgtctccttcttgggaacggtgatcgtcacgcgtgccacgcccgacgtcttagtgtcgtagcgaaccttttcgccgttcttggtaacggtgacatcggaaggcttggacgtggtgatctcgatcgaggactcgggcgtgtattcctgctcaaagggtccggtcgcctgggcgccatagaccgacttgccatcaaccttgacctcaatccaagcagtcttgcccttggcaacggagatcttgacctttgtgacctcgttctcctccttattggccgtcgtcttggcggcgtccgaatcggtggactcgtccgtcgcctcatcggcatcttcatcctcatcgacggattcggtcttcttggaagacttcttagtcgttgtcttggtggcaacgggcgtctcgggcgtcgaatcgggcgccgaggagccgcagccacgtaggagcaccacgatgagcacgatcaacagcagcgccacggcaccgatgccggcgtaaacgatacgaggatcgagaccgttgttctggggagcacgcccaccgccgcgttcacgatttgaaccaccgcgaccagtgccttggggcatgcgaccgcggttattgtcggaacgtccgcgataactgccctggcgctgcatattgcgctggcccgagcggggggcgagctcgccgcgaccctggtagttgcgctgacccgagcgaggcgctgaggagcgctggctataaggccgtgactgagatcgaaggcgaggcgtcacctgcgtagtatcggcgtctgcatagccgccgcgcggacgaccggaagaaacgccgcggtacccgcgatcggaataaccaccatccccgtagccggcacgagggtctcgtgcgacaccgcgggcagcggggagtgcgcgctcctcgggcgccggcgtgctgcgaaaacgatcgcgctgggaacgaatctcctcgctcgagcccgtttcggtaacatagccagcctgctgagggcgctggccataacgcgtcgaacgcccgccctgaaccatcaggaagcggccgttgtcgaccgaggaacgcgaattgacgtagccggcggcgtcctgaaaacgaccgccctgctgcgacgtctcgcgctcatatgccatcaaatcgtcaaaataagcgttgacgacctcccgcggattgaggcccaaaaagcgcgcatagctcgaaatcatgccctgcgcatagccgcgcggaggcatcgatgcaaaattgccattctcgaaaaactcgatgatctgcggcctgattttgatggtgttggcgacctgctgaatggaaaggcccattcggcgacgctgctcgagcagcatgtcaccaaagcgtgcagccatcagaatcctccaaactcacgatcttcacgtgccatctcggcgtcgacggattccagcgcggcaaggccttcttcatccagcaggacctcgcgcggcttggagccatcgggcggtccgacgacacccttttcttccagcatgtccataatacgcccggcgcgcgcatagccaaccttcaggcgacgctgcaagccagatgtggagcccagctgcgattccaccacaatatgagcggcttcccagataagcggatcgtcgtcctgaggctcggcaacgccggtgcgcacgatcccgccgccacctgccatggacatggaggcaggtgccacagccgacagaatctcctcatggtagtcgggctcgctttgcgacttgacgaactcgacaatctcgttgatctcgtcatccgaaacaaagcagccctggatacggcggggcttgccccagtcgaccttagagaacagcatgtcacccaagccggtgagcttttcggcacccatctggtcgatgatgacgcgggagtcgatgcccgttgcgacgttgaaggcgatacgattggtaatgtttgccttgatgagacccgtcaccacgttagagctcggacgctgagtcgccacgataaggtggataccggcggcacggcccagctgggcgatacgcacgatcgaggcctcgacgtccttgccggcaaccatcatcaggtccgaaagctcgtcgatgatgatgaccaggtagggcatcttttgcggcgggttatcgtaatgctcaaactcgccggcggcctgcttttcgttataggtcgagatcttgcgcacgttaaggcgctcgaagaccttcaggcggcgctccatctcggacaccgcccactgcaaggcactcgcggcctgcttgggctcggtcactacgggcacgtaaagatgaggcaggccgttatagcctgcgagctcgacgcgcttggggtcgaccatgatcaggcgaacgtcctcggggagcgcacgcatgagcagggtcgtgatgatggagttgatcatgaccgacttaccggaacccgtggtaccggcgatcagcaagtggggcatcttggcgaggtcggcgacgaccggcgtgccctctgcgtcgcggccgatggcaagctcgagcggaccgcccttaacatagggcagcacgtcgcccaagttgacgttctgacgcttgcgattggggatctcgatacccacgagcgaggtgccgggaatcggcgcaaagatacgcacggactgagcagcaagcgacagcgcgatgtcatcctcaagactcgaaatcttgctcacgcgctcgccctcgccgggctgcagcttaaaggtcgtcaccgtggggccggcgatccagccgaccacgcgggcactgcggccaaactcaagcaaggtggattgcagtgactcggcagtctgttccagctccttgtcagatgacgcggaggacgccgactgcgggttggcgtgcaggatctcgagcggcggaagcttgaggccgtcctcttcttcgccctcgttatccgcgggggcattgaccgctcccccatcgctaggagtaggcgcctcggcagcgcccgcgacagccgtatcggcaaccttgggatgcttcaagaagtcgggaatctgaggtgttgccgagacaggattcacggcaaacggcggctcggactcgtcgatcttatcggggtcgtcttccatcgaaagctggccggttacctgttcgcgcttagcatggcgacgcggcagcaaagttgtctttgcggtctcaatcggagcctcgtcgtcctcgtcatcgccctcggtaagctcaatctcgctatcggaccaagacgggtcgggctcgcttgtattcaacttgggcgtggccttgcccttcttgacatgacggcgcggcagcagcgtcgtcttagcgcgctcggcctccacggcatcggatacgtcgacaaacggatcctcgtcctcgtcgtcatcgtccaaaaccgggtccacatcgttgcccatgaccgtggtcacggcagcatcggagcccttttgacgaagaatgctcaggtgcggacgggcaacgccgggcaccgacagggcttcgtcgtcaccccacgggctcgcgttaacatcggcacgacggcgctcggcaaaatcggccgcgcggtcgcgagcagagcgcagcacgccacccaccgaaaagccgatgatgacaaaaccaacgacggccagacccaacaggaccaccatcgcgataggcttacccagggcattctgcagcgcactcgcaataaacgcaccgatgtagccacccgaggcggacagattttgcggcgtgaacataaggtcacacgagtcgctcgtacccggcaccatcagcgaaagaatggagacaacggtgataaagaccacggctccgcccgcgaccgagcgcacgttgagcggcgagtcctcgcctaaaaagagcgtggcggcaaacagcaaaatgacgatcggcagcacgtaggcgcccaggccaaagcccaggtggtaaaaaccggcaacagcagccgtcacgggcgctgttgccggagaaatcacggcaataaaggacgcaatcgccaaaacggcaatgaccacgccggcgatatcgcgattggccgagggctccaccaagggctcaaaatcgtcgaagtccgcctcgtggcccttattggcacgcagatgggaaccggcacccttagcagatgccggttggttattggccttattgcctttggcgttttgtgcagatccgcgcgccaaactaaacctccatgacgaccgggatgatcatcggacgggtgcgcgtacggctccagataaagttagagagcgaatcgcgcacggccttgcgaatggcatcggaaccgctgctcgtaaagctaaacttgcccttctcgatcgtcttcacaatggacgcggaggcatcctcggagaactggtcgtcgatggcaaacgagacgccgcggcccgagaactcgatggcctcgatcttcttgtgcttgagcgagacgatggcaacagcggtaaccataccgtcgttggcgagcttctgacgatcgcgcaggacgatggggtcggtatcgccgatacgcaggccgtcgacgtagacgacgccggactcgacgggcgtaccgcgtttgacgataccgccgcgcatctcgagcgtgtcgccgttatcgaggataaagatgtgatcatccttgatgcccatcttgcgggccagctgggcatgggcacgcagatgcacggcctcgccgtgaaccggcataaagtaggtgggcttggccatggccatcagtagcttgagttcctcctggctaccgtgaccggagacgtgaacgagagcgcggttcttatcccacacgtcgcagccgagcttggctaggctgttgacgacctgctggacggctttctcgttaccggggaccggcgttgccgagaggataacggtatcgccctcgtggatggagagcgtcttgtgctctccgttggccatgcgggacagggccgacagcggctcgccctgcgaaccggtgcacatgacgacgatcttgtcgtcgggcaggttatcgatgtcaaaggcatcgatgatatcggcgtcgtcgatgttgaggtagccaagctcgcgcgccacgcgggtgttagtgagcatggagcgaccggtcacaacgaccttacggccgcacttgcgggcggcatcgcagatctgctgcagacgatggatgtggctcgagaacgacgcgacgaacacgcgacccggcgcgttcttgatggcgtgcagcaggttggggccgacttcggcctcggacttggtaaagcccggaaccgtggcgttggtggagtcggaaagcagcaggtcgatgccctgcttggcaaagcggctgatagcggcgtagtcgggcgtgacgccgtcgatgggcgtctggtcgagcttaaagtcgccggtgtgcataacggtgccctgattggtgcggatgaacacgcccagagcgccggggatggagtgcgtcatcgaaaagaaatcgagcgagataccgccgaggttgacatggctgccgcccttgacctcgcggaacttgggtgcgcggatgcggaactcagaaagcttgccctcgataaagccaagcgtcagcttgctcgagaagatgggcaccttattgttgaggtcctgcagcagatacggaagcgaaccggtgtggtcctcgtggccgtgggtgacgacgataccgcggagcttctcctcgttctccagaacataggtgtagtcgggaagcaccaggtcaataccgggctgggaatcgtcggggaacatgaggccagcgtcaacgagcaccatgtcgtcgccgcattcgaagaccgtcatgttcttgccgatgccgtcaaggccgccgagcggaatgatcttcaagggagatgattttttagctgccataggttagtgtggtttcctttcttcgaaacgggtctggaacaaccgacggggcgcttctggcaaaccgaccgccgggaacgtacaaacatgcatcgcagagtcgatgcaataaccacagtatgatacccatttgcacaacaacagaccacccatgcatcaaagccccatctgaactggtccatcccgccggtcagggctcagcggccccggcacgggctaagtttcctgctctacagtcctgctcacgacggaggccacattaagtggcctcccgtgcgacgggggcgaggcgaatggctgagcggtatcgatatgcgggttcaacggcattatattgaccacatagattatcaaaaccgtcgtaaaacccctggtttcaactagaaccccgaggattctccctcctctaaatgaaaagtaggtgggagatgaatcggggttccgcgtcacgggtataaggacgccatctgtcgtaatcagtcgaaaggtggtgctacctgtggagttggagtcgaataaccactcggtgtttctcatgcactaccatctcgtgctggtggtgaagtaccgccgccgggtcatcaccgacgcggtatccgaccgcgcccgggagatcttcgagcgcatcgcaccgacctatggaatcacccttgaggagtggaaccacgatgtcgaccatgtgcacatgctgttccgcgcccagccgaagaccgagctgtcgaagttcatctgcgcctacaagagcgcgagcagccgcctactgaagaaggagttccacgagatcaggcgcaagctctggaaggagtacttctggagcaggagcttctgcctgcttacgacaggcggagcccccatcgaggtcatccgccgttacatcgagagccaggggcagaaatgacggtcacgatgcacaaggcagtggtgtaccgcgcctacccgacacgtgagcaggcggctctcatcgagcgcacgtgcggctgcgcccgtttcgtctacaaccggatgctcgccgacaagatcgcccattacgagaagacgggcgagatgctgaaggtcacccctgccagatacaagcgggagttcccctggctcaaggaggtggacagcttcgccctctgcaacgcccagctgaacctcgacgccgcctaccggaacttcttccgccgggtgaaggccggggagaagcacggttttccgaaatacaaggcgaagcacaggagccgctgctgctacaagaccaacttcgtaaacggcaacatccgcttcgagggggacgagcgctacctgcgcctacccaagctcggcagcgtgagggtcaggcagaaaagggagatagacccgtcgtggaggatcaagagcgtcacggtcgagcacacgaggtctggcaggtttgaggtgtccgtcctgttcgagttcgaaacccaagaacccgagcaggtcaaacccgagtctttcgtcggcctcgactactccagccacgacctctacgtcacgagcgacggcgagcgccctggatacccgcgatacttccgacatgccgaaaggaagctcgcacgtgagcagcgaaagctctcccggatgcagaagggttccgccaattggcgaaagcagaagctcagggtcgcacgcgtccacgagaagatgaaaaaccagaggaaggatttccaccacaaggcggcgaacggactcgtggagcgctacgactgcgtgtgcgtggagaatcttgacatgaggggcatgtcccggagcctgaagctcggcaagtccacgatggacaacggcttcggcatgttccgcgcccttctcggctacaagctcgaagaccggggcaagcgtctcgtcaccgtcggtcggctgttcccgtcgagccagctctgtcatgagtgcggctaccgcttctcgggaaccaaggacctgtcggttagggagtggacgtgccccttgtgcggtcgcacccatgaccgcgacgttaacgctgctcggaacatcagggacgaaggtatgaggctcgcgctttcggcctagaggaagcgaaaccgtggggcacacggggatagctcgtcgatactggcgacatcggttgccttgagcgagaagcccccacctctagcagcgaagttgcaaggtggatgggagcatgtcacctacggggagtgtcaacggtattcactttttcagcaatgccgtatttacgtaatgtcgttattacatagttctgtggaatagcagaacaattgaacattgaactaatcgcgcctgaaaattttccgcaagtgtcgtgcgccgccgtacaaagcccggcggcgcactagggctctgccctaaaaacccggcgcccttggcggcgttaaaaagtgacgcaataacgttgttacgttattgcgttattacacagttcggcagtcacacttttacattgttgcggcatgacacagttacgcaatgtctccggtgcgtctcggtaaaaggttcgctaccggacagccaccggacaccgaggcgatctaagcgcggcgatggtttgccgtgaaatgtgctgtgagatgaaaaatctcgcaagagacgcgaacttgtacctccatcgtaaatgtagccacaagttcgcagccgttggctcttgccagggctctgcccttggacctgggtcggtaagttgactgcgactgcatcggttgattgatggcagttggaatcgacgccgtagtttttaaatctgttatgaagcgtgaaactcaaaaactcatcgtattgattttcatttgattcgaaacgcccgcgcaaaagtcgaaacggctcgcgcgggcgtttcggtttttcgtttcgcatctcaactcgcgtcaaaacaaaacgcgagctttgaaaatcgatagcgaccgaaggtcgcgatcataggcggcttgaccgccgcatgaaaatcgaatcgccattcgaaccgtaatgcgattcgcggtacctttcgacaatccaacaacgctacgagtctcactaaagactctccgcgtcattgaaatgtcgaaagctgcctcaactttttcgcaagcgtatcgaaaaacgattcgataaagtcgaatgtttgcgtcgcgggcgccgcaaacccgctccgctctcgctacagcgaatctctaacactcagcatccttcgcgttaaaaattcactttcgctcacggtcttcacgcagttacaacgccgcgaggcctctcgcttggaatgaggcctctcattccacgtctacactgcgtttcgcccaatccccgttccggagattgcaagattggtgttgggctagataaatggggccatactcgacccctttatctgccaacacatcttgtttatcgcctcttacggcgataaagttagaaatgaagttcgccttcatttctaagggaagtgacgacgtcacttcaaaaaacggcgcgacgtcagtcgctcctaaaaaggaaagcaatctcatatcggttttgaatcggtggcctcaccgattcgctctgctttcctggggggcatatgagttgcaagcgtccacacaccgttaaggcgacactcacttctgaagaatatgaaacgttttccgctttggcggaaaaggcaggcatgacgaaagccgaactcattcgctatgtcttgattcatcggggcgaatcgctcgatgatctagtcatttccaaaaatgatgacggcggccgtaacgaaaaaccgcaacccgtctcagaggattcggatgaacagcgttcgaaggtcatttacgttaaggtcaccgacggggagcacgaagcgatccgcaaacaggcggatgcgctcggtgcgaccgtcagtgcgtatgcccgccgcgtgatgcttaccgggaaaatcgagatgatcgattgcgatatgagccaggtcgcgaaaatctatcgcgagctgtatcgcgagggtacaaacctcaaccaactcatgcatttcgtgaacgcgcagggtcttccggcctacaacgagaaagccgttttccgaacactcgaaaaggtttaccagaacgcccgcaaagtcactctattcatcagagaactcgagcagcgctatttcattgacggcggtgagctcaatgaccgttattaagcagaaaggtgtttcatccgagcgatacgcgaaaaatgtgcgcaaatacatcaacggaaaacatgccttggctcgcggcggctggaacctcgcgaaccgaaagtactggttttctgaaatggctatgacgcggaagatgtaccaccacgacagacctgcgcgtgccggtgcgaagaacataacgatgcttcatcaaatcattgcgtttcttccggaggagtgcagctgcaacggaggcaagatgactccagatgcgtgcatggcttacgcggagcaatggcttgcgaagcactacccgcatcaacaagcggttgtcgcgttgcacgaagaaagtgacaaggaaggaaaacggtttgcggtccacatggcgattaaccgcacggaccttctgacgggtaagcgttgcgagacgggtgggcgacgcggaaagtacgaacgcgctgcgtgggtccgtgaaatggacgaggcttggaatcttactcaacttgaaaagggaaagaagaattcgaaaattcgtgatcgtcagccgcgcgatattgaaaaggagattatcgatcggggagagtacagttacaaaaacaatctgcgcgagctgatccatatcgcgatcgacgaaggtcgcccaaagaatatggggcagttcaaaaaactacttgcatcgtggggcgtagacattttcatcaagaacaatcgagtctacgcgaccgatctcgatatcaaagaggccggcaatccgaagtgtactttcaacctgactcgtcttgacgggcggtttgcggtcaagcaacttgaggcggccttcaaaaataatgttctagaagccgagcgagctcttccttatgagaagcgctgtgagatttacatccaacggcttaaaaaagcgtattcggcgtgggtcgagcaggcgaaagcgagcaagggcgtcgcctacaacgcattccctaaattcattgcaccgaagtgcgatgaagacctactcgaagaccccgccgtacgcgatgagcttcttgcccggcgcggctatgcaagggagattcgcaaccgttacgccggcgccgttcccgataccggcgacgaccgcgttcgcgccgccggccaggcgcacggcggcaccgccgcatcgcgacagatggacgatcgcgtcgttgatcgtggcgactattcgcgtggcgacacgcctcgctagggttgaactgcctgtcgtcggggcggagtaaaaacgctcatgcctcggcgatgcggcgagggcggcatctagtaccgtagtattacgtttccgcaggtaaatgaggtaaaaaaccagcgaagcccgcccgccgtagcgggcgggcgtgctatcatctgggttgtgctcgggtgttaccagcgccctcgcacgcgtagaggcgagttaccagctcgcgattctacagccaagcgcgttcaagacaacgtcgcctgacaatccaatgatagcagggacctgcaggtcaagctatggattagctgagaattcgcgaatgggagccacctcggtggctcccattttttgtggagcgcaacatatgccgttcccggtcggccaggcctcagggcctgcgaaaaaggtagccaagggctcgaataatcggagactgagctgtacaggttcattgtcccgtctcgcaagagacttcgacgggggtagtgccctccatgtggcccctgcgtcgcctcggcccttctgggcggagacgacgtgccggattcagagcgattgtcctgctgaaaaactgcaggaaagtaggcgagcagccgaagatcaggagttggttggatagccgtgtggcgacacacgtgtcgcggtgagaagccgcaacgtcaagcaaagaggatcgcgatgagcatacagccgtgacggtttctgagccccaccccgggccccgtcacgtacgggggcgccggtgaggacggccggcgcgttaaaacgaacggtccggatgcatgggcgtagccatgcggagtcccgcgagatcgtcgagtaaaaggccaaggggcgggtgaggttttcccggctgcaatgctggtttcgaagatttagggaggtccacgattgtgcccaaactctgtggatactccaccacctaacaatccgaccagcaagcccattagacctcgcgatcagttatcacaaccagcaagccatcagcgcgaggcgtaccagctgccagccctcagcgccggcgtcgcctacggctccccggacggactacctcacctggctgtaaacacctacaattcggcaatgagccgccgaattcgcttttcgattgtggttgaagatgtaaaaagaaatatataaatcagcgagctccgcgagcggatcataggtgccgtcaggcaccgcatcaaaagcgattcgcattcatttcgaaatgcatgtcgcggttctttctaggaatacacgcgagaaagggccgaaccgaagtgtctggccggacgccaattgttcgggaactgcttggttcgaccctcttctactttacttccatggccatgtgaaggctagtactccttaaccgggtgcttcttgccgaaaccaccgtcgatgccgaagtgacagagcatgtcgatggcgcgaagatgctcggcgatggcagttgcaatctgggcgtcgatctcgctgtcatggtcgttgagggagcggaccgcctcatcggcgaccatgaaggccttgatggcttggttgagctgtgccttgaaagcatcaaccttctcaactgcggcggctcgttgtgccatttcgcgttcgagtcgttgaacgatttcctgtgcgtcgctcatgctgttcctttcctcgcggggcattttatttactgtatcgcaccgcgcggacacggttttctccggacggcggcaaactcaacaaagcggcaggtagacggcttgctgtaatcgcaaatacggccccgaaaaggcatgcctggatacccgttaggggcatctgctttcaggcgccttaaaacgcatctggtgaggtcgatttttcggccttgaactgtgtggcggcactttgaggtgctttgggcgcgcccttaagctgtgcttgcacctaccagcgcgtgaaacattttgacggtaattcgtgaaacagattatggaactatcgctccaacgggcgctgccgccgctcaacgcgagcgatcggcttggcaccgcaaacggctactcgttctgcatggccatatacatggcgtcggccattgagtagcgggtaccgtcatcttccatcagcgtttcgttgaatgcctcgatgtccaccatatcctcgactttctcaagagcggctcttctcacgaactcggaaaaggacatgttcgagatgttcgcatgggcctgaatcaaagccatttcgctctcatcgaactcgaccgcaatctcgcatatccccatggcctctccaatcaatgccggcgactggactgtgctggcacacatcttattgtttaagttaaacgtctcaaaacgtatgcgggaaacgcggtaccgtcagaaaatgcaggaggaaatttgacggtcccgttaatagattttgtgacaagggcatgacagggggacaggtcattcgtcaggtttctggcagacgatatgagcgggacatggaaaatggaagcccctcctgtatgcatatccgctggtaaggcctggcccggttttcaccatcgcacgcggtgaccgagcacccatccaacgcccaagtcaaaatactcagtacactgagtgatttcactcactatactgagtattttctcaatttgctcaggctagttaaacagcggcaccttatcgagcagaaaatcctccacggtgcacgccccggccgccgctcctcccacgacgatccgcttggctcgcggatacttttttaggagcgtcgacatgccgctctggccggactctccaccgcttttgacctcgatggcgctcagtgcatcatcccttcgcagcacaaagtcgacctctttgacgccttcacgccaccacatgacctcaaaaccctcttccggcgcgcgcgcaagcagtcgtgcacccactgccgattccaccaaatgaccccgccgcgccgaatcctccagccattctgcacggcccttatcgccgagcgccgtcataaacgccgtgtcataaaccatgagccgcggggtgcttcggcgctttgcgagctccttgtcactgaacttggggatcgccgtaaccaaaccggccttgcccagcaggtccaaatacccggcgaccgtgaccgtgttaccggcatcctgcagctggcctaccatttttgaatacgaaagctcctgccccgaatagctcgccgcgagccaaaagagcgcgcgcatcagcgccggtttgcggatattctccaacgagagaacatcgcgcgagatcgccggctcgacgatcgcatctcggagatagtttcgccaacgggcgtcatcggaaaccagcggcgccgcacccggatatccgccgtgatagaggtagtcttcaaaagaaaagtcaaaggcctcgctgcactcgcgataggaccaatgcggcgaccgaatgagctcgtaacggcccataagggattcttccaagcccttatgcagcagcagcgacgacgatccggtcaacatgaccttgagcggcgtcccctcccggcgatcccggtcgtacaatcccttgacgaccgtggaccaactctgcaccttttgaatctcatcaacaacgaaaacggccggggccttacctccagacgtgaggtttcttgcctgttgccactcgatttgcagccagctggcatcgggattcacaacatcgtccgcattggccacgtgacagggcatgtctacatggtgcaacgcctgcacgaacatggtcgactttcccgtttggcggggcccgattataaattgcatcaacggattattcgtttcccgcatcctctgggctatcacggcaacttgatggcgctcaaacatgtcaatctacctccttgtttcttaaatactcagtatactgagtaaaatcactcagtatactgagtattttttgaaccgggagatcgaacccgccaactcaactcccttcaccagcgggttgccgccgcccctccgcgagtcgagtttctggcccttcgtgctcactcgatatataaaaactgccatagccatatcgaaaaaccggtatagccggtcccatcatcgaaccatcgcaaactgatacgcatcttattgctcatattcaaggccccgacgtctcaaaaggtatgccgcgcggcactcgaaaaccgaaccctcgatgccgtgaacagcgagtgccaaaacccagtgtcaaaacctccacttgcattcccatgagaaaatcaaaagacaaggcaggaggctgaaaatgaccagatacggatacgctcgcgtgagcacgaaggatcagaagctagataggcaaatcgaggcgttggtcaacgccggcgtgccctatggccatatctacaaagacaaggtcacgggtgccaaggacggcgaccgaactcagcagaagcgtctgttcaagaagatgaaggccggcgatgaagtggtagtcgagtcctgggagcgcctaaccagatcgaccaggcaattgctgaactacgaccttatgttccgaaatctcggcgtgaagctaacttccttgaaacagccggtcgacctcgataccgccttcggtcgattcgttctcggcactcacgcctgcaccgccgagctcgagcgcgacctgatcaagcagcgccaggccgagggcatcgccgtaaaacggaaccatggtggcaacgtcgggggccgcccgcgcattgcggacgtcaaggccgatgctgccgtgaaactctaccttgcgcgggaaacgcccatccccgacatctgcgccgccaccggtatatcgaaatcgactttgtaccgcatcctccgtgaacgcggattggtgggcgtcagaagataaatccgagtgcgctactatataagagtgcggtatttctccaactgaaaccccctgcgtgaacgcataacgtatgacttgagacgccttttagaactcaccgatcgcaggatgactacaaatcaacagcggccgtgcattgttcccagccatatggcatggcggagccatgccgttgttgattggagtgccgcaccatggcagacaatccgagcgaaaagaaaatcagcgagacatccggcgtgaaggccgtcctcgatgaggccgccgagcggatcgaggcgacgtggcgggagaagctgctgcgcgagacgggcgacctcagaaccgagaacgcgttgctcagggcccagctcgacgaattcaaccgcaagctcgtcgaggcgagagaccggaacgaaagacttgaggccgactgcaatgagcgggtcgcctttatcgaggagaagtttgaactcgataccgcgagcctcgagctcgagaacaacgagctccatgccgcgagcgtcagatacctcgccgatgccagggagctcgacaggcaggtcgtccagctccatgtcgaggccgtggccatggtcgatgagatcgagcgcctgcgcggcgagcgtgacgccgcgctgaaagcccaagccgagttgaacgacgcactcctggcccagcgcgacctgatggccgaggtcgccgccctcaaggaccgcctcgctgcaaccgaacagcgggcggccgtggccgaggctaaggtcgaggtcatgacccagatgaaggacgagtagccccgcgcttctcctgtcaggctactgatttctaggaatcttctagagcgcttccagaaggttcctagaaccgggcgtagcatcttcgatcggcacgatgtcttggtagatcaagcgatgcccggcgtcgagccattcgtcaccgtggtaatgtccgaagaaccaggcgcagtaatcgagccgtccgtcgagctcgcctaggaaggtttgcagcggatctccgcggtactcacgtccgcgttcgcggcacagcccctcagcaagggcggcaggagcctcgtgagtcacaacgtggtcgactttccagcccacgcggtcgagcgaggcgcggcagtgctccatctcttcctcgctcggcatctcctcgggccaccagctcctcccctccctgcgatactgcctgtcgttgctcgcggcaccgcccatggcaaggaccgtgagcccgtcgatgtcgaacacctctccgcgcatcaggtgcagcacgtgcggtcgcacctcatggacgagcccgccgttccactcccgtaccggcagattagccaaggcgtgatggttctcatggttgccgtctacgaaacacgtggtccatggcttcgactcaaaccaatcgagccaatacctctcagcattcgagccgtcccagacaaagccgaagtcgccggccacgatcaccacgtcgtcgctcgtcagagtccggcccagcgaccaagacctgaaggcgaacctgctggccccgtactcggccctgccgtgcacgtctcctgtcacatagacagccatcagtacgcaccccacggcaggagtttgtccccgagcctcacgatccggtcgtacagtacggtatgacgttcgtccgggttgccgtctcggtgaaaatggccgtaataccagcgcttgtggtccaggcggtcctcgagctcgtcgaggaatccggtcagccggtccacatcagggcgttcccagcccgggtccggatagagcgtcggcgagagcatgcgcgtggcacaggtatgggtgatgacgcagtcgaccttccagccgacctcgtcgagctttgcccgcgcggcatcgaaatcgcgctcatccgggagctcctgaggccaccagctggaatacggaacgcggcattccctgtccacgctcgtggcaccgcccatggtgaagattgtcgagccgtcgagctcgaagacctcgccgcgcgtcaggcgccgaatgggcgaggtgtccgacaggcgctgcgtcagcccgccatgccataactccacggggcgctccgcccagtgatcgaagcgctcgtggttgccgtcgacgaacagtaccgtgtaggggcgcgactccagccaagcgatgtcggcgcattcctcagcggaaaagttccacggaaagccaaagtcaccggcaacgatgagatagtcgtcgctggtaagactgtcgccaagctcccagtcgcggagcttttgcatgtcgagcccactgtggatgtcgcccgtcacatagaccgtcatcgaatcacctcttccctcttgtacgccgcaagctcgccctcgacctgcctgtcgccggtctcgttgacccaccagggccatttcacccggccgcacggctcgtcgactccggcgaaccattccctcagctcgtcgaggctcaccggggagtgcccgttggcatcgcaaccgacgtcgtagcgcagaaggccctgcttgcggttgaactcgttgtacgcgccaccgctgctgtggatgtgtccgtgaaggtgccacgatccatggctcatgccctgccagtcggcaatggggtaatggcacaggacgatcttctgcccgtcgatcttgagcacgcagatcggcggctccacggtgaacgcgcccgcgaccgccggctgggtccagtccttgtcgtggtttcccgggacgaggtggatgcgtctgcaggcgatccgcttgcgcagcccataggcgtcctgggcggtcatcttgaatgagaaatcccccaggatgtagaactcgtcgtccacggcaaccatgccgttgatgctgtcaatgatggcgtcgttcatctgccaaatcgtctcccacgggcggtcggtgaacttcagcacgttctcatgcccgaagtgggtgtcgctggtaaaccagatcatatttatgtctccttctgtcgctaaaaaacgttctccttcgaggtcaggagacgttttatgagcgacatgaggtgcatatccctcatgtttcaagctccaatctgccggatttgcccaactaaaagtttacgcccacgcgcgaggttgatttccgatctcagccgaacacattgagcggataggccgttcccgcagtggcgggcactgttctggggagctcgatgggtcatctcgctaggtaaaaagatagttcgcggtggtattgttgcagtgggtttaattcgatatgaaagggtgactttggtgtcccagatggattctacgctctcttatataactgaccagttgaaggcgcttacctcgattgcttctcctacggggtttactcgtgcggcgaccgattatctgatggagacgcttcgcgatatggggtttgggcctgagcgttctaataagggtaatgtgctggtggagcttggtggcgagggtgagccgcttgtgttggcgagccatgttgataccctgggcgccatggtgcgttccattaaggacaatggtcgtctgcgccccacgacccttggcgggcatcagtggtctacggctgatggcgagaactgcactgtctacacgcgtgacggtaatgtttatacgggagtggtcctcaacaccgagccctcggcgcatgtggccgatgagccggtcaagaccattgagaagaacatggagatcttgctcgatgagaatgtcgacagcaaggacgatgtgctcgagttgggtattcagaccggtgacatcattgccatggatccgcgcaccacggtgacggagagcggctacatcaagagccgcttcctggatgacaaactgtctgcggcgattctgctgggtctggcgcgtgccgtcgctgccggcgaggtgacgctttcgcgcaaggtttcgctgctctttaccgtgtacgaggaggtcggccacggcggcgcctttgtgccggccgacacgcgcgagatgatcagcgtggacatgggctgcgtgggcgacgatctgggctgcaccgagcgcatggtttcgatttgcgccaaggattcgggcggtccgtacaactacgacctggtaaccacgctgtccaacatcgcgcgcgagctggagctcgactatgcgatcgacgtgtacccgcattacggctccgatgtcgaggccacgctttcggccggctacgacattcgccacggcctgatcggccccggcgtgtacgcgagccacaactacgagcgcagccacatggacggcgtgcgcaacacctacgagctcgtccgcgcctacgtccagcgctagggaagtagtttgcgactcggctgaccaatcgctaaggcccgatctctcgggccttttttcgctttaggtcgtttagtattatgatgtaagtaatctattaactaaacgcgtaaattacttaacgaggtgatgcggcatatgaatacatctgagtacttgtctatgggtgatgctgcccgcctgttgggcgttacgaaagcccgcatatctcaacttgccgcatcgggaacgcttgtgtgcgatattgtgggcggccggaagttggtcgagtacaattctgcgatcgcctaccaaaaggtccgcaagcgaggacgccgtcctgcggccgatgttggacgcaagtttacgctgatgtcggccgaccatgaggtcgcgcatgtctcatttgatccgacgcgcgagtttcccttcgaaatcgccgaggtcctcgatgcgcaacgaatgccgtttggcacgtgctcgagctcttctccaacggtgaataagcgggagctcaacgtgtggtggaaccatcggtcggtgcctgacgtccgccccggactcgtctcgcgctatcgtgaactgggaattgccagtggcatcgaggttccggttcggtgcctgggcctctcgctttcggattgctattggctgcgcccggccgattgcgccgaactcaaatggcaaaacatcaattactttgagaacgaatttgagcgatcggcgcccgaagagcgttcgggttggctggaaggcatcggtcttaaaaatcctgataacacgtccgagggcgagctccctaaatcgtggatgattcgcaacggtgttcgcgttctggtcaagggatgcggcatggacgaccaacggccctttaacgaggcggttgcaacggctctgcatcgtcgcttgctgtcggagggcgagtttgttccttatacggttgagcggatgttcgatggccctgcgtgcctgtgcgaggattttcttgacggccgcgaggaatacgttccggctgtttacgctaagaacgcccttggtggccagcgaggaagctcgacgtacgaccggtactgccgctttcttggtaagcatggagcagacgaggccgctgtgagaaggtctatgtcgcagatgatcgtttgcgatgcccttttggccaacagcgatcgccattggcgaaacttcggtatcatccgcaatgtcgataccctggagataaggcctgcaccgctgttcgatagcggtaactgtctgtggtataacgtgccaactgtcttgctcgcggctggcgagtttgggtttgctgctaagccgtttgggcccgacccttccgtccagctggcgcttgcggactcgctcgattggttcgattcatcgcggctcaacggatttgttgatgaggcgatcgagattctttcgcagagcgaatgggccacggcggagggtcgactcgaggccatccgccgtggcctcgagcgtcgcataatcgaggttggtgccgctgttgaggtacttcgacacgtgcagcgataaacccgcggctacttaagtgcgccggtcacggtgccgccgcccaggacgatgtcgccgcggtatataacgacggcctggccgggggcgatggctcgttgcggctcgtcaaaggtcagcagcatttgtccgtcggcgccacgtgtaagggttgctgcctggtccttttgacggtagcggtatttggcgcccacgtgaatgccgccggcatcgagctctgcctccatgccggcggcaggggcgctccagatccactcatcggccgtgagcgctgtggctgtcaggtcctcggcctcgcccagatgcacggtgttgttggtggcatcgacgcccgttacgtacacgggatgcgccatcgcgacgcccaagcccttgcgctggccgatggtatagcgcagcgcgccgttatggcgtccgaccacgctgccgtcgcgccacacaatgtcgcccggtgcagcggcatgtccgcagcggcgctcgatatagcccgcgtagtcgccgtccgcgataaagcagatatcctcgctctcggccttcttggcgtttatgaagccctgttcggcggcaatgcggcgcacgtcgcgctctttgtccaagcctgccagcggaaagatcgtgcgtgccagacgctcttgcgtgagcgaatacaaaaagtaactctggtccttcttagggtcctcgccgcggtgcagctgccaggtgccgtcggacgcctgactcgttttggcgtagtgacctgtggcgatgtagtcgcagcccatatcgagtgccgcatcgagcaacgcgccaaacttaatatggcggttgcagatgatgcatgggttgggcgtcaacccctcctgataggcagtcacaaatcgctcgataacgttgcggtcgaaggtctgctgcaggtcgagcacatggtggggtatccccaggcgctcggcgacggcctttgcatcggcgatgtcgcggtcgaccttgctcatgcctgtgacgggatcgggcgcggggcaagtgaggcgcatggtggcgccaacgcattcgtagccctggcttttgagcaggtacgcggtcacgctggaatcgacgccgccgctcatggcgacgagcacgcgcttgttgtgcatggggaggttctccttggtggcatgcggccaaaaaagaaaagcggcgcgggaggctggttccgcgccgcagacattgtagcaagttcgggtgcttcgtgggacaccctaacgagatgggctcaggccgccagaagagaggggagaccggcgtgccttgaactcatccgttcaacagcaggaactagtcctggaagagtgccgtggacaggtagcgctcgccggtgtcggccagcagcgccacgatggtcttgccctcgttctcggggcgcttggccagctgcagcgcggcccacacggcggcgccggacgaaatgcccacgagcacgccctccttgttgcccacggcgcgaccggtggcaaaggcgtcctcgttctcgacggggatgatctcgtcatagacctgggtgtcgaggacgtcgggcacaaagccggcgccgatgccctggatcttgtgcgggccggcctgacccttggagagtaccggggaggtggcgggctcgacggcgacgaccttgatctcggggttctgctccttgaggaactcacccacgccggtcacggtaccgccggtgccaacgccggcaacgaagatgtcgaccttaccgtcggtgtcgtcccagatctcggggccggtcgtggccttgtgaatggccgggttcgcggggttcacaaactgaccggcgatgatgctgttgggggtctccttctgcagctcctcggccttggcgatggcacccttcatgcccttagagccgtcggtgagaacgagctgcgcaccatacgcctgcatcagcttgcggcgctcgacggacatagtctcgggcatggtgatgatcaccttgtagccgcgggcggccgccacggaggcgataccgacgccggtgttgccgctcgtgggctcgatgatggtgtagtcgccgccgcgcacgagcttgccggccttctcggcctcgtcgatcatgttcttggcgacgcggtccttaacggagccggcggggttgaagtactcgagcttgacgagcacgcgggccttgaggtcctcgtcggcctcaaagtgggtgagctccagaagcggagtgtggccgataagctgatcgatggacgtgtaaaccttgctcatggtgaacctccaaagtgttcaagttgctggataccgtgtgagtttacggtgtgtcgaacagtcaaacccacaaacctaataggttgttcgtatagctgttgggaagcatagtagacagtaaagcctagtaatgcaataggaaattgtgaattattacgagtcgatgaaccaccttgactggaacgggtattttcaaagtcaatttttcggctagaatttctaggactaaaagaccgaaaggcagcactatatatgttggtttctactaagggcaggtacgccctgcgcgttatggtcgacctggccgagcaccaggcggccggccgtatcccgcttaaagagattgcggcacgtcagggtatttcggagaagtatctcgagaatattctggcgacgctcgtgcgcgccaatatgctctcgggcatgcgcggcaagggcggcggctacgtgctcacgcgtccacccgagcagtatacggtgggcgagatcctgcgcctaaccgagggcagcctggcgccggttgcatgtctggacggcgactgcaagggctgctcgcgctcggatgagtgtcccacgctcgacgtgtggaagaacctggacaagctcatcaacgactacctcgacggcgtgacgcttgatcaacttgtcactcacaacgagggctacgactacgtgatctagggctctaacagaatgtgatggcgcgggccgacctgtggtgggttggcccgcgctttatgtctattggactaatcgttggcgacgccgtcgaggatgctgcgcatgatggataccaggatgctgcccataaaggccgagccaaagctggcgatagaaatgccggcgcctaggagattaaccgacaggtagctggcgagctcgagcataaagctgttgaccacaagctggaaaatgccgagcgtaataatggtgagcggcagcgagataaccgtgaggaacggcttgacgagcgagtcgacaatgttcaggaacagccctacaaaggcaaagcagacccaggcttcggcaaaaccgaagggttggatgccggggacgagaaacgtggcgatcgcaatggcgatcgaggtgaagagccagttaagcataaagcgcatggtgtgatccctttctgcgcagacagtgtgtcgctttgtttggacgcccattgtcgcaaatattcgtggagcttacgtgcgcatttagtttcaaaacggcgttcgtcctgaaaaacgcgccgctgacagagagtcttatcgctttagtttagtggtgtgctacactgctacgggcaaatgccccatgcattgttttattgcatagaacgggcgaacgatgcccgatgtcagtatcaacttcgatgccttttggcaggtttggcggtgatcgatgaatatcgagaacatgtttgacaagcctgatgtcaagcagctggtccacgcatttagtcttttggacgacgagaaggatattcaagcgtttttgaccgatatctgcacgccgcgcgagatctgcgatctttctcagcgcctgcaggtcgcgcgttatctggatgagggcgagccctatgttgaggttcaggcccgcaccggtgcttcgtccaccacggtgagccgcgtgtccaaggcgctcaacggcgagtacggcggctatcgcaagatcctcatcaagctggaggatggcgagtaggccaacggcaaaaacgaattgcacagaaccgtcccttcgggggcggttttttggtgcaagggggtcaggttatcttgcactaatgtggtgcaaacaaacctgaccccgatgcaccaaaagatgttggtgtggtgccatgttgtccgcgtgggcgggtaggatggatacattgaatattgcgaacggtttgagtggaggaccatgcctgttcgaatctataccaccaatgccggcgcggacctgagcgatgccgaggcggcgattcttgccgaccttgttgcccgacatgggcgcgccgtattgctggcgcctacgtttgccgagctcgacctgtgccgtcacgatgcggcggtggccggcgcctcgctgggcgttgactacaagactccctcgtcgtggctccgttcgctgtgggagctgatgggcgacggccgcagcttcgtcgacaacctgcagcgtcagatgctgttctcggatatggttgcccgtcgcgacgatgccgatctgcagccgctttctcgtagccagggcacggtgcgcatgctcgcacgcatggctcgcgatgtgcttccgggcgtggcggggacaggtgccgaacgccactgtggcaacgcctgccagcccgagcccaaaagcgatgccgaggcccgcgtgttcgagcttttgcgcgcctatgcgagtggcttggaccgccgagatatggtcgaaccctgcgaggcggccgacatgatggccggtgccttagccgacaatctgccaacctgcgtccgcgctgtgtttgtgcgtggcgtcacgtcgtttgcgcacggcctgcttgagctgctgtctgccgtggcgaatggcgggggagaggtcgtcgtgctgctcgcccgcgagcaggcggcaatgcgcgaggaacttgctgcggcctttgatgcccgcggcgtactgtttgagattgcgccgctgggggaggacgctgctgcctctaagcccgccgctcagcctgcctttatagaggttgccggtccccatgcccgcgcctatgcctatgcgaatgctattgataagttggtaaaggcgcgcgagggtgccgcaccgcgcgacggcgctgcggcaccggccgatcctgcgcgcgtgctcgtggtgtccgcccgggcaccccagttgttcggcgagcttgccgctcgtttggcggcgcgccacatcgcggccgagacaaccgagttcacggcgttttcccaatccatcgcgggcaggcagttcacggcgcttgccaacctgatcgagcgcatgaaggctgctgacgagggcaccgcctccaagaccgagtggtggcccgccccggagcttaccgactggatttatagcccactttcgggcgccgacgccgccagcgcgcgaaccttcgataagaacatgcgcctgtcgcgcagcaagaccactgcgggcgtcaagagtctgctacagagcgtgcagggccaagtgaggggtgcgcgcaaggcggccagcgaccagaactggtttaagaacgtgccgtgcgtggtctcggatgtgttccaggcgctatggcgtgacaagcccgtgacggcgctcaaggccatgctcgcggttgccgaggcgctgcccgatcgcgccctgggcggccttgacggccgggcccgtcgccaggccgagacggccctgctgcgccatgccatcgacatccttatgaacgacgcccgcgcgctcgatgtgtcgcaggcggcgaccgtacccgtgctcgatggcgtccgcaccaaggtggacaagcgcagtaccgcttacgattacgagacctacgaggtcgaccgcactccgcgcgcccaggtgcgattcgcgtcgcttgccgatgcggcggcgctgcgccccgccagctacgatgccgtgctgtttgccgatgtcgacctggacagttatccgctttcgcatgaggagggcccgttggccacgttgacggaagagttgggtcgcggcggcgtgacgcttgagcccgcggccctgctgcgcgtgcgttttggccgtgcgatgcaagcgtcgcgtggtccggttacgctcgcccgcgtgacccacgatcgccaggcgcgcgagtgctacccggcggccgtgtggaccgagttgcgggcgcgcgccaaggccgctgacgacgccaaggccgctggcgctgacaaggccgctgacgccgacaaggtcaccgccgccaaggcgacgtgcgtgggcgagggcgatatcgtgagggacttcgaccccgccgccggcgaagggctcgagcgcaagcgggtcgcatgcgaagcccctcagcatctgagcgccgaggccgtgccgtatctggttttgcgccgccgcgatggtgagggcgaggatgcgccgctcgtgccgcgtttaacgtccgcctcgcaaatcgaggcatattccacctgcccgctgtgctggtttgtgtcctatcgcgtaaaaccccagtctatcgatgcaggctttggcaacatggagaagggcaactttgtccatgacgtgctggagcacctgcatgctcgtctgccccaggagggcatggaacgcgtgacgcccatgaacctgccgcgcgcacaggagctgctgcgcgaggtcttcgacgagactctggccgagcacgccggcaagcgcggtaccgagggcccgctggtgccgctctcaccggtggaggaacgccaggtggccgagatcttgccgcagctggaggacgtgctcgcctatgagtccgaggcgcttgcgccctttgtcccgcgctatctggagtttgcgtttaacgagcttaaggtcgagtatgccggctggccgctcggcgggcgcatcgaccgcgtggacgtggatgccgagaaccgcgccgtggtgatcgactacaagcatcgttcgggcgtcgaggaatataagctcgccgaccccacggtgttcgatgagaagacgggcgcggtgcccgccgacgacccgcgttggctgccgccgcatacccagacgctcatctacgcgcaggccatgcggcgggcgctggacttgaacacgcgcgccgcgctctacttttcgaccaagggcggcaagccggcgctgcgcggcgccgcgagtgacgagctgctcgaggaggagcgcggcgacggtcgtattccgggccttaagaaaggcttcccgggcgagggcggcaacatggacttcgacaccctgctcgaccgcgtggaggccggaattgccgagcgcctgcgcgagctcgaggcgggcgtcgtggctgccgtcgatccgacatcgccgcaggcagcgcacgcgcgctgttcgtataaccacgaaggaacgtttgtaaggagggacgtgtagaccatggatctttcgactttgatgccgcaacagctgcaagtcgtcaaaacgctcgaccgcccgctgtttgtctcggcgggcgccggttcgggtaagacctttaccctcacgcgccgtatcgtctacgcgctctcgcccgaatccggtccgttcattgagcatctggaccaggtgctcgccattacctttaccaaggacgccgcggccgagatccgcgaccgcgtgcgccgtgcgcttatcgaagagggcatggacgaggaagccctgacggttgacgatgcctggatttcgaccatccacggcatgtgttcgcgtatcctgcgcgcgcatgcgctggagctgggcatcgaccccgaatttacggtgctcaccgataccgatgagctcatggatcaggctgtcgagcatgtgctgggccgtgcgacggcgcccgatgccgcccccgagcttgccgcctcgcttagaagtctctatgcctggtatcccatggcaggcgagggcggtccctttggtggcggcaccaccatcaagggcttggtgcgcgacctgctggagctgtccagccagctaccgggtggtatggacgacgtgtgcgtgcttcgcggctgctccgatacctcggcacttgccgatgcctatcgtgcggcgctcggcgcgagcaaggccgcgaccgagaaggcgcaggtggcgctcgaggccatcgacgcgttcgaggcgagcgacaagaccatggcggatgtggcgcggctcatgatgtcgtgcggcatgccgcgcgcgagcaagatgttccctaaggagaatgtcgagctgctcaaggcagaggctgccgacacgtttgtcaacattgtgctggcttgcggcgacccggcgctcgatgcgctgacggggctcgcccgtgccgtagaggcggagtatcgcgcgctcaaggccgaccagtccgcgctcgataataacgatctgctgcgcatggcatacgaggcgctgcgcgattatcccgccatccgagccgcctacgagggccgctttaagatggtcatgatcgatgagttccaggacaccgaccagatgcaggtcgatctgattcgctacctgacgggtgcgggcgagcgtgcgctgtgcacggtgggcgacgcgcagcagtcgatctatcgcttccgtggtgccgaggtcgaggtcttccgccgccaggagcgcaaggtgggcgcttcgggcgcggccgaggcatcggccgacgctggtactgccgctgatgctcccgccggcgagctcgtcaaactcgtgcgcaatttccgcagccacgacgaggtcctgcgctacgtggcgcgtgtctttgacggcgataccggtggccttatgcagggctttttggatcttgagccgagcgatgagcgcgaagacaagctcgaggcagaggcgtcgcgtcggcaggcgctgctcgttgtcggcggcagtacacaggagcgaacgcaggcgaaagctcatgcaattgcggagcggttccatgcgctcgtcaaggcggggcagcctcagggcgatatggtgttgctgctgggccgcatgaccaatgccgacgtctatgcccaagcgttccgtgaccagggactcgactgcgtcatcgcgggcggctcggtctttgcccaggctgccgaggtgcaggcgattcgcgccctggtgtgcgcgcttgccaacccggcggacacggcgcagggccttatgcccctgctggcctcaccgatgtttgccctgggcgcccaggagtttctggcgctggcgaccaagctcgacgagcagacgggggagacctcgcgccgcaatatcgatgcgggtattatgagcgactgcgacgtgcccggcctgcagaatctgccactggtgacgcgcgctcgcgaagtgctgcgctatgcgttccgccgcgtaggccgcgattcgtttgccgttatcgctcgcgatgtggtcaacgcctcgggctggtttgtgcgcctggcgcagcgtggccccgagggcaaggccatcgccgccaacgtgctcaaggcgctcgatgccgtggcagaggcagaggccgagttcggcaactcgccgcgctccattgcactcgccttcgatcgtttcttggcgggtaaggaagcgccgggcgcgctcaacgaggagggcaacggcgcggtgcgcatcatgacggtgcatgcgtccaagggtctggaatatccggtcgtggcggtttccgagtgctttggcgtacgcaagtcgaccggagctgcccagatggggcgtgtcgagggcggcgcgcaggttgtggcgctgccggcacgcttcgatggcgttaaactcgcggacggcacgttcgtcaagggtgacgacgtcaaaaagcagtttgagcacgcatttaagggcaagggtacgtcgccgtggctttcgccggaacttatggacgacgtctgtgcgacgggttctcccgccgaggcatttgttcgcctgcgcaacgatgacctgcaactttcgctcgaggagcgggcccgcttgctctacgtcgccatgacgcgtgcgcgcgagctggtgattctggcgatggacgtcgccgtgagccgcggtaaggtgccggcgccgtctttcgacgtcgagtccgacctgacctatgacgtgctgcgccgcatcctgcctggccagggcttgggtatgccgcagctcgatgccgaccacttggtgttcgacaattcccagccgggggactacgagcttatctcgctggcaaactttacctttgacgagcagacgtttgaggctaacgcttcgctggatgccgagggaaggcttgtccgcggtgatgcggaggcagaggttgttgatgcgggtactcgcgtcgccgttcccagtcctgccgaccccgagcccgatgcgtttgagctcgtgtatccccaggcggtgggtgtgcgtatgggtacctgcccgtatccagcgcgcgattcgtacagctattcgtcgattgccgcagcgctgcatgccgaggccgaggaccgtgccgccgaggcgcgcgtgcccatggacgaggccggcgatgatgcggagtcggatggctcggagatgacggacgcggacgtggccgccgctgagcccgccggcaaccccatggcgctgggctcggcgttccatgccgcctgccagtggctgattgagatgggcgccgacgaattgcctgccgagcgcgccgatgcactgacgcgcctgtggcatctgacgccggagcaacgcgagcgtttcgatgtcgccctgaatcgctggctcaggtcatcggttcgcgccgagctgcttgcctggccgtgcgttcgtgccgaggtgccgttcttctcgctgggctgcgaggacgaggacattgcccgctacggtgcgtatgccgagggcgctatcgatgcgctggcgaccgatcctgctaatccgtcgcgtgcgctggtcatcgactacaagacgggtggcacgccggacgagacgccggatcagttgctagagaaacacgccctgcaagcgcgcgtctattcggatgttctgcacaaggcgggctttgaggccgtgacggtcaagttcgttcgcgtggaacagacggccccagctgtcttcgccgagctcgccgagccccaagtagtcacctacaacctctaacctcaataacttgcggtggaatacggactgttttgaccagaaaagccgccaatcagtccgtatttcaccgcaacggtaggagggtcgctcgggtcccttggaagttgcggtggaatagttcctgaattgctgctcaggcggggcaaacaggaactatttcaccgcaactcaataggagccgtgtgggtttggctaggttcgggtgctgtccgtgccgtgcggtaaaatcgttcagtcagaacacgaacccgcatcggagctcatcacatggcattcgtccatctgcacaatcacactgtcttctccatgctcgacggcgcaacccgtatccaggatatggtcaaccgtgccgttgagctgggcatgcccgctgtggccattaccgaccacggctacatgtatggcgtacccgacctggcgctggcctgcgacgccgtcaaccacaacacgcccgagtacaaaacgtggagccacgacaaggccttcttggaaaaggaccgccgcgacgagctggtggagcccgaccccgaggcaaacccgcgcgagcatgcccagtacgtcaaagacatggccatgtgggacgagaagggcaacatcgacgagctcaagccgcccctggtcatcaaacccatctttggctgcgaggtctactttacgccggacgagacactcgcccgcgaccacaagcccgagctctaccacatgatcctcctggccaaggaccaggagggctacgtcaacctgatgcagacggtttccgaggccgccgtgcagggcttttactacaagccgcgtgtgacgctcgacaacctgcgccgccatgccaagggcatgatctgcaccagcgcctgtatcgcgggcatcatccccaaatacatcgaccgcggcgacatggaaggcgccatcaagtgggccgagaccttccgtgataccttcgagcccggtgacttctacatcgagatccaggaacacggcatcaccaccgacaacggcctgactgacgagcagatggaccgcacgctcatcgacatcgccaagcaggtgggcgtcaaggtcatcgccaccaacgacttccactacctgcgccgcgaggatgcgcccgtgcaggacgtcatcatgtgcattggcatgaacgccaaggtcgacgaccccaaccgcatgcgcatgaccggctcggagttctacatgaagaccgaggaggagatgcgggcgatgttcccgtattgtcccgaggcctgcgacaacacgctcgagatcgccgacaagtgctatgtggagttggactgggactccatcatcctgccgcgcttcccgttgctcgatcccggcgagacgcacgagagccagttccgccgcgagtgcgagaagggcctgcgccagcactacggcgacgactgggccacgcgcgagatcggcggtgtcaacatcaaagagcgctttgagtacgaatacaaggtcatctgcgacaagggctttgccgcctacttcttgatcgttgccgagtacgtgcaatgggccaaggacaacggcatcggcgtcggccccggccgtggctcggccgccggcgctatcgtcgcctacgccatgaacatcaccgcgttcgacccgctcgagaacggcctgatgttcgagaggttcctgtccccgcagcgtaccgagatgcccgatatcgatatggacttcgacgatgagcggcgcctcgaggtcgttgagcacgttcgtcagctctacggccccgagaaagtcacccacgtcatcacctactcgaccatcaaggccaagcaagccatcaacgacgccgcgcgcgtcctggactacccggtctacatgggccagcgcctgtccaagatggtctcgagcgaccccaaggtcaaactcaagcaggtgctcgacaagcaacccggcaaagaggatctgtttaaccccgactttgccgaggcctataaaaaggacgacgacgcccgccgcatcatcgacacggcgctctctatcgagggcctcactcgtggcgagggcgtgcacgcgtgcgccgtcctgatctgccgtgaccccgtcaacgagcacgtaccgaccaagctcgacaccaagggcggcgtcgagattacccagtacgagggccataccgtcgccgacatgggcctgctcaagatggacttcctgggcctgcgtacgctgacggttatctccaaggcaaaggccaacatcaaaaagaacttcggcatcgacatcaaagaggaagagattccctttgacgaccccgagatctttaagctcatgggttccggccacaccgccggcgtcttccaggtcgagtccgccggcatgacggccacgatcaagaacatgaagcccaccgagtacaagcacgtcgtggcattgatcgccctgtaccgcccgggcccgttgggcgccggcatggtctcgtcctacatcaaccgtatgaacggcaaggagccggccgtctcctacgacgaccgtctggacgacatcctgggcgaaacctacggcaccatggtctaccaggagcaggttatgctcatctccgtcgagatgtgcggcttttccaagggcgaatcggactcgcgtatccgtaagcccgtggctaagaagaagatcaagctgctcacgtcgacggtgctccactgggaggacggctcggacgagaccacctacgaccactggatgaacggcgccatcaagaacaactacacgcgcgaggtcgcccagaagatttgggacgatgtcctcgagttcgcgtcctacgccttcaacaagtcgcactccgccggctacgccatcctggttatgcagacggcgtggctcaaggcacactatccgcacgagtacatggcggccgttctgacgtcctatacgggcaagaccgacaagatcgtgcactacgtctcggcatgccgtcacgacggcatccccgtgctttcgccagatgtcaacgagtccggtaccgagttcacggctaccaaggagggcgtgcgttttggtctggccggcatccgcggcgtgggcaccggcgtggcgcaggcgattatcgccgagcgcgaggcgggcggcccgtttaagacgctgcacgactttgtcgagcgcgtggactcgagccaggccaaccgccgcgtaatcgaatcgctgatcaaggcaggcgccttcgactccacggggtatccgcgtcgccagatgatgcactttgtggacaagaacaaccccgagaacatcatcgatgccgcggtgaagcgccagaaggatcgtgcgagcggccagacgtcgttcttcgacatgtttggcgacgttgagggctcgggctttgaggtgagcgtgcccgatccggacggccaggagtgggaccgccaccttaagctgagccaggagaaggaggttctgggcatctatgtctcggaccacccgctgcgcccgtttgagtatgcactagccaaggcgcgcgacttctcgttctcgcagatcgataccggctacgaagttcagaatcctacgggcggcaccatcaaccaggagattcccgagggcaaggcgctgtggtgggccggcatggtctcgagcgtgtccaagcgcgtgaccaaaaacggtgaccccatgggcatcgtgcagctcgaggacatggaaggcgaggccaccgtcgtcgtgttccccaagacctataaagaggccgaggggtacctgtacggcgaggtcgatcccgagaccggcgcgcagctgtccgatgcctttgtgcgcattaagggcaagctcgagcgctcggaccgcggcgaccagatcatcgcgcaggagatcgtgccgctcgagctcaacgaggagaacaacaagcccaaggtgtttgaggtcatggtgcctaacagccgctttagccagggcaatatggcgcgcctggccacggtgctcaccgctaacccgggcggcgaccgcgtggagatctttatcgagcaggtggacgggcgcgtgctgcgtgccgaggtacctgccaaggtcaacgcgcgttcgattccgctgctggccgaggccaaggccattgtgggtaaccagggccgcgtgacggtgatctaagctaccccgggtgagattggaggaagtgatggcgcaggggacgtttgtgcaggcgcttcgcaaagaggcggcgttgagcggcacctttatgaaggggcgttcgctcatgctcaacggcgccgtgctgtcgatcgaggacagcggctcgcgcttctccaaaaacgtgacggttgagggctcggtgcgcggctcgcgcggcgacctgtacaagacgcatgtggaactcgatgtggacgagcacgaggttatcgactacgactgcgattgccccgccgcgtaccgctaccctggcatgtgcaagcacgccatcgccacggcgcttgcgtatctggacgcaagcggcaccgagcccgtcgagggcctgcgcacgccggtccgcacgtttacagcggcgcccaagcagcccgcgcgccccgcgtccgctgcgccggcggtcaaccctaacttccctttcccggcgccagttcccacgagcccgagcctcatgaaggcgctctccgatctttcggacgcgcgcatggatgagctggcgggcatgcgccgcaagctcgcctccgccgtcgaccccgatgcccccaaggcggtgttggagccctcgttggtgccatactacaatccgctgtttgccgaccgctttagctgggcgctcgagctccgtatccgctgcggctcggtgtcctacgtggtcaaggacatcgacggcatggccgacgcctacgtgcgcggcggcacgttctcgtacggcaagaagctcacgttcccccatacgcccgaggcctttgatgaggtgtcgggacggctgctcgaccttgttgcgacgacggttgcctatctttatgacatcacgaggtcgcgctcggcgtcgtacgactttgcgcgcagcggctttgtcgccgagcgccaactgccgctgtccgagcatgacatcgtatacatgctggacttgctgcgtggccggaccatttcctttgagcccgcctggtcgcgggggacgacgacgcatcgttcctacgaggtggcggttgagtcgacgccggaaggggaggacggggcctcggcaaaacgtccgccgctccttgccgccaagatcgcgccggcggccggtggcagctacgacttgcgcctgcccgccgatgcgtactgttttgcctcgggcgacgtcgcctatctggtcgacacgcaccgcgcgcgccgcgccgatgcggcgtttgcccagcatgccgcaccgtttctgtcgcgcctgctgccctgccgcacgccggtccatatcgctgccgaacaggtgggcgagttctgccgcatggcgctgcccgtgctgcgcgaatacaccgacctcaccgctcccgccgtgctcgacaccgtggcgcccgagccgagttttgtcatggcaatcggcgtcgacgacggacttgtgacctgcaagatcacggttgcctacggcgattggtcggcagacctctttagcttgggcgctccgggaagtcccttcgaagaccagcgccccggcgtgccgcctcgtgacgtggtggcggagtttcgcgttatggatacggccgccatgtacttcgatttcctcgagggcggcttggcgtttgaggagcgcgacgacgagagcctgttctgcctgctcaccgagggtcttgctgccttgtccgagctgggcgaggtcatgctcagcgatcgcctgtgccagatctcggtgcgtcccgcgcccaagctttcggtgcgcgcgaccgtcaagagcaacctgctcgacgtcgagctgggcgcgagcgggctttcggcggcagaccttgccatctatctcgactcgtacaagcgccatcagacgtttgcgcgcctgacatccggcgacatcgtgcgcctggacgagggcgcccgcgctgcgtttggccttgccgaggacctgggcgtcgatgccgtcgacctgctcgacggcgtgtcgcttcccgcatcgagcaccctgtttgtcgatagcatgctcgcgcgcacgcccgcgctcgaggccgatcgcgatgccgcattccgtcgcaccgtcgagcgcctggacacgctcggcaagatggactttacggtgccggcctcgctcaaggccacgcttcgtggctaccaagtcgatggctaccagtggctcggctcgctcgagtacctgggccttggcggcatcttggccgacgatatgggcctgggcaaaacgctgcagatgatcgcgcatatcctggcgcgcgtggaggcgggggatgccaagcctacgctcgtggtgtgccccgcgtcgctcgtgtacaactggactgccgagctggagcgctttgcgccttcgctcgacgtgtgcgccatcgtgggtgccaaggcgcaacgccgcgtgcagatcgccggcgccgccgagcataacgtggtcgtgacctcgtatgatctcatgcgtcgcgatatcgacgaatatgccgagcaggactttgcccgcgtggtactcgatgaggcccagtacattaaaaacccgctcacgcaggtggcgcgcgccgccaagcgcctgcccgctggtgtgcgctttgccctgacgggcacgcctatcgaaaaccgcctgtccgagctctggagcatcttcgactttttgatgccgggccttttgggcacgcgcgagtcgtttgccaagcgctttgagagccccgtcgagcatgccgagggcgacagtgccgctcgcctgcaggcactcgtgtcgccgtttgtgctgcgccgcgtcaaagaagacgtggtggccgacctgcccgagaagatcgaggacaccgtcatggcgcagctcaccggtgagcagcgcaaactctatctggccaaccaggaccgcatcgcccagcaggtgcagcatcgcgaggccaatgagtttaagaaggacaagctcaaggtgctcgccgagctcaccaagctgcgccagatctgctgcgacccgcatctgcactacgagggctacaaggcggggagtgccaagctcgacgcttgcatggagctcgtgcatggtgcgctcgacggcgggcaccacattctgctgttcagccagtttacgggcatgctcgatatcatcggcaagcgcctggccaaggaggacatcggctttcttaagctcacgggcgcatcgtccaaggaaagccgcgccaagatggtcgtgcagttccaagcgggcgaggtgccggtctttttgatctcgctcaaggcgggcggcgtcggcctgaacctgacggccgccgacgtggtcatccactacgacccgtggtggaacgtggcggcgcaagaccaggcgaccgaccgcgcgcatcgtattggccagcagcacaccgtgaccgtgtacaaactcatcgccaaagacacgatcgaggaacgcattatgcagatgcaggaatccaagcgcgatctggtcaacagcgtactcggcggtgacggtatctcctcggcgctgtttacgcgcgaggacgttctggcgctgctgggaggcgacgggcgctaggctgcgcaggtggcgatcgggactgccgagacggctccaggttgctggcgcgccctgactccgggcgcttgcctcgctcgttatgtgttcatttgccatgccgtggatggttcgtttgcctttgggcataagaaccatcgagaacattggcacatcagcaaaggagaacatcatggcgaaattctttaaggaccccgaaggcaagctcatcgccgccctgggcgacgatgtcgcaacccctgccggctgcacggagctgaccgcaaacaccgaggacgcggcacacgagaagcacgtgcccgtcgtcgagagcgagcgcgacggccacgtgatccgtgcgcgcgtgggctcggtcgagcaccccagcctgcccgagcactacatcgagtggattgcacttgaagccgagggtcgtctggaggtccactacctccagcccggcatgaagcccgcgacgttttttgccggcggttccaagaccggtaccgtctatgcctattgcaacctgcacgggctgtggtccgcgacgttctaggagcgcgcccccgctcggggtatcatagctggcatatgtacatgcaagcgccgactgcatcttgcggccggcgcttttactacgatgacgacggtttacgatggaaagggctgagccatgaagctcgcacttgcacagatcgatatgcgcctgggtgatattgagggtatctgcggccgcatcgaggatcaggcgcgcctggcccacgagcgcggtgcgcgtgtgctgtgcgtgccggctccgctctttatgggcgccctgcccggtggcctggtgggcgctgccgactttgagcacgatatgcttgccggtctgaccggcgttgccgagcgcatccaggagctcgatatgatctgcatcgtgcccgcggcggtttcgtttgagggccagccgctgctcgactacatgatgctcaaggacagccgcgtggtgcccgcccgcgcgagcattgccctgcagcgtggcgagaacaacgatgcgcgctgggcgccgccggtgttcgacgtggacggcgtgcgcatcgcggtgattttcgacctggatcgcgagctcgagatgctgccgaccggcgtcgacctcattgcttatttccagttcaacgcattcgatatgaccaaccgcgagaccgctgccattgcagccgtgcgcagtggcgcttaccgcaagattgcatccaagcgcagcgtgtggtttgcctgtatggcgccggtcggcgcgtacgacgagtcggtgtataccggcgggtcgtttgtgctcgatgactgcggccgcgtggtggcccaagcaccgtgctttgaggagagcctgctggtccaggagattcagcgcggcgtgatgctcgatgctctggaggaccatgagctgcccgagttccgttccgaggagtggctgtggcaggcactagtgctcgccgtgcgcgacaacgcccgcgcccacggcacgtcgcgcgccgtggtggcgctcgagggcgacctgccgtcgtccctgctggcggcgcttgccgtcgacgccctgggtccgcgcaatgtgatcggcctggtgctggggcgcaaccgcatctttacgcctgcgcaggaggaggccgaggcagctcgctgtgccgccgttcgcgccattgccgagcgtctgcatattcgcacggttgagcgcgatgcgccggatgccgcgcgtgtgctcgaccgcgacgtgtcggcgggagacgccgagcgcctgcgctcgcgcacgcttggcctgatgctggaggatacggcgctcgagctgggcgcgatggcgctgagcccgctgtccaaaaccgagtacgcgctggcagcacccgctttgtgcggcggctaccagggcgattacgcgccctttggcgatgtgtacctgtcgacgctcgagtttgtggcgcgcgtgcgcaaccgtacgtctgccgtggtgccgcaggagctcgtgacgctcaacgcggtggaagattgcatggagcgcgtgctggcgcaggcgctttcgacgctcaatggtccggttgacatgctcgaccgcgcggcgcagctgctcggcgggcttgagccgggcgaggtcgatggcacgctcgagtcgcacgtggaccgcaatcgtcctttcgacgacatcccgatggccgctggcaagcctgaggcctgctcgctgctgctgatgctcgttcgacagggtgaggctgcccgccgtatgttgccgacggcgccgatcgtttcgtcccgttcgtttgccgagcgctcctggccgtacatgctcgcgtggtccgacctggggcttaacggcaaggagcgtatgacggtcgattcgctggcgcgcgccgaggtgcgccgttttgctgacgaggatacgagcgagcgcatgcgaaacgagatgatgggcgtgctgggtgagctactgggtatctcgcccgaacagatggaggagctgcgctctgaggacggtcagcgccgcctgcacgagggtatgaagaagtttgagggcgaggtccaggacgccatcgataagatgatgggcggccagggtggcccgcagggtggaccccagggcacgccgatgccgcatccgccggtggatccgaggcagttcccctttttctcgcagaactaactatgggataggattcgcttccaaccccgacacttcaactaagcatctcggccccgttgtgttattctagaacagacgttcgtgagtagtgcgcggggccttgccttgcgcttggtaaaaggcgaggggaggttggcttggtcattttgggcatcgaccccggtttggctcatacgggttgggggattatcgaggagcggcgcggtgaggttcgctgccgtgcctacggttgtatcgagaccagcgcgggtagtccgctcgcggtgcgcctgtcgcatatcgcccgcgacctcaagggtgtcgtggagcgttatcgacccgataccgctgccatcgagagcatctactttggcgccaacgttcgctcggccatccctacggcgcatgcccgcggcgctgcactcgtggctctttcggaatgcgcactcgagatcggcgagtacacgcctatgcagatcaagcaggccgtggtgggcactggcgctgcagataaacggcaggtcgcctacatggtacgcacgctcacgcagctcgatcacgacccgcatcccgaccatgccgccgatgccctggcctgtgccatctgccacgtaaacctcagccgcacccgtgcccttaccggtggcgagttctatcaacagagaggaaccggatactgatgatttcccagctccacggaacgcttgtcgaggccacgatgagctccgctgtcgtcgacgtgtcgggcgttggctttgaactcggcatctcgggcagcactgcggccacgttgccgacgcccggcggcgaggttcgcctctacacgcgcatgcaggtgcgtgaggacgccatgacgctctttggctttgcttccaaagacgagcgcacaatgtttgaccggctcgtgtccgtgtcgggtgtcggtccgcgcctggcgcttgccgtactttccacctataccgtgggacagctgtattccctggtgatggccgaggacgacaagggcatggccaaggtgcccggtgtgggcaaaaagaccgcgcagcgtctgatcctggagctcaagagcacctttgccaaggataagggctttgtgccggtcgacgtgattcccggacaggttgcgatgcccgtgcccgctgccgctccctcggcgatcgatgatgcccgtgcggcactcctttcgatgggctttagcccgcaggagaccgatgtcgctctgagcgggtatgatgggcaggatatgcgtgtcgaggatttgctcggcgcggcgcttaagcgactcggaatggatgcgtgatgtgggaagccgatgactctcaggacctgtgggcgacgcccggcaactcgccggcggcattcatggcgcacggcgagcgcatggtgggctcggagctgacggccgaggacctcgatgtcgatcgcactttgcgcccccagcgcctggacgattactgcggccaggagcatatcaagcagagcctgcgcgtgttgatcgaagcggcgcagagccgtggcgagacgctcgaccacgtgatcttctcgggccctccgggtctgggcaagaccacgctggctacggttatcgccaacgagctgggcgctcagatcaagaccacgagtggccctgccatcgcgcgcacgggtgacctggcggccatccttactaacttgcagccgggtgacgtgctgtttatcgacgagatccaccgtctcaaccgttcggtcgaggaggtcctgtaccccgcgatggaggactttgccctcgatatcgtgattggcaagggtccggcggcgcgctcgattcgcctggatattcccaagtttacgctggtagcggcaacgacccgctcaggcatgttgaccggcccgttgcgcgaccgcttcggcatttcatatcgcctggattactacacggtcgaagaactcgcgcagattgtgacacgctcggcgtccatcttgggtgtgacaatagaccatccgagcgcgctcgagatcggctcacgctcgcgtggcacgccgcgcttggctaaccgtttgctcaagcgcgtgcgcgactatgcgcaggtgcgtggcaacggtcccattgagcttgatatttgccgtcaggcgctcgagttcttcgagatcgatgagcttggtctggactggatggatattcgcattttggagacactcgctaagacgttctccggacgtgccgtgggcctgacaacgcttgccagcgcggtgggcgaggacccgggaacgctcgaggatgtctatgagccctatctgctgcagtgcggcttgatgattcgcacgccccagggccgccaggcaacgcttcgcacctttgagcacttggggattgaacctaccatttagggcgctttgttttggcgggctgttaagctatcgctgagcattggataaacatatcgccattcatcggttacgggtgttttactattgcgcgcccgtgctatgctgaattggtctttttctcattcggtaacgaaaggaccgcccatgcctactgacatcgaaatcgcacgttctgtcacgccgctgcctattaccgaggtggccaagaacgccggcgtcgacgttaagcacctgattccgtatggcttcgacaaggctaaggtcgactattcactgctcaacgagccgaccgatcaccaggccaagctcgtcctcgtgaccgctatcaacccaacgcctgcgggcgagggcaagaccaccacaaccatcggtctggccgatggcctgcgtcgtcgcggcgtcaagagtgccgtggccctgcgcgagccttcgctcggccccgtctttggcgttaagggcggtgctgccggcggcggctgggcccaggtcatccccatggaggacatcaacctgcactttaccggcgacttccatgctatcggtgccgccaacaacctgctggccgccatgctcgacaaccatatccagcagggcaatcagctcggcattgacgttaagcgcatcacttggaagcgcgttgtcgacatgaacgaccgccagctgcgtcatgtcatcgacggcattggcggtaaggcccagggcgtgccgcgcgaggacggcttcgatatcaccgtcgcctccgaggtcatggcaatcctgtgcctgtctacgagcattaacgacctcaaggagcgcctgggcgagatcgtcgtcggctacagctttgccggcgagcccgtccgtgcccgcgaccttaaggcccagggtgccatggccgcgttgcttaaggacgcgctcaagcccaacttggtgcaaacgctcgagggcacgcccgcgtttgtccacggcggccccttcgccaacatcgcccacggctgcaactctatcatggccacgcgtatggcgatgcgctttggcgatgtcgccattactgaggccggcttcggtgccgatctgggtgccgagaagttcctcgacatcaagtgccgtatgacgggcgttcgccccagcgccgtcgtggtcgtcgcgaccgctcgtgcgctgaagtacaacggtggcgtcgccaaggccgacctcaacgaggagaacctcgaggcgctcaaggccggcatgcccaacctgctgcgtcacgtcgacaacatccagaacgtttatggtctgccctgcgtggtcgccatcaaccgcttcccgacggacaccgaggccgagcttgcgctcatcgagtccgagtgccagaagctcggcgtcaacgttaagctttccgaggtctgggccaagggcggcgagggcgcgctcgagctggccgatgaggtcatgcgtctgatcgagcagccgagcgagctcaagtttgcctatgaggacggcgccgatgttgctgacgcccttgaggccattgccaccaaggtctaccgcgccgacggcgttgactttacgccggctgccaagcgtcagctcgccgagctgcgcgagaacggctttggcaaccttccggtgtgcgtcgccaagacgcagtacagctttagcgacaacgccaaggccctgggcgctcccgagaacttccgcatcacggtgcgcgagctcaaggtttccgccggtgcccactttgtggtcgcattgactggcagtgttctgaccatgccgggcttgcccaaggtccccgcggctgagaacatcgacgtcgacagcgacggcaacatcaccggcctgttctaagcctgttgcccctagctgcctgcccgccccgccgtgcccccaaggcccggcggggcttttttatccttaggcccgcgcatgtcttgtagataccgacgggctctgcccatcataggcttttgcgcgggtagaatgcatggataacttgatgctcacgcgcgacggaaaggaatcgttgcatggatcaggacaagacaaccgtgatgggcggctacggttccgcgcaggctggcgatagcgccgatgcgacccgcgttgttcccaacctcggttataccgaccccgccgcgacgcagccttctgccgagcccacccgggttatgggctatggcgacacggcgcaggattcgtacgctacatcttcgcaaggcccctatggcaacgcagctccggatccgtttgattacgcgccgcaggattcttatgctgcctcgacgccgaatccctatgacaacctgccgcagaatcccattccgcagcctcagcagacgacgtatatgcctcgcacggcgcagcctcgctacgagtcgcgcgagccgtatcgcgagtaccccaagtcgattccgcaatatggcgaggacgaggagaagaagccgtcgcgttcgtcgagcgtgatcaagaagatcctcatcgtgctggcgatcttctttgcgctgtcggttgtgtttgccatcgtgtcgggcatgcttaacaagcgagggagttcaacggccgatgccactgttgagcaaaccgagtccgcctcgtctagcaccgtcgatctgagcgatatcccggggcagtactggtccaacgccaagaagatcctcaagtcgcgcggcgccgatctttcgaatgccgtggtcctgactgatgatggctcaacgcccgtcgtcgatgccaactggatcgttacttctgcttactataacgacagcggcaacctcgaaattcagctcacgcacaagaacagctcgggcaactcgtccggcggccaaagcggtaccgacagctcgagctccaatacgctggaggacttgagcaacaaggcacaggagttgggagacaaagcgcaagagctgggcgacacggcgcagaacctgggcgacaccgcgcagaacttgggcgacatggcgacggatgcctggaacgcactgcaaaacggcatctcgggcgcgcagggaaactagctgttaagcgggctacagctgctctgctggacggtcgggcgaactaaagcccgagtcaaacgtaacgacgcatgagacgttgggccggcgctcgtgcacgatgcgcgtgacgagctccagcagctcctcgtcggatatgtcaaagccgtcgggacgcaccaggtcaaacgaaacgaacccgtcgtgctcgtgcaggtcgtggatggagagtgcggggtcgatctgcatgatgccgcgcttgacccagccgcgcaaatcatcgccggttgtcgcgatggggtcgcagtgcagcgtgataccgatgtccatctgccgtttgatatcgtgctcgatggcgtccaggatctcgtgatgttcaaacgcatcgccctcgccgggcatctccacgtgggcgctggcaaactgacgaccggggccgtagtcgtgcaccatcaggtcgtgtgtgcccaagacctgcggataggacatgatcttgtcgcggattgcctggacgagcttggggtcgggcgcttgtcccagcaacgggctgatggcgtcgcgcactagacccatgccgctgatgcagatgaagatgcccacacccaggcctgcccagccatcgaggtcgaagccggtcgtctgcgaaataagcgccgccaccaagaccgagcccgaggtgatgacatcgtttttggagtcctgtgctgtggcgatgagcgtctccgagtcgatgcggttgcccagcgtgcggttgaacgcggccatccagagcttaacgagcatggacaagacgagagcggctaaggagagcaccgaatatgcagtgggggaaggcttgatgatcttagtgaccgactcgaggatcaggttgatgccgacggcgcaaaccaggacggcgacgaacagaccggctaggtactcgtagcggccgtggccataggggtggccttcgtctgccgggcggctggcaaggcggaacccgagcaggcttacgatgttgctcgaggcatcggagaggttgttgaaagcgtcggcgatgagggagacggagccggcgagcaggcccgcgatgcccttggccaggcacagggtgatgttgaggccaatgcagacgaggcttgcggaaaagcccgcgttggtgcggcaagatgcatcgaccggctcgctctcgctgccgggaacaagcgtatgtaccagccgatttacaaatagcatagcggtcgtcctcacaatcatgtttaaggggatagtgtagctcgcgcgggggcgccgtgcaccgatgctcagaaaatgcagcaatagtctgccggtgctaacgagcgagccttcccgtctgcctgggtggtccattttgggccacatgggtatgggcatgtgcctgtttgctcgacatacttaatgtcgacagctttgtgcaaaggaggacgtttccatggacgagatgtttgccattaaatgtcaaaactgcggcggccctatgtactcgcaccaagctaagcgcagctttgagtgcgcttattgcggtgcggtcattccgtggcaggcggacgccggagagcccaagagcgctttgggcattcgccatacgccgttgacggtagtggatggactgctcaagctcacgcatgtgtcgcaactcgagcgcccggaggacccggactggtatttcttcaattcgcactggcgcaatcagtcggtcctggaacatctgctgtgggaggaccgcggcacggcgcaggagttccaagaagcgacgcacgtgagcattccctgccccttctgcggagcgtcctttgagggcgagtcaacgcagcgtgtgtttgagtgcccgtcctgcggcaacaagatcggcattgccgacctgctcaagcccggtacgtttagcaaacgtctgaccatgggcgtgggtgcggagtatgtgccggagcagggtattccctgcgaaatttcgccgcagcaggcacgtgccaacgcgctgcagctggtgcgccagtacccggatgcctttgccgggcacgacgtggaagacgcgatccaaaacgacatgatgctcttctattccccatggcgctggcggacctgcgtatgatggcgagcttcccgggcaagggcctgagcaaggaaaccctggtgtactacgaggtgctcgactgggcgtatccgcgggcaaactatctggatgttcgccttatgggcattttggagccgtgggactttgccaaggttgggccgtttgacccggccatgcaggaaggtgactttcgcgttgtctccgtcgatgcgtctaccaaggaccaggtggtcattgataagttggcgctcgacattgccggcaacgatgccgaggcaaccctggggctcaataaaaagagcatccgcacgtgggcgcgtaaggctcgcaagcacaaggatggtctggtgatggtgccggtctactttgtcgatcgcccggcttcggatagtcgcgacggcgaacaggtgcgcatcgccgtgaatggccagacgggtcgcgcggcagcggtggtgtttagcgacaagcgcgagacgcatatcgtggcgccgctcaatccgagcgtgatgctgtcgagcgaaagcaccgtgcacgccacgcccatcgaggtcaaatacgtcaaatctccgttcctataccagatcgtgcgccgcggaggcggcgagcagccgcgccaggtggcggccgcagccgagggttccatccgagaggagaagcccagacgccgcggtctgctgggtgcgctatttgggaagtaggggagcggtgctggttagtcttatgacgcgatagccagggatatggagcagctcacgggagcgcgggctgccgtctgattgtttgagggtgccagatgtaaataaacagtggagcggctgcaaaagagcctcctcactgggtaaaatcaggttgtgccgcggaacccgctcctcagcgcttaaacttcggagacgcgggcaacgcaggtattatcgtctagggccggctgcaaccggcccttttcatgactcccttcgctatccgttactgcttatattcccgccagatcgcgtagaggttccgggcaatgccggtcacatacatcgagaggcgcaggatttcaagaaacaagttcataggcttcaccccaatcggagatcggagcgttgcccgcaggcggattccgcggcagtcaagattttaccctatacgccgcagcgggggatatctgaccccagtgttagagtggtgtccatttgcatggatgaccgggcatgatcgcgacatgtcctggagttgaaatgccgctggggatacgagggggagccggggtcggatgttggggctcaacgaagcaagtggcgcttctgtctttttgggatcggggatgcgaatcaacctgcagcaatgggcccagctcgattcggggcgcagtgagtcccgaatcgagcgttcctggctgccatgcatgtcaggtgatgaaagcccacagcggcatcgccttacacggcaacgggggcctctttggggcgtcccacccttggtgcatcggcgagtcgtgcctcgatggaggctttggacatcatgcgcttggtgccatccttccatgaatccagcagtcctgcatttagcagttgtgacacccgtgctgagctaacaccgagcatacgcgcggcatccactgcggtgacggcgggaatgtcgccgagttcgcggttgacggctacagcgataatcttgccgccgtgtcgcggctcatgtccgaagtctggcacgggaagttcaatgccatctgaatcaaagaactcgaattcccatgcgtaaaccagataagacctcctctaatggcgaataatacgaggcgtgctcctagaatattccgttcgcatcgatgcagctgagcatacccatcttaaagcctcgcgcggactcgcattactgtgctgtttggcaccttcgcatggggccttgcggtgactaaaatgtggcaatagagacagttttagcgaaccccacgggagtgacgcgtatggacaacaacacgctgctattccaggacaaaggttcgggtaggtttaaagacgttaagatctaccccaatcgtatcgaggtgctcaagaagggcacttttggcggcaggcacaccgagattgtctaccttaaggacatcacggggggtcaacaggatcaagggtcgcgacgttttcctgcgtaacaggctgttgaccgcttgcgtctttagcctgagtagccgtgcgaaggcccaggaatttgtgaacgcgctgaacatggtgatgtagccgatagcggcgttcgggccaaggtaaaaatcggggcgcagaacggtattctgcgccccgattgagttaatgcgcccaaaagactggcttgcctattcgttaacgtcctcggtattgtcgcggtcactggcaagcattgctgcacctgcgaccgttgtcgccacggcggcggcagcgagcccggcggcaatgccggagccgtctcccgtgtcggcgagttttccgcccgagctcttgccctggtcgctcttgttgcccttgccattcttgtcggcgccgcctgcgttggaacccgtgtcggtgctggcgccgtctgcactgtccgaggccgctacggtaaagcttgcggctccgtcgctggcgagcgtgtagttctgcgccgcgtcgcccaagagaccgttcacgcgcacccagtacgttcctgcggcaaatgtttcgccctcggccattgccgtgcccggagcgccgttcgcgtcgtgcacaaactcgagctgggccgcgcaggcatcgttttcgagcttgccctcaagcgatgccgcaatcttagcacgcacgtcctcgccggccttaaggtcttcgagcccctcaaaatgaggcgtcagcgctcgcggatcgatatcgatgggcacggaacctcgcagtcccgtaacggtctcgttgccctgggcgtcgacatccacgtattcgatggcaaacgcatggcccgaggctgccacgttgagtacattgctgctgtcgacgaggcggaaatggccctcgccaacggtcttgccgccctggagcgaagcttcactcagcgagttgccatacgtcatgcgcatgcgggctgggaggtagcacgaagctgtctgcttgtgctgcgtatcgtaattgcgctggtagatgctccgggccagcgccgcatcaacaaagtcggatgcgatgatgccaatgtgcttgaggtaatctgactttgtatcctcgatgccgctgggattgatgtacgggctcttatacagatgctcgttgactactcgtgccgaggtaaatggattgcctccgtgcgacaagcccgtgcagctggtgtagttgatagaccagcaacgctcctggacttgcaccttggcctcgtcatcgtccacgacgtccaccttgttgcgcgtgcgcccggtcgtttccttcagcgcattatcgacccagctgagcttgtcggttcccgtgagtttgtacttgtcctgggcgtataccttggtgcaatagggctctttgtcgcctgtttccccgcggcttcaaagccccgcgcgtcttggacgagacacatagtggcgctgtcggagtgagccttgatcttgtcatcccattcggtaaggtcgaggccccacgtatggtcgcttacactgttgccggcgagcctaaatcgacgcagcagaacgatctttccgcgcacctcgcccagcgtggggacgtggctcgacgtgtagaacagatcggggttgtcgtccaaaaccttggcgaaagccgtcgtaacactttcgtcggtagcctcgtcgttgcctcgtgatacaagcatgatgagcgcttctgtcgggttttcgttcaaaaacgttttgaagtagcctatgacatcggaaagatgcataaagtacgcgtcttttttgagcaggtagtaatccccgtggtcgataccggggtcgtcgccctttccgagccggatatcaaaatagcgaatgccttcgagcaactgcgtgggaatgtaatcctgctggcattttacttgcgaggattggggctcagtgtcgttgtccacgctgcaggtgcccgaatcgtgcgtacccgggatgctcagctcgtcgaggaacttgttgtcgtcgacgtatttcatccaacatggcccatcgacgtagctgctgtacgtgatccagtcgaggctgctaaccgtgacatcgttctttttcatgtcgtaaccgataagttcgagctcccacggaatgctcttactcttatggcagatcttattgttgtcctggtcttcgccgttcgattctattgccaggtacttaatgtcttttttctcggtttctttctcgaccgtgcggtctcggatgatataggttccgtttgattggcgctcgaacgcaaaagcgcggctgggcttgttgtcatactcgccgccccatacgtggatgacctttccatctttgtcagagtcgtcgtcgaccgaccaaatgctgtagcccgtctttttatgctcttcgaaattgagcaaggtgcggatagcataccagtttgtatcgtcattcttggtcgttacgttctcaaggatgagcttgctggacgtgccgtcgttaaacaggtggcagacgttgccgcgaacgttgccgtcttggttgacgctcgcggtgcgaaaaaagcccgcggggcgaaggcgaatgacgaaattgtcgaggctgactgacgctgtgacagcgtcttctgcaaatgccgcgcgcacgggaaggcccaatcccgcggtttcgggcaggcttgcaaatggcgacaatgctgcgagtcctaggcccaacgtgaatgctcgacggctgatggcgtggtgttcggtcataacttctccattcgcagagtgcggttatgcgatagttttggtcactatactgctcagatgtttaaagatgctggtttaattgcctgcgcggcacaataaatcggcgggcggacgtgtcggggcgtttgtcgttttcgtactgttgccacatttggggcggttccgacgtccggcatcctcgcgttcgtcggctacaggcataagaaagggagggtcggtttaccggccctccctgggtatgaagcgctagggtaccgtcgcttgtttgcactgcgaccgtgtttcccgttgcgctcgccagtcgcttagcgcttgatctcgatatcgtcgagcttgacgtccatggcctcggtcttggcctcggcgatgtcgtcggcaaattccagagacttcatcatggtctcgacggcgtccttgtgctcctcgacgttgtcgatgcgcacgtagacgctgccgcctgcttcggtgaagtactcagtcgtcacgccgcccgagtgtgtataggaagcgttgcgccaagtcttgccgttgtacttgacggggtcattctcggtccactcaaagctggcattccactttgcctcgtagtcgaacagctcgtcagcgttcttgtcagagtcgaagacagggatgaagcgatcgctggcgtgctcgctctcggtgaacttaaactgggccctgtcggcggtatcgcctgcgacgtcggtgacctcgacgccctcggggacctcgaccttaaaccagatgaagtcggtcctcatatccgcggctggcttttccgcaccgccaccgctgccggtagctccaccgcttccgccacagcccaccagggcaaccgcggcaaagagactgatgcagagggtgagaatcgcaaaggccttctttttcatggtcgtgtcctcctcgatctgtaaccgcccatggattacctgcctttactgtacgcgcgagcggctcgttcgagtgggccatgtgtcccattctgagggccggatttgcgccattaagtggcaatatgcggggtccaaaagaggggagggccgatgctgtcggccctccccggggttgggtgcccgttgctttaatggggcgcatgtgcgcaggtgcgcgtaggcgcgtgcgggtgtcccgttactcgagctcgatgctcgaaatctcgacttcacgtgcctcgtcaactgctttcttcatgtcgtcggggaactcgatggagttgaggagcgcttcggcttctttcttgtgaaggtcgacgttcctaatcatgatatagacgcttcccgtgtcgacgtcggtaaagaggtaggtataagtgccgccgttgtccttgcacgttccggtgagccatgttctaccgttgtactcgacggggtcgccatcctcccactggaacgttccggtgtgcctttcggcctgctctgcaaaggactcttcggccgtcatcttctcttgccaaacggggatgaaacggtcgactgtggtgttctcgttctcggggaaggtgagctggaccctgtcggcattcttgccggcggagtcgcttacgccgacgccctcgggcatctccaccttaaaccagatgaagtcggtcttcttggcgacgggggccttttccttgctctcgctcttgggggcgctgccgccgcccgatgcgctcccgccgcagccgacaagggcaaacgcggcaaagagggcgatgcagagggaaaggatcgatagggtctttttcttcatggtggcgtcctccttgtctgccagggacatcgtgtgccgcggatcgctggggcggcggttacgcgcacgcgatggctttgtttgctgtgctgttgttcctccattcgtcgtccggtgccgtgatgagcttgccccaacatagggctccctacttatatgtatgccccagttgccgctgcccggaagtctcgaaaggtgggccatgtgtcccatgtttgcgttgctgtcgcctatcgtgtgccatagaaatccgcgatggccaggtgcgctgacgcccatgtgcttatgggctagacttagcaccattatgtgatcgatgcggtcggtcggcggttgccacccgaccgatgtatatgacttgaaggtgcatgcgtatgagccaagagatgatggacaagacctgccgcgggtttgccgaggcgcttgccgcgcgcgagccggtgcccggcggcggcagcgcgagcgcctttgtgggtgcgctgggcgcctcgctgtgcgggatggtcgcgcgctacggcgcgaccaatcccgcgcttgccgatcgcgcggatgacctgacgcgtgcgtttgcccaggctgatgagctagcccaggagcttgtcgagttggttgccgaggacgttcgtgcctatgggcaggtgtccgcggcgtacggtattccgcgtgacgatccggctcgagcgaccgcgattcaggatgcgctgcatgtggccgctatgccgccgtatcgcattatggatgcctgcgggcgtgcactggcgctgctcgaggacatggccgacaagggttcgcgtcagctgctgtccgatgtggcgtgcggcgccgtgttctgccgttccgctatgcagggcgcgagcttgacgctctttgcgaacaccacgtctatgaaggatcgcgctcgtgctgaggagctcgagacggcgtgtgatgagttgctcgacacgtggttgccgcgcgccgatgcgctggcgcgccgcgccgccgacgctgcaaggaagagaggatagccatggctgaactgctgaagggtgctcccgttgctcgcgctttgactgaggagctcgctgctcgctgcgcagccctgcgcgagcggggcgttgttccgacgttggctatcgtgcgtgtgggtgaacgcgaggacgacctatcctacgagcgcggtgcgctcaagcgctgcgagaaggttggcattgaagctcgccgcgttttgcttcccgccgatgtttcgcaggacgagctgttggcggccatcgaggacataaatgccgactcggctgttcatggctgtctgatgttccgcccgctgcctgctgggcttgatgaggatgcggttgccgcggcactcgatcctgccaaggacgttgactccatgacgccggcttcgctgctcaccacgctttcggggcgcggcgagggttttgccccctgtacagccgaagccgtgcttgctctgctggatcattacggcgttgagctggatggggctaaggttgctgtggtcgggcgctcgctggtgatcgggcgtcctgttgccgccatgcttacggcgcgcaatgcgaccgtgacaacgtgccatacgcatacgcgcgaccttgctgccgagtgccgtgctgccgacattgtggttgccgccgttggacgcgcgcgcacgattggcgtggacgcggttcgcgagggccagacgatcatcgatgttggcattaattgggacgaggccgctggcaagctggtcggggacgccgattttgatgccgcggagtcggttgttaacgccatcacgcccgtgccgggcggcgtgggcgctgtgacgacggcgatcctcgccaaacacgtgatcgaggcggccgagcgcgcatcgaaataggcgttttgggctgtttgaggggttagttctataccccgtggacaaaaaatgccaaatatgagtactgttgccaagatagtcacatatattttaggtcaaataggctctctaacgatatttattatcgatagagagcctattttattggacctatgaggaattacatcatctaatttttgaacaaatgaagactttcgacacccatacgtagcaaaattgctgttactaaattggtgacagtactcatatttggcattttttgaccacaggggttgccagcgccgtggtttcgccctttctgcgccgaagcgatacactgttgccgtttgatttcttcgctcaaggaggatgcgcatgccgtgcacaacgattttggttggtaagaacacgagctacgacgggtcgacgttggttgcccgcaacgaggactcgtccaacggggtgtttgagcccaagcgtatgcgcgtggtgcatcccgacgagcagccgcgcgtctacacgagtgtcctgagtcacctgaccgttgaactgcccgataaccccatgcgctacacgagcgtccccgatgttgtcccgggccacggcatctgggccgaggccggtttcaacgagttcaatgtgggcatgtccgcaaccgagacgctcaccaccaacgagcgcgtccgcggtgccgacccgcttgtggactacgtgcccgccaagggcaacgagggtgaggacggctatgtgccggcgcagcctggtggcctgggtgaggaggatatggtgaccctggtcctgccctacgccaagtccgcccgcgacggcgttcgtatcctgggcgacctgctcgagcgctacggcacctacgagaacaacggcatcgcctttagcgacgttgacgagatctggtggctcgagaccatcggcggccaccactggatcgccaagcgcgtgcccgacgacgcctatgtgaccatgcccaaccaactgggtatcgacagttttgacctggatgacgccgagggcgcccaggccgaccacatgtgctctgccgacctgcgcgcctggatggccgagtggcatctggacctgacgctgggtgtcgagggcgacggtccggctgcggtcttcaacccgcgcgaggcctttggctcgcacagcgacagcgaccacgtctacaacacgccgcgcgcctggtacatgcagcgctgcctcaaccccagcgacgtgtgggatggtcccgaggcagactatacgcccgagagcgacgacatcccctggagccgcgtgcccgagcgcaaggtgaccatcgaggacattaagtacgtgctctccagccactaccagggcacggagtacgactgctacggcagcaagggcacgcccgccacgcgcggcgcctatcgtcccatcggcatcaaccgcaacagccagctcgccgtgctgcagctgcgtccctatgcgcagccggcctatcgcgccgtgcagtggatggcctttggctccaactcgtttaacgcgctggtcccgctgtacgccaacgtcgagaccatgcccgagtactacgccgacacgcaggcccgcgtgacctccgagaacttttactgggccaaccgcctgatcggcgcgctcgccgacgttcgcttccacgagtgtggtcgcgcggttgaggactaccaagagaaggtcggcggcatgggccacaagcacatccacgacgtcgatgccgccgtggcagcgctgcccgaggccgaggtttccgccgagctggcgcgcgccaacgaggccttcgccgagcttgtgcgcgtggagaccgatgccctgctgggtaaggtgctctacaccacgagctgcgccatgaagaattccttcgcgatgaacgataacatcaggtaaaacgctttgtcgctttcgcgcaatcttgggtacaagaaggccaatgcagttgttcatgattggagccaaccatggttatgaaattcgatcagcttgttaacggcgccatcaacgtaggctttggcgccgctgccgttgccgtcgagggaggcaagaaggtccttgacgacctcaacgccaagggcgagcaggtgcgcaaggacgccgacactcccgatatcgcccgcagcgtatccgatatgttcgagcaggccggcggcaccatctccgaccttaccgagcgcctgggcatgcagggcgagaccgcggcgcagcgcgtgctcgatgagctcatccttgctcgcgtccgcgtcatgaccgcgccggagcgcacggccttcctggcccacgtgcgcgacatcgtcgattcggtcgaggacaacgtgacctcggtgcccgtcgagtccgttgagcccgacgacgcagaggacgccgaagaggccgagtagtagcgcagatggcagatcccaccaccgattacaacaatcaagatcccttgtgtgacgaggcggcagttgtcgacgaagtcgaggctgccgtctcgggcactcgcaagaagccccgcgccgtggacatggtgcctgaggagcccgacgccatggctccgtgcgacgagtaccagctaacgccggcgggtcgtcgcgagcgcattggacagatcgtccgcctcgtcaaaaaataccgcgtgtgggacaacctcacgccggtgcgcctgcgccgcctgctcgaggagctcggccccatgttcgtcaagatggggcagattttggccaaccggtccgagattctgccgcagcgattttgcgacgagctgcgtcgtctgcgctccgatgtagagccggtgccgtacgaggtggtgcttcgctgcctagaggaggaatacggcctgcgtctgggggagatgttcgacgcgatcgaccccaacccgcttggcagcgcctcgctcgcgcaggtgcaccgtgctcgcttggtgacgggcgaggacgtggccgtcaaggtgcagcgccccggtgcgcaacaggtcatggcccaggacatcgatatcatccgctcggtggtgcgcatcgtttccaagttcgtcaacaccgatcaattcgttgacttgcacggcgtggtcgaggaactgtggacctcgtttcgcgaggagaccaactttttggccgaggccaaaaacctcaacgacttttacgagttccataagagcgtgcgcggcgtgtcgtgtcccaagtcctacttggatctgtgcaccgagcacgtcgtggtcatggattacatcgatggcatctcgattgccgaccccgagcgcctggtggccgagggctacgacctggagaagattggctcgacgattgtcgaggactattcgacgcaggtgctcgacgacggctttttccatgccgatccgcatgcgggaaacatcattctcaaggacggtatcgtctactttatcgacctgggcatggtcggacgcatgtcgagccacgatcgtggcatcgtcaaggacatgatttttgccgtggccgagggtgacgtgcccaaactcaaggactcgctcatgcgctttgccgtgacacgcggcgattcggctgagctcgatcactcggcatttttgtccgatctggactttatcgttgccgactttgcgggtctcgatcttaaggacctggacatcggcgagttcttgacctcattgctgaacttggcacgcaagaacgacgttgagctgccgagcgtggtgacgatgttcgcgcgcggcatggtgacgctcgagggcctgctgaccgagtacatgcccaacgtcaacatgatccagatcatccagacgcatatcaaaaacgagaagagcacctacgcgcgcatgcgcgacatgagtcgcgattttgcggcgagcagctaccgtgcggccaagggctcgctcgaggcggctgagtacctggggctggcgtcgcgtatgctcacgcgcggtcagcttaaggtgaacctgcagctcatgagcagcgacaaggcgctgcgtcagataggcggcatcgtcgaccgcatgtcaatggccatcgtcatcgccggcctgtttatcggctcttcggtggtttactacgcgcgcatcgagcctgttgtgctcggtattccggtcatcggcttttttggctacgtgagtgcgctggttttggcgctcatgctgggccgcaatatctggcgcaacagtcacggcggcaagcactagcgtagctgcgcggtgtcttgtcccacggcgcccttccatacccaactctttcctatcgcaaacaatagcttttacctcgggcttcgcctgtgtgcgaggcccttttgcgtgataccatactgacggtgataatcaatggcctagatggtggtgcggagacgcacgaatgcgcggttttcctgcgcatttgggagaatcggggtgcgaatccccggctgtaccagtaaccgtaattcctcttggctcgggatgctcgcgtcgcagatcggacgacgcgcccgagccgttaaggttaagtcggatcgcctcccatcttgcatgcggctgcggcgtatgccgccggtgtgcatagggctctggagggaagggggaccccgatgggggaactcgagcgcagcatgcgcgatgacgtgggccagcctcagggcaacgctccaagtacagacagtaggagacaaatggatatgttcgaggacgagcgccagcgcgcctcgcaccgccgtggcgcaattgcgcgcggcgtagccaagcgcggcctggtggcattcctggccttcgcgatggcctttggcaccacaccggctcagctgtgggccgacggcgtcgagggcattgccgaggctgcggctcaggctacgacgccgggcgagaccggctctgatggtgccgtttcgggttctgccgagcagagcaacgccagcgcttcggattccggggcggctgcaactggctcctcgacgagcggagcagtagctggcgacgaaggcccggcgacgggggagaaccctgccgcgagcgagcagtcttcgacggcatccgctggccaagcaggatctgccgccgcgactgccgtccagacagagagcccgacagaaaccggcgatgtcgccaagaagcaagtcgaggtctcgttctcgattatcggcaccgatgccgacggcaaggctcagacctgggtggcacctacgcagctcaagctcgacgagggcgcgacggctgcggatgccttcattaagctgcaggagaagacgggcttcaaggcggactacgatccgaacacggcatacgggttctacctcaaaagcatcacatccccgagcgatggccgcacgcttgcctacgatccgacgacttatgccttctggcagctgtttgtcgatggcgcgtcttcctcggttggcgcgagcagcgtcaagctcacccaggggcagaagattgagtttgcctatacggctggtagctcgtcccctgtcgttaaggaccagcttgccgcaaatgtgaccgtcattggtcgcgatgcccagggcaagactcagacttgggtcgataacgcgcagtatgtggtgacgtccggctcgagcgcacttgaccttacgaaggtcgcgctcgaggcgaatgacatcgacgccgttgctgcgggctccttcattctgagccttaagtacaacggcgttgagctgggtacgccgctcgattattcgacctattggcagctgttcatcaacggcaagtcgagcgacttcacggcagacaatgtcaccattcatgctggcgataccgttacgtggttctacggtggctggggcgaccagttgccctctgattccgtccatgcttccgttcaggtcctcggtaagggcaaggacggcaagcagcaggtttgggcctcgacgggccaggcgagtctcaaggcaggctctactgccaaggatctccttgagcagaccggccttactctcgatgctggcgaatcgccttggggctggttcctcaacggcattacttcgccgttcgatggtaagtcctatggctgggatgctgcgactaatagctattggcgcttctacgtaaatggcaagttcgccgacgttggcgccggtgcctacaggctccaggagggtgacgccgtcacctttatgtatgctggcgacagcgatgccctccctggtcaggtgcttggatccgccgatgttgtcggtcccgacgtcaatggcaacaatactcgctgggccgcggcgagtaacgtttctctgcccgaaggctccacggctcaggaccttatcgaggcggttcttaaggcaaagggcgttgattacaacgcctctcagagcggcgcatactggctcctcaattccatcacctcgccgttcgatcacaaaccgtatggctgggatagtgcgaccaataaatactggcacctgtatatcaatggtgaggagtcctctttctgcgccaaccaggtcacgctcaagagcggcgacaaggttacgtttgcctatacaaccgatggctcgcccgtgcccgatcccgacaagatcgtcgtggacccgagcgcgacgacccccgattgggatcccgagtgggccggctacggcaacagtggcaacggttcgaccgtaacggatgccaagacgcctgcgcaggccgccggccttaagtgggccttcgattggaaggccgagtctggccagcagtatgccaactgcagcgagcctgtcattgctaacggttttgtgtacatcgcgaccgagaacgagctcattaagatcgattcgtctgcgggtaaaaaggtggcctctgcgccgcttgcctccaaggtgagctatacctctcgtccgatctataccaacggccttatcatcgttccgctcaacggcggtgcggtccaggcgattaccgcggacaagctgatctgcaagtggctgacgcccggtttgacggaccttacgcagagctcctgtaccgttgtttcggacggcgagtacgtctatgttggcacggtcgatatctcgtatgacgagaactacaacgcgacttacggcaacggttcccttaagcgcatcaagatcgccacgggcgaagtctcttggcaaaacattgacgcttccgagggttattactggactggcgctgcgctgacggataagtacaccattgttcccacgagcgcgggcacgcttaagtgcattgacaaggcaacgggcgatgtcgtttcgagcgtgaagctcggcgcggtcgcaaacgccgattgcatcgccgacccgtccaatggttcgaccttctatcagatgacgcacgacggaaagctccacgtgatttcgctttcggcgaagggcgtgctgagtgagcagaagacggttgacttgggtcttacgaataatctgagcgcccctgcggtgtctggtgacaacctgattgtcggcggacagacggcatctggttctgctttggctatccataacctgaagaccggtaagaccacgatggttactgctgcagacggcaaggctttgccggctgggctgaacggcattgctgctacgccgctggtgagcgttcagggcggcaagacctatgtgtactttaccgttaacagcgcggataccaaggactatgtcaactactctgccggcggcggcgtgtaccgctatacgctcggcgatgcagaggcgacgcagatttacgatgcggctggccattaccagtactgtgactctccggtcattgccgatgcatctggcagcctgtactacatcaatgactcgggtacgctgttcaagcttggcgccgttgagtcctggacgatctccttcaattcaaacggcggatctgcctgcgacactaagtttgtcgctacggccgatggcaagctggtcaagcctgccgacccgacgcgcgagggttacgccttcggcggttggtataccgacgaggcgtgcacgcaggcgtatgacttcagcacgccggtgacggccgacctgacgctgtatgccaagtggaccaagaacgccaccaaccctggcggtaatggcggttctggctccaacggtttcaacggcggcactggcaacggttccggcgctggtgctggtactggcacgggcgctggctccggcacgaagggccagcaggctggtgacgctatcgccccgggccagaagccgacgaccaagacgacggtgtccaccaagacggagaccaaggaaaacaagtccgacaagaaggactccgacaagtccgacaagaaggacgagaagaaatcggacaagaaggacggcaagtccgataagaagtccgattccaagtccgacacgggctctgcttctgcgaccactgccaagaagtcctctggtgcttccgagcaggagaccggcaccaatccgcttgccatcgttggcatcgcggcgggcgtgattggccttgcgctcattgccgtcttcgtgctgaccaagcgcggcaagggtgacggtaatgcccgataagcccaaggagaccaacgggcaacagcccgactcctcgtttatccagctcgacgatgcacagcaaaaggacgccgcttcggcggcgtccgcccctcgccgcaaggcactcgttagcgcccttacggccatctgcattgcgctaatcgtcgtctcgctgggctttgtccatccctccgcgagcggtgcttggtccattgattggatcgtccagaccgtgacgggggagagcgtcgtcgccaaggacgccgcgggatctggctcgtctgctgcttcggtcaaggccgattccaaggattccaagtcatcgaatgatgcaaaagacgagtccaaggattcggatgagtccaagtccaaggacgatgccgagtcttcaagcaaggaatcggacaaaaactcagacggcaagaagtccggcgaaaaaggggctggtcataaaaagaccgacagcaaccagtcgacttctcagaattcgacagcgtctggcggaaccggctcatcgtctggaacctctgtcgcgtcgggtggatcctccgccgctcccgataacgacaatgcctctgcgggcgaccagggcacctctcaggagccgagctacgttaccgtgacggtctcggtcacttcgagcgccgtgggcaatcctgtctcgtctggcggtacgttcaccttcaacgagggcgccacggtttacgacgctctgtgcgcgttgggcctttccgtaaatgcgcacggctcgtcgtacggcacgtatgttgcggctatcggcggcttggccgaaaagcagtatggcggcacgagcggctggatgtactccgttaatggcgcaacgcccatgacggcctgcagcaactacgttctatccaatggcgataacgtcgtctggtattacgtgacgggctaggagccttgacataacaagccaaacgggcggttcggacaaacatccgggccgcccgtttttactgcgaatgggacggagtttcccaatcgatgttcaactggaaagcatgtcccactttgaaagcgaattctgggacacagtttccgaaacagtgccatcgggaaaccatgtcccgttctggcggcgaattccgggatgtactttccgcttgagcggcgttgcggaaaatgcgacccgttttgaggccccaatccgggacgcgctttccgaggcagcgcccatggggaaggcgcgtcccatttcggcatcgtagcccgcctcacgcgggttctcggcaaataaaaaccggttggaacgtgaattccaaccggttacaaatgcgaggttatgtttgactgactacgagcgtgcgccctcgaggaagaagcggcggctgaagtagttgtaccaggtgaccaggaacgtggcgatggccttcatggcctggtagccgatgctcaaaaacgtgacgcccacaaacatgtacaggtcgttgaggcccaagccgatcaccgacaggatggtgaagatcgtgaactcacgcttgcggctcatgccctcgcggtgatcgaacacgtacttcatgctgagccagtagttgaccacgacggacgtgatgaacgagatcgtggtgctcatcaaaaagtcgaggtggaacagctcgacgagcgcaatgagcatgccccagtcgatgccaaaggagataaggcccacgacagcgaacttgaggaactgcttcgtatgaggttgtgccagtgccttgcgcacgtaatcacatccaatgcgttgatgaatcgagcagaggatactttagagcttttgcaagggaaacgtaaggtctttgccaagaactatatgaactcgccaaatttgcaagagacaatccgcaaacgtgccaaatttgcccgtaaacgagtagggcccgcggacgatgctgcgctgagcgcataccgtccgcgggccctgcaatacagcaaagaagccgagctacttggtctcgtcgccctccaggaaaatcttgcgggtcacaaagttgtagaccatgacgagcgcggtggcgcagatcttggcgatattggcctcgagtcccaggccggcgttgagtgccagcacaatgccgtcgttgagcgccaggccaatcacggacagcacgacaaagatgataaactcgcgacggcggctcatgccctccttgtgcgcgaacacgtacttcatgctcgcgacgtagttaaagatgagcgagacgataaagccgctggtgttggcaatcaggatgttaaggcccaggccgtagtggagcagattcatgatgccgaagtcgatgacggtggcaatgacgccgacgacgccaaacttcatgatctgcgcaaggagcttttgcatggtacctgccttaagctggcgccgaagcgccgcggggatgacaaacccagcaagtttagccaatccccgcgggcggggctaggcgcgctcctcgatagcaccgtttctatatgcatcgagcagctggcgcaggtcctggatctggccacggattttggcgccggaatcggtgtcgcttaccatgcggcgacggtcggcctggtcaaaacggttggtctcgctctcgatgtccacgttgcgcgtgagtgcctcggcaaccgtcgtaaaggcccggtgcgacttgaggcggcagccgcgcgagctcgagatgagcgtatagccggcgatgcccgtcttgggatggtaggcgcggcagaagccgccatcgatgaccagcagttttccgtcggcgcggatgggttgttcgcccttggtggtcttgacgggggtgtggccgttgatgatgtgaccggtcggcgaacatgccatggggacgacgccgaactcgtgcatgatgtcatcgcagaccgagggcgacgtggtgagcgtgtagtacggatccatcggctcgacccaggtgctcttgtcggcgatataggcgcgctcaaaggtgcgcaccaggcgtccgctggcgggcgagttaaagccgatccacaggtaccacatccagtcgagggcgtcacggtcgcccacgcgccaggcgcggcgggcgatgtggtcgcaaaaatcgaaataatcgcggccggcgtgccaggtgcccaggcagttcatgctgctaaaggtgccgtcctcgttgagcggcacgcagccgtggaacagcagattgccgttggcgaccttgtacatcgagccgtgggaatagaggaaatcgatatggcgatgcaggtgatcggcggtgacaaactcggacacgagcttgtcgatgatgtgctgctcctgagacgtgagcgtataggggtccgccgggtcgacggtggggaagtcgttggtcgtgagcggccacacgctgccgtcggcgagcgtgaccgtgccggtgccgtgatcgatcttgtcgagtaacagacggtcggtcatgtcgaactcgggatggcgctggataatctggccctcgagcttaaagagcaggacgttgatggccttgatcagcggggtgatggactcaccggcggtgtaggtggcatcggcaaaggcgacaagctcacgcagcgagatgccgtagtcgttctccaggatctcgtagttgtcgtagcgtaggttgttgcgcagcaccgttgcgatgcaggcgggctcaccggccgcagcgcccatccacagcaggtcgtggttgccccactggatgtcgagtgaatggtaggtgagcaggcggtccataatcttggcagcgccgccgccgcggtcgaagatgtcgcccaccaggtgcaggtggtcgacggccaggcgcttgatgagcgaggcgagcgactcgataaagtcgtcggcgctggcggtctccagaatggactccacgatgcgctcgtgataacgcacgcgatagttgttctcgtccggatgcgtgtgcagcagctcgtcgatgatgtaggcgtaatcgcgtgggatggccttacgcaccttggagcgcgtatagcggctcgaaagcgagcgggcgaccatgatgagctggtcaagcatcgtcctgtaccaggtgggcgagtcttcgcgccggctgcggaccaggtcgatcttctcgcgcgggtagtagatgagcgtgcacagctcgcccttttcgtcaaaggaaagcgtgtcgccaaaaatctcgtcgacatgttcgcgcacgacgcccgagcagttgttgaggatgtgcataaaggcttcgtactcgccatgcacgtcgctcataaaatgctcggtgcctttgggtaggttgaggatggccgagaggttgataatttcggtaaatgcggattgttcggtggggaactgtctcgacagcaggcgcagatacttgaagtcttgcggattgcgatcgaatgcgaccatgaaacaccttccgatagggctggtaaaactgataaacagcgtaaaacgtttatcagtatgcgccgcttttgtttcgattggggatgggcggccgaattgttagccgaacggtttggtaaatcgatttagtggaggtagatatggcggttgagtggagacgatagagggtgttttctcagatatttatgcgtggggtcggtggaaacgatggtggtaaagatgttcgctatttttggttcgatttggtaaatagtggacatatgtaccgtatgtaggctcactgtgcgataatttgcgcagcaatgagtaaggagcctcatatgagtgattttgtcctgacctgtgaatccgccgccgatcgaactcgggagttctttgaatcgcgcaatatccctgtcgtgtgttttcattacgagatcgacgatgttgtctatacggacgatctgtatcagtcgattacgccggacgagttttttgcccagattgccgcaggcgccatgcccaagacgtctcaggtgagcgtgggtgagtacgaggagttttgggagccgcttgttgccgagggtaaagacgtgctgcacctgacgttgtcgtcgggtatttcgggtacgtatggctcggcttgcgttgcggcgcagatgctcgcggatcgctatccccagggcggcaaggtgcgcgtcatcgattcgctggcggcgtcttcgggctttggcctgctggcggaatgtgccgccgacgtgcgcgatagcggggcttcactcgacgagacggctgcctggatcgaggagcacaagctcaacctgcaccactggttcttctcgaccgatctgtcgagctacctgcgcggcggtcgcatttcggctgcgagcgcgatcatcggcacggcgcttaagatttgcccgcttatgacggtcgattgcgaaggtgggctgtcgccacgtgagaagattcgcactaagaagcgcgcgatttccgagatggctaagaccatgatggcacacgtgcaggacggcgcggactattcgggcaagtgcgtcatgtcgcactcggcgtgccgcgaggatgccgaggcagttgcggcgctgatcgaggaacagattccgcagcttaaaggcaagattgagatcaataacatcggtactctgattggctcgcataccggacctggcacggtggcgctcttctttatgggcgacaaacgcgtggattaatttgccccatcacatcgctgcatgattgctcaaacgaaaacggcccgcctcacgtttgtggggcgggccttgctgttggggttagcgtttctttccgcggaagaagaagccgtgcagtgacggcttgaggccgcggttggcgcgatgctcctcgacgcgctcgtggatcgaagcgacgcgctcgatgacttcgtcgggaatcggcacgtcgggattcatgttctcgacctggctgacctcggcggcggagacctggtcgataatgggcacatcgtcgtgcgagatgacaggtgtggcgtcttccttcatcttgcgataacgctgcatcatgtcggtctgtagctgctgggccgaaggcggcgtccagatgatggcgttggcgccggcggcgatggtttcacggatgctctcgggcgtcttgccgcccggcgcgatgagcggcaggttgggatagtgcttgcgcagctcgcgtaggacctggggcgtgttcttgccggcggcgatgttgagaatcttggctccagcgcgcaccttggcgtgggcatcgtcgtcgcagcgaacgaccgtagcgatgacggggatgtcggcaatgttagtgatgtgctcgaccatttcggcggtggcgggggagttgaccacacagcccgccgcgccctgcatctcggagacggctgccatctgaacggagcgcttgccggtggtggtgccaccgcccacgcctacgaagaccgggcactcggcgacggtcagcagcgcctgcgtaatggcgggctgcggcgtgaaggggtaaacggcaaagacggcatcggcgttggagttgcggatgaccgcgacgtcggtggtgtagatgagcgatttgatacgacggccgaagagcgtgaagccgctggcttcctcaatctcgtcaggcatgcgaagggccgccttgcgcaggcgcccgtcgatgggcagcggctccatgggaagcagtccgttgggggtcacggctacctggggttcggtgaactcgtctgcgagctcgacctcggagaaatcgaccgaggcgacgatgtcctcgtgaacctcggcgggcacatcgatgggggcttggtcgtttgccgcggcaggcgtgtcgaaggagctggtgccgacgaaggcgtcgacgcgctcatttagatcgttgagggtatccatggaagctcgattctatgtgatgacggccggcgcgatgcagccggaattgcgaatgctaaatcgtttgacgagttgatttttccccgccgcgccatccgttagaccgaagggccggcgaacgtgaaggagctgtggtggcgggtattgaggtgctatcttgaatgtcccgtttaaaagagaggtgacgcggtatggaattgacagcaatgtttggctcgattggcctgtgtgtgggcgcaatcgttgccgccgcggtcatctactttgtggtcacggccattaagggcaaaagggccgaacgcaaggagcgcgcgatgcttaaacagcatcgcgaccagcagggcaaacgcgcacggagatagcttgttgagttttggatccgtgcgctagctgcgttttcggatcagggcaatgtagaagccctcaaattcgcggctgggcggaatggtgagcgtgccgggcaggccgttggcgatggccgatacctgacccgcggcaatggcctcggtcagggcgttggactcgatgcgcggctcctcgccagcttcctgggcgcggcgtgcctcactttcgcttggcgtgccgtcgagggggatgagctcgcagtccatatgcttgtcgagggcctcttgcagggcgtcctcgttttcctgcggcaagatcgaacaagtcgaatagacgagcgtgccgcccggtttgagggctcccatggcgcggtccagaagcgcacgctgcgagcgggcgcatttgacgagcagctgctcggtcaggccgcgcaggcttttctcgttgccgctgatgacggtgcccgtgccggtgcagggagcatcgagcaggatgcggtcaaagcggaagaactcgtcgagctcgcgtgcgtcggtgcgcatgacgggcacgttttttgcgccttggcggtggaggttggcttcgagcttctcggcgcggggaatgctcatctcgcaggcggtaaggtgcgcctgcccctgcgtgagggcggcgatctgcgtcgtcttgccgccaggggctgcgcacatgtccaggatgtcctcgcctgcctgagcgcccaggaccagcggcggcatcatggacgacaggctctgcaggtagatcttgccgtcgcggtagatgtcgagatcccacaggtcggaaacctgggcctcgggcaggatgaaggcgtctgggtaccaggtgacggggttgtgggcgatgccggcggcatcgagcgccgcagcgatgtcctcggcggttgccttgagcgtgttggcgcgcagcgtgaccgggcgtgtggccgcggcgccgaagccctcgatcatgagctcggcatcggcgggcgcataggcgccggcaaccgtgtcgaccataaagcgcggcaggtcggcggcggagtgttgggcggcaagctggtcggaaagctcggtagcagcaaactgcctgagcttgagctcggccttgacctgctttttctgcttacgacgacgcggcttggacatccgtctttccttcctgttccattacatgtcgagtgtttagtactggctctcgtgcttgctgaagaagtcgaagcgcgggggcagcggctttacgcggtgctcgccgggcttctcgcctaggctctccacaaactcatccgtggaggcgaagatgttatcccagctaaagaaggcgaccggatcgacgttgaagtactcgcagatgagctcgcagccggcagggacgatgccgtgcatgagcacggtcgccacgcgcagctcggtaaaggcgtcgacgagggcctgcgtcattgcggcgtttgcctcgttaccctcgagcttgttggcggccttggaggcatcgctccagcgcttgttggcggcgcgcaggtagtcgtcgcacacggcgagcgcgcggtgcgtctcgaacttgtacatggcctgctcaaaggcaagggcggcctgctcggcggcctcgaccacggcggcagaggccgcgccggcggggatacagccgttgcggtaggggctctcgtcgccctccttgacggcgacgccgtagaagcagctgcgggccaggcggttgaacacgccggtcaaaagggcgctctccttaagggccggatcgatgacgcgcttgtcgtcgcaggcgcgcacctcgttgccgtccttgtccttgccggtcacgcgggtgtcgtatgccttggggctaaagctcactggcttttcggacaggccgagcgacagccagtgcgcgcgcatctgctcgcaggtgtagtggttgagcaggtcgtctgccggcgggggaggcgtctgcgaggacgagctggcctttttgcccatgtagagcaggtggtagcaggcgctgacggtgctctgcgttaggccccagcccagggcctcccacatggcggtctgcgcgatgcagtagaagtagatgttgtcctgaccgataaactggtagatctgtgcgtcgtccgagcaccaccagtcgcgccagtcgagcgagctgtgctggtaggtgggcgcgggcacctgcgtggagtcggcagcgggctcgcccatgagggcggcgtcctgggcggcgacgccctcggtcacgccggcggccttagcatcgcgcgcgagcacggtacgcgtatagctgatgggcgcccacaggctctcgggccagcaccagcaggtgacgtcggagacgccatcgacctcgggcaccggaacgccccagtcgatgttgccggtgatgcggaagggcacgagtgccttgccgctgcggaagcgcacgccaccgttggcgagcaccgcgtgggcgtcgtcgcgctccttccagctggggaaggtgacggtaaagctgctcttgttgccctcgggctccagcacggtgtgctcggggagctggtcctcgacggcatcgaaggcctcgcggaacttgttctggatgtagagctgagccggcagcagccactcctccatggtcttggagaccacggagcgaacctgcgggttctgggcgagcttggcggtgtaggtcttcataaagtcgaggtaggccggcaggtcaaagtagagattgtcgaccgggcgcagctcgggcacctcgccggtgagctggctcttgggcgcgatgagctcctcgggctcaaactggtggcccaggtcgcactcgtcggcataggccttctcggacttgcagccctggatggggcagcgtccgatcacctgacggccgttgaggaacgtgccggccttggcatcgtagaactgcagcgtggagcgcttggagatggtgccccgctcgtgcaggcgcttgataatctcggcggtcacctcgttgtgaatctgcgcagccggctcaaggcccgagccgccgtagatgtcgcagctgatgttgtagttgttgagggtcgcggcctggcgggagtgattggactcgacatactcgctaatggacttatcgtagccttcgttctccttgagcttgcggtagctctccatgatgggcgagccgtagcagtcggtgcccgaggtgaagatgacgttctcgcggcccagacggtcgcgcaggaagcgggcgaagaagtcggcagggacaaagacgccgccgacgtggccaaagtgaaggcccttgttgccgtagggctcgccggcggtaacgatggcgcggcgaggccagctgggacggtcgttcatggagtatttggatgccatgggactccttcgcatatggtgagagcgcggccgggcgcaaggcctggcgacgcagtggtcaattcgtgcatatcgttcgacattatcgcacatgcgggcgggtgcgtggcaggggcgctatcctaagatgctatgaatgagatttccaacatacatgcgtttgaggacgaggattttctgcacgcttgcttcgtgtgggggatggtcgtcgtcggcgtgtttgccgtgtgcctggtgccggtgtttatgctgctgggcgggcctgcggatctggatgcggctgacgcgggcggctggatggctgtcgtgggctggatagtcggcttgactgcggtctcaatggcgtcgtttgccgtgcacgagctggtgcacgcggtgttctttaagctgctggcgcctgcgggcgcgaaggtgacctttggggcgaatcgcgagacggcgatgatctatgcctgcgccgaggggattgtgtattcgcgccggcggtatatggcaatttgcctggcgccgacggttgttgtgacgacagcatttgccctggggtttgcgttctcggactatccgctgctgtgctacctggcggctggtctgcacttgtcgggctgcgtgggcgattggtattacgtgcggaccatcctgcgcggccgccgcattgtcgcctgcgaggatacgtcctttggcgtgcgcttttttgggtgaggagatgtcgatgaagtcgttgttgctgcatgcgtgctgcgcaccatgctcgcttgagccggttcgcctgctgcgcgaggaggggtttgagcccacgatttgctggaccaaccctaatattcaacctcacgatgaatggcagcggcgtttggacgagctgcgccggtggtgtgccgatggcgacatcgagctcatcgaggccggggaggaccgcgaacgctgggagaccggcgtggccccgctgggtgccgatcgtccccgtcgctgtcgcgcgtgctatgccttgcgcttggccgaggcatgccgcgttgcccaggagcgcgggtttgaatatgtgggtacgacgctcgccgtctcgccgtaccagctgttcgacacctgcaatgacgtactcgaacgcctgacggcggcacgtgggctcaccccggtcattcgcgattttcgcccgtattatcccgaggctacgcgccgttcgcgcgaactgggcatgtatcgacagaactactgcggctgccgcttttctgctgtcgaggcggccatggaccgcgcccgcatccgcgacgagcgcaaagccgccaaaaagtagttcgtttgggacgtcagcctgctaggatgtagagcggactttagctatataaggagtatcagacgtgtctatgcgtaccgatgattttgactacaaccttcctgaggaactgattgcccaggctcctgccgagccgcgcgactcctgccgcctgctggtggtggatcgcaaaggctcccaggcggggaagccgctggagcacggcggtactgttgagcaccgcatcttccgcgacatcatcgactatatcgagccgggcgacgtgctcgtcatcaaccagacgcgcgtgatgccggcccgcctgatcggtcgcaaagccggctcgggtggcgtggtcgagacgctgctgctcaagcgccgtgaggatgttgacccgctgggccacgtttgggagtgcctggtcaagccgggcaagcgcctgaagcccggtgctcagattgagtatcgcgccggtggcgcccatgcgcccgagggggctcccgtggtgctgacggccgaggtcatcgactttgtcaccgatagccgcggtggccgtctggtgcgctttgagccggccggttgcaatgccgccggcgacccgcgcacgctcgacgaggccatccatgctgccggccacgtgccgctgccgccctacattaccgatttcgagggcgaccccgagaagtaccagaccgtctacgccatgaaggaagagcactcggctgctgctcccacggcgggtctgcactttacgcccgagcttatggctgccatcgaggccaagggtgccaagtttgccgccgtcgaactcgaggtgggcatcgataccttccgtctggtggaggaggacgatcccacgcagcatgtgatgcacaccgagcgctaccacgtgtcgcaggaggttgtcgacgccgtgcataaggcgaaggccgagggccatcgtgtgattgctgtcggtaccacggcggtgcgctcgctcgagagcgcgtttgacgccgatgctccggtgtccgatccggctgtgacggcgcgctattttgagggccgcgaggatggggccgatacgctcggccgcggcgacatcgtggcgcgcgagaacgctacgacgcagctctacctcatgcccggctcgacctatcacgtggtcgacgcgctgatcacgaacttccacgtgccgcgctccacgctcatgatgctcgtaagcgcgcttgccacccgcgaccagatcatggatgcctacgccgccgccatcgaggagcgctaccgcttcttcagctttggcgacgccatgctcatttgttagttacgcggttctacgaaccgcgtaactgctcgacgctgcaaacgcccctaagcggcaatctgacgttcaaggacttgcagcgacggacctcaggacactcttacaccacgtctgcgcgcgcgaccctctcagggaaacggcatcccagaatttgagctcaaaacgggacacagtttccaaaacaggcccgttccggaaactgtgtcccggaatcggcgctcaaactgggatgcagtttccgaatcaaggctctacgggaaactacgtcccagtttgagggtccaacgactagttgtccttgtggaagaggcttttgatggcgctggggatgctcttggcgcccttggcggttacatcgataaagtcgggcgaacgcacgagcttatcctcgtcgacgtacttgcggaccgcgcgcaacgtctctttgtcgtcgcgcgtcgaaaacgtaaagtgaccgttgtccttggtgaagatggcaaaacgcgtgatcttcttggtgccgcgcaaaacctcggcggcaatatagtcgacctcgtcccacgggatttgaatataatcctcgggattacgctcgttgtaatactcgaacgccttattgcccaccatcacgttaccgtggctggtaaggcccataaggcaggttgccggcgttgccagatcgaccgtgctgttctgagattgcgccatgcgcgcctcgccctccaaataaaacaatcggaccgcatccagtgtacccaccgggtgcggtccgtttcaatggctcaaaagcccttgcctagcaattctcggtcttaagccgaagcgcgcttacatgaagccgcagacgcgaccgatgatgccgatggcgaagagagccaggatgatgacgatcgggctgaccttcttcttgaggagcttgcagaccagcagggtcaggcacacggcggcaaggccggggatgagctgatcgaggttagcctgaagcgtggtgaccttcacctgatcaagggcgttagcaccgatggagttatacatcgtcagtgcttccttgacaccctcagaaccggagggcagattagcccagtcgataaaggcgccagcagactgcgtgaccttggagacgaccggggtgaaggagatggacacccagcgctcgaccagggcgccgatgatgaacatacccaggatggaagcgccctcggtgaccttgcccatcagaccgccggagaggtccttggcgatggaggagccgaccttgtagccaaactcctgcgtgtaccacaggaaggcgtaacggatgatgttccacgcgaagaagaacagcagcggaccggcgatgctgccggacagggccagggaagcgcccagagcgcccagaatcgggcgaagggtgaaccagaaggcggggtcgccgacgccggcgagcgggcccatcataccgaccttgacgccctgaatggcgacgtcgtcaatcggagcaccgttggcgcgctcctcctcgagagcgagggtaacgccaatgacgggggcggaaacataagggtgggtgttatagaactccaggtggcgcttaagagcggcaatctggtcatccttgctggtgtagagcttcttgatcgcagggatcattgcgaagcaccagccgccgttctgcatacgctcgtagttccacgagccctgaaggaactgatgacggaagcaaaccttcttgcggtcagccttggtgagttgaatcttgttctctgccatatgtatcactcccctcctactcgtaatcgttcagaatgtcgccgagcgggtcgccggagccaccgcccatgccgccaccctgcttggccagatccttaaggccaaggtagataagggcaagggagatgccgatgaggccaagggcgatcagcgtgagctgagggatggcagcaaggacaaagccgaggatgaagaacggccaagtctccttggtggccatcatgttgatgaccatggcgtaaccgacggaagcgaccatgccgccgccgacagccatgccgccggacagccagtcgggcatagcgttaagcgcgttggtaacagcctcggccgggatgatgcacagaagcactgccgggatggcgatacgaaggccctgcatgaggatagcagcgtactgccagcgctcgatgccggcgaagtcgcccttctcggcgcaaccgtccatggcgtgagcgatagcggtagccagggtacggcagatcatggtcaggaacagaccagcgaccgacagcgggacggcgacggcgatagcggcggtaacggccttggccgaatcggtggcgccaccgttgagggcgagcaccatgatgatcgaagaagcgaccgaggccagagcggcgtcaggcgcgacggcggcgccgacgttagcccagccaagggccatcatctgaagcgaaccgcccaggaggatgccctcctgaaggtgaccggttacgagaccgataagcgtgcatgccacgagcggctgatggaactggaactcatccagaatgccttccataccggcaagcaacgcgacaatcgcaacaagcagaatagtgattgcagacatgtatcggaccctcctttactatgcttgagcggccagttcggccttagctttcttcaacatggcgtcgagatcctcggaggaatccgaaggaaccttgcggacctcgaacttgacgcccttggccttgagagcctcgagagtcttaacgtcgtcatcgctcatggcgacggcgttggtgacgacgaccttgcccttggagtgagccatggaaccgatgttggcttccttgatgtcgacgccggcctcgatggccttgagcagatcctgcgggttctcgaagagcagcatggccttggtgtcaccaaagcgcgtgtccttgacgacctcggccatcttcttgatgggcacgacgttggcatggactcccggaggggcagcctgctcgatcatggtcttgcggagctcgtcgtgagcaacgccgtcggaaaccacgatgatgcggttggggttgatctgcttggtccaagtggtggccacctgaccatgaagcagacgggtgtcgatacggacgtgggcgatcttgatgtgcccgtcgccgatgaccgttcccggagggatggcgcctgcaggagcagcggcggccgcagccggcttcttctcctcgggctccagagactcgggcttgacgcgcacgccagccttagcctcagtcacgagatgttttgcgatcgcatgtgcagtgttctttgcgtcaaagcgctgcgaatatgcctcgatgagcataggcaggttgacaccggtgacgatagcccaggaatcgtggccctcgatgagcccgctgatctggttgaacggcgtgccgccccacagatcaacgaggaagagcacctgctcctggtcctcgaaggaagcgactgcttcctcgaccttggcacggaagtcgtcggggcccatgctcggctcgagcgagaccacggctacagacggctgatcgccaaagaccatcgagcccgtctgcttgattccagctgccaagtccccatggctagcaagaacaatacttaccatcacataacctcctttttgtctacgtatttcctacacgacaataatggagtatacctgttcgccttgtggatttatagctaaattcgcaaaaggttggattatttgtttaaacgtcaaggtttgttacaagttgattacattgctgatttttggcttattacctgctaaatcgtagcttaagcgacccgatattttgacatatacaggcgcactgttcattaataccgactataactagatgaaaaggtgctcaatgcggcgcaattctgtttaaacaggctgaacttgactgctaatgacaaatatgctctgaaaatctagccaaactgaacaatagcgacaaaaaagttgcggtggaatagttcctgattgggggccatggggccgattttaggaactgtttcaccgcaactgatgaggggctaggcgatgtggagggggttggcggcgtcaacggcatcgggggtatcggcggatgcagcgaggccgtcggggtcggcgtccgcgggctcctcgtcgggagtctcgatctgcttgatcatgacctcttggccctgcagcagataggtctcgccgctgccgcaatggggacaggtcttgccgtgctcgaccgtgccgtagtcgcggccgcacgcctcgcagtgcgtcacggcctcgacaggttctacgataagctccgccccctcagtgatgggctttttatctgccgcccaacgccaagcatcgagcagcaggtcgggaacgacgcccgagacctcgcccagcagcaacgtcacgctcgagacgcgacccacgccattggcgcgcgccacattctcaacatcgcgaatgatgtgatagacgattcctaattcatgcaaggcgggcacctaactactttcgaccaaatttaattttgatcgcacgcttgaggacgtacttgcccaggctggggagcttttgctcgtatttgaccatggtggagcactcggggcgatcgcgatcgaggtggatggcatcgaaggcgcacttggtagtgcacaggccgcagccgatacacttgttgggatcgacgatcgaggcgccgcagcccaggcagcgggcggtctcggtgcgcacctgctcctcggtaaaggtctcgacgtactcgctaaacggcgcagtcttctcgcgctcacggtcgacgtgggcaacctcgcggctcgcgttgtcatagctctcaatcacgacatcgtcgcggtcgagcgcggtgtagcggcgctggttgcggccgatggtgagcgtggagcccggctgcacaaagcgatggatggacacggcggcctcgtgaccagcggcgatggcgtcgatagcaaagctcggaccggtgtagacgtcgccgcccacaaaaacatcgggctcggtggtctggtaggtctggggatcggcaagagcgccctgaccgcggccaagctccaccttggagccagccagcaggtcgccccacacgatggactgaccgatcgacatgacgacacgatcggcatccacacgacgcaggtcgttctcgtcgtactcaggcgcaaaacggccctcatcgtccatgacacgcgtgcagcgcttaaaggtaacgccgcacacacgaccggcctcatccagatggacctccttggggccccagccgcagctgatgtgcgcgccgtcctcgatggcctcgcgacgctcctcctcgctggcgggcatctgggcctcgctctccaggcagaacatctcaacatgctcggaacccaggcggcaggcgttgcgggccacgtcgatagccacgttgccgccgcccaccacgatggtgcgaccgggcagcgcgtcaatcttgccgctgttgacctcgcgcaaaaagtcgacggccacagtcacgtcctcggcatcctcgcccggaataccggcaaggcggccgccctgacagccaatagccacgtagaaggccttaaagccctgcgcgcgcagctcgtcgagcgtcacatcgcggccgacctccacgccgtagcggaactcggcgcccatcaggcggatgacctcgacctcggcctcaatgacatccttctgcagcttaaagctggggatgccgtaggtgagcatgccgcccgggcgctcgttcttctcgaacacgacgggcttgtagcccttctcggccagataaaaggcgcaggacaggccggccggaccggcaccgatgattgcgatcttctggtcgaagccgccggcgcgcgtcggcgtcaccacaggcgggacataacgggtcgcggcatccaggtcgcgctgggcgataaacttcttgacctcgtcgatagccacggcggcgtccacgcgaccgcgagtgcaggcgtcctcgcagcggcggttgcacacgcggccgcagatagcaggcagcgggttctcgcgcttgatgagcgccagggcctcgtcgtagcgaccctgagccgcgagcttcaaatagccctgaacggcgacatgcgcggggcaggccgtcttgcagggtgcggtgccggattcgtgcgtctcgatacggttgtcgttgcgatagttaggcgaccacttggtgtggtcccacttggtggcgtcgggcagctcctggcgcggatactcgggcacgtggccgccggcctttttgctgcagagcttctggcccagcttggcggcgccggcagggcacacctcaacgcagcgaccgcaggccacgcacttgtccttctcgaccttggcgacataggccgaacgcgataggttgggcgtgttgaacagctgcgaggtacgcagggcgtagcacacgttgacgttgcagttgcagatggcgaagattttgttctcgccgtcgatgttcgtgatctggtgcacaaagccgttgtcctcggcctggcgcaggatgtcgtagacctcgtcgcgggtcacgtaatggccgcggtcggtctcgaccacgtaatcggccatatcgcccacggcgatgcaccagtcggccggatcgtcggcgcaaccctcacccatcacacgacggctcgcgcggcagctgcaggtgctggcggcatacttgccctcgtatttgtcgagccaatgctcgatatgctcaatgggcaccgaggtgctcgtggcgtcaatggccttctcgaccggaatgacgtgcatgccgatgcccgcgcctccgggcggcaccatcggcgtggccttggacagcgggcccttggacgcctgctcaaagaacttggcatagaccgggtgctcctcgagctggctcacgcgcatgttgaggaactcggcagaacccggcaccagcatgggcagcacccactgcttggcacgctcggggttttcccagttgtactcgagcaggcccgtgtagctcatatcgtcgagcatcttctcgatatcggcttcgggcatgccggtgagcttgaccatctcgggcagcgtatagggacggcgcatcttcatcttgcagagcacttcggcctgctcgtcagtcgcggcctcggcaaacgaccagtactcgtagcccagcagctcatcgcgatgcagcagacggttggtgcagtgctcgcacagcttgacgatggcctcgcgcggatgctccggcagcggcggcacgaactccgaaccgatgtcgggctcggtgtagctaatccccggtccgttgagaatcatggttgtcccttctcttgccacagcccgacgagaccgcggcacccctcttttttgcaggccgggcatgcccccatgccgttcacccgccattagttgacattgtgtcaaaaatagtattgacgaaccgtcaacaatattcaagactgttaggcgaacggtcaggcaaaagaggatgaaaggcggcaaaacatgggcaacaacacagcagatacctctgtggtcgatgccgttcccgcatccgatagcgcggcaaagcgcctgacgggcgacgaacgccgtcgcgagatcctcgatgccgtgcgcaccgtaagctccgagctgggcgtgtcccacctatcggtatcggccgtgaccaagcgagccggctgcacgcgttcattgttctaccactactttgccgatatggacgccgccgtcaccgccgtcatggacgaggcaatcgacggttttatctccgagctcgagcagtggaatgccaaccgcatcgtcggtgatatcgagggcgcactcgacaccgtcgccccgctctttaagcgcctggtcgccagcggccacgagctgccgagtacgctcacctcaagcagcggcgcgctctacggcggctttttgcacaacgtggtccagcgtgtggcgcagtatatctgcgacaccaccgtggtggactttgtcgcccatcatgagctacgcatcgaccatgtctacgagacgttctacaccctcatcatggggttgttgatgtatatccgcacgcatcccgatgtgcccgacgagacggtcaaggaaatcatcgcctcgacactccacatcgagggctataccgccaagtatccggagcgcaagccccagaactgacgacatttggccaaactgcccgcgatcagaagaggggccgcgggcgtgtgaaaggagagcagcatgctgttcgatgtttggggtagcgatacccttatccactgggccggctgggccatggtctttatcggcctgatcgtgctcaacgaggtcggccgccgcaccaagctcggcgcggccatcatctttggcgtggctccgcttgccatgaccatctactgcgtcgccatcgccgtcggcgtttcgcagggcgccgagtgggcgctcaccaaccccacccacgtgtaccaaaacagctggttccactacgccaaggtatacgcggcgctggccggctgctggggcttcatcgccattaagtaccagtggggcaagatcggcaaggcgcactggttccgcgcatggccgttcgtgatcgttgccatcaacatcatgatcgccgtcgtgtccgactttgagagcgcctatcacttctttgtcctgggcgagtccacctgggtcacctccgagggcgccacgcagctcgccggctggaacaacgtgttcaacggcatcgccggtatcatcaacatcttctgcatgaccggctggtggagcgtctacgcctccgaggacaagaccgacatgctgtggcccgacatgacctgggtctacatcatcgcctacgatatctggaacttctgctacacctacaactgcctgcccacccactcctggttctgcggctttgcgctgctgctggcccccaccgtggcggcctttatctggaacaagggcggctggatccagaaccgcgcctttacgctggctatttggtgcatgtttgcccaggtattcccctacttccaggaggagtccatctttgtgacccactccacgctcgaccccggcgccgctaccgcggtctcgatcgccgcactggtcgccaacgtcgccgcgatcatctacatcgcctaccgtgccaagaagctcggccgcaatccctataagcaggatgtctttgagggcaccagcgattgggagaaggctaccgcccgccgcgccaaggttgattacgcgcacgccgagtaatgtgttgaccgttgtcggaacctgggtatagaaacacttgtccggctttcgatccaatgcctcgcgcagcccccggaacgcgattcgctcgcgttccgggggctttttgttgtcgcgcctttgggtcggatgtcgccctcggattaaatcgtatttcaaattgcacgccggctctatatggccccatttttgggtacattgttgagccgatattgcattgggggatatatgagcgatgagacgtgcggccgcgaggatgcggctcaagatgcagaagcgtgtgccgaggccttggagagcctagaccagatcgcgctgggcgagattgcgtttgacgattcgactgttgatgcgcaggatgagtcagaagccgaaggcgaacaagatgccgacgatgatgctgcgcccgccggggatgaggcgggacacgagaactccgaaagcgaggacgacgaccagcccgaatccgacgcgggcgagggaaccgtcctgctcgacagcttgccggctgaggattcgctgacccgcgagctccctggcttgggctctgcgcctatcgtcgacgagaccatcgccatgggcgatattcccctgccgtctgtcccctcggcacgcgaggccgaggttcgccatcgcaagatgacgcccaagcgccgcaatctgatggtggcaggcgttgtagccgtcgcgctcgttgccggaggcgcgggctatgccgcctggaacggatatcagcacgaacaggcagccgttgtcgccgccaatgcgcacacgatgatgtcggtgcagattggcgtacatgccgcggggctcgactgctctactggctccaagattcccgtgcaggtaagtgggcaggattctgacggctcgtccgtgagcgagacgctctacgttgatgagcacggtcgcggcatcaagctgctgcccggcgattacacgctctccatcgccgcctcccccatcgcggcggacggcactatctacactgtcccgaccaccaaggcacaggtcaccgttaagagcgatggacaggatttaagtgcccaggccacctttaagctcaaggtgccttcggccgacacggtgactgacgaccagatcgatgccgccgccaagtatgccgaggagggcggtgcgagctccgccgcggctgccaaagtgctccagcaggcagcaaccgcgcggcgcgacgccgccgtcaatgccgtgagcgcgcaaaaggcacaggcgtcccgtgatgctgacgctcgccacaaggcaaccgacctctaccagctcgatattcccgtcgagtggtacggcaaggtcgcaacttggcaaaacggaagcacgctatgcatctatctgggcgacgacgccaatacgccgctcgtgacgctcgtcgcggtgcgcgagggcgagagctttacgcccgatgaaggcgatacggttttgggcgcggccaatctaggcaacggttataccgtctacgccagcggccccgtctatccgtacgtggtgccccagaccatcaacggacagacgcagaaccccgtgtcaacctaccccatggacacggccattgagcttgtcgagcttacgaccggcaaccgctatacctatagccagatcaagaacgtgctggtcggcaaagacggcaaggccgacgccgccgccaaactcgagaccgactacctcgcccagattctgatgccgagtatcaaagcccaggactagcctggcgcagcaaggtgctccccaaccgtgatgagggagccaggaggtcctgaccccacaggtccatagatgattaggcaaggagccacttccatgcgggcacaacgtggaccacaccgtgctcgcatgaaatatcggtctgttcatccatggtaacgattgccgactcgccaagatcgaactgggccatcgaggcatcaagcgcggcaatttcgcgctcgcgcgttttctcacgtgccatatccgcactcacctgaatcaggctataagcccgcatgagaagcgcgtccccagccacaaagtccacctcatggcttttgctcttctctttgatcagcaggcggcagaccgagccggtcctcaccgcgggagtctttcttcttagcgcattgaacactgcggtctcgagcctctggccctggtccaatgctgatgcgggagagaatgctccaaacatcgcagggtcgacagcgtagaccttagacgcagaccgcatgttatttgccagtgaacgcgtgaactccggcacagaaaataacaggtaggcgtcctcataatactcaagtaaatcgctgagcgaattacgactgacgggtatctgtctgctcttgaactcgttgtacactttgttcactgacagctctcgtcccgaagatgccatacaccgcgtcaagaacagcgatgccaggcgagggttcttgacgtcgtaacgctcaacgacgtccatagcgaccgttcgcgaagcatattcctgtagcagctgaatcgcgtctgtgggcgtctgctcaagtgtcgcgatgaatcccccttgttcaagatacccgatcagatgatgtcgaagcagcgctgcatcgctcggggaaaaggtcgcatctggctcgagaacgctccccgtcttatatcgaacgtattccgaaaaactcaacggaaaaagctctcgcacaagagaacgacccctgaactcgctcttaagttctgaggacagcatcttagaagaagatcccgtcacatagacggtcgctttctccgtatcgactacacgccgcagaaacgcaccccattcgggaatttcctggatctcgtcaaagaaaatgtaagcgccctcggttcgagcaacaggatacagcgcatagaacgtgtcgagcacgtccgccagcagcgatggctcatacgggcgcaagcgctcatcctcaaaattgaagtaaagcatccggtcaagctcgacgccccggctctgaagccgccgcatctcctgatacaggcgatacgtctttccacaacggcgggcccccacaatcacatttacgatgttgtcgcgctttggctcctgtgggtttcctagatcaaggtctcgctcaaagacctgcggaaccccctgctgttcaaagtcctttattttctgggcgatcaagtcgttgaatgccatgattctccaatcttgctctctagctaatcaaaattatagcgattcttgattaattagagagcaagattatgtatgacttgattaacacttaagcaagttttttcactattagtgctcgaaggatgccgagtggctgagaggacaaccaagctcgaatgcgactccctgggcagtcgatttgggacgggacttttttgactaccccattacagtttgagtcgtccgaaagggcggctcttttccgttgcatggttatacgattgagccgtaccggtggtcgctggccgaccgccccggacggccgtcagcccctgccccgtagagggcccgggacgtgttgccgccggggcgggaggggccgcggggaacgactgatagagatgtgccgggcccggaccgggccacggccgggtaatgtgggtgtcgcttccgcggcttacggccggctcaagggagaggatacaccatgcctgcagcagagacgccaggtcgacccgtcgagccgctggcaggtgtcgatgctggccgagttcggcggggccgccgggtgctcggccgccggctggcgcaggttctcgagcgccgccaggcgcgcgggcgcccccgccgcgggggccaggaggctctgggaggcgctgctggcctcgtcgcgctcgggaaggcggctcccggccggcgaggacgtcgcggtccggatactcgcccgggagatagcctccctcgacgccgacatcgaggagctcgacccgctcgtggccgactcgctggcgggcgacgaggtctacgagtgcctcctcacggtgcccgggatcggccccaagaccgccgcggcgctggtgacgtcgatcgacatatccgcgttcagggggcacgacgagctcgcgagctattgcggcgtggcgccgtccgataggcgctccgggagcagcatcaggtcgacatcgccgcagcacggcgggaacaggcagctcaagaacctgctcatattcagctgcaactccctcatcggcacggacaacaggttcgggaggtactacggggagtgcagggcgagggggatgaggcacagcaaggcgctgaaggcggtcgcgaggaagaggctcaaggtcatctacgcgatcatgcgcgacgccgtcccgtacgcggcctagcgggcggcgggatcaaccgaaggggaagcgggggcgccgggcgcccggatgcgtcatgccgaaatggcgcgaagcgcgcggttgacaaaactatagagacacgtcccagaaaatcatcgccaaattagctacttgatgcaattagcgccatgggtcagcttcgaacatcggctcacgctcggggcgtcggtcgctgtaggggtcgtaaccgtcatcgtcctcgttctcggcacggatgtaggggtcgcgcggcttgggcgccggtttggacgtgggcctgggcgccggcgcgcttgtcttgatctcgtctttcatctgcatagctccttacatcgcatccgttcggcatcatcgattgtcgcacgaaaaagggcggcggacccaattggatccgccgcccttggcgtttagagacgggctggtggattttaaggcatgtcccaaaaatctactcggcgtcggggacctcgtaggtggccgccggcgtgttgtcgcacacgacggtaaagccgccgtccttgtcgacgtcgaccgtcacctgatcgccctcgcgcaccgtaccgtcgatgatggcggcggcgatggcgtccacgacctcgcgctgcaccagacgcttgagcggacgggcgccaaagaccgggtccaggccgcccacggcgagcatctgcttggccgccggggtgatggcaagcgtcatgcgctccttggcaagacgtgcgcggacgtcggcgagctggatgtcgacgatcttctcgatctgcgccatgccgagcggatggaacaccacgatgtcgtcgatacggttgaggaactcggggcggaaggtctgagccatggccgcgtcgacctgatggcgcatctcctcctcgtccttaccggacaggtcggcgatggacttggagcccacgttggacgtcatgatgatgatcgtgttcttgaaggacacctgacgaccctgaccatcggtcagacgaccgtcgtcaagcacctgcagcagcacgttgaagacgtccggatgagccttctccatctcgtcgagcaagatcacggagtacggacgacggcgcacggcctcggtgagctggccgccctcgtcgtagcccacgtatcccggaggcgcaccgatcagacgttggacgctgaatttctccatgtactcggacatgtcgatacgcacgagcgcgcgctcgtcgtcgaacaggcactcggccagcgccttggcgagctcggtcttgcccacgccagtgggacccaggaagaagaagcttccgatgggcttgtccggatcggagagacccgcgcggctgcggcgcacggccgcggcgacggcggagacggcctcgtcctggccgatgacacgcttatgcagctcgccttccaggcccttgagcttatcgagctcgccctgcatcatcttggacacgggcacaccggtccaggcgctcacgacctcggcgatctcatcagaggtcacctgctcgttcaggccctcgccgtcctgctccttctgcgcctcgagcgcggcctcggactcctgaatctgctgctgcaggcccgggatcacggcatagcgcaactcggacgcacggcccagatcgccgttgcgcgttgcgcgctcctcctcgctcttggcctcgtcgagcttgcccttgagctcctgcacgtggtcgatggcgttcttttggttgagccaaccggccttttgcacgttgagcttttcctggacctcggcgatctcctgacgcagggcctccagacgctccttggaggcgtcgtcggtctccttcatgagcgcctgctcctcgatctgcagctgggtgagctgacgcgtggtggcgtcgatctcgaccggcatgctgtcgagctccatgcgcaggcggcttgcggcctcgtcgaccaggtcgatggccttgtcgggcaggaaacggtcggcgatgtagcgatcggagaggtcggcggcggccacgagcgcgccgtcggtgatatgcacgccgtggaagatctcgtacttctccttgaggccacgcaggatcgagatggtgtcctcgacggtgggctcgctcaccagaacggtctggaaacgacgggcgagcgccgcgtctttctcgatgtacttgcggtattcgtcaagcgtggtcgcgccaatcgcatgcaggtcgccacgggcaagcgccggcttcaggatgttgccagcgtccatggaaccctcggtggcacccgcgcccacgatggtgtggagctcatcgatgaacaggatgaccttgccctcggacttctggacttccttgagcacggccttcaagcggtcctcgaactcgccgcggtacttggcgccggcgaccagcgcgctcatgtcgagctcgatgaggtcgcggtcgcgcagggtgctcggcacgtcgccggccacgatacgctgggcgatgccctcgacgatggccgtcttaccgacgcccggctcaccgatgagcacggggttgttcttggtgcgacgggataggacctggatggtgcggcggatctcgtcggtacggccgatgaccgggtcgagcttgccggcgcgggcaaggtcgcagatgttgcggccgtactgctccagcgcctcaaactgggtcttgtcctcggcagacgtcacgcgatcatcgccgcgcagctcctcgtagacttgctcgatgcgctccttggtaacgccggcgtcgcgcagcacgcggcccgcctcgcccttgtcctcggcaagcgccatgagcagatgctcggtcaccacaaagctgtcgcccatcttggtggccttcttttcggccttttcgatgacgcgaacgagttcgttggaaagacccatctgctggccctcgcccgaaaccttgggcgcatggtcgatggcatcctgcgtagagcgcgcgagctgggcgggatcggcgccaatgcgctcgatgatcacggaaatgttgcgctcgccggcaccgagcagggcagacagcaggtgaatcggctccaccgcgcctgcctgcgcgtcggcggccgtgcccatggcggtctgcagcgcctcgcgcgacgtcattgctagcttatcgattctcatggaatcacctctcttggggcggccgccctacggggcggcttcacgttgttcgagaagtattgttgccagctttacgcgttcttatacacaaatctaagtctctatatataagattttctgagtgattgaaggatagggtactgagacgtcgacccgctgtggccccggcacgctaccgtctcgatctgtaacatctagcagccgtttttgggtccagatgttatagatcgagatgaaatgttcagtagctcccgattatctaaatctgtaacaactactcggcaaataagggtctacctgttacagatcgagataaacagaagacgcccgaatcgaaaatctcaatctgtaacaccaagcccacttttaacggcccagatgttacagatcgagacagaccgaaaaccaccacaaaggggacaggcacctttgtggtgatggagaacgaaaatgtacgaccggacaaacagccctgctctcaatgtctgttgtcctttcttgttatgggctaaaataaattgttatgtgagaatattcatttgcaatcggccttgtctgtcatttgtctcggggaaatcatatgaagccgtctcattccaccggtcgcaacgtcatcgccattctcgccatacccatcgtgatgctcttccttatcgtcgtcacgcccttttcttttggtatcgcctcgcccttcgatctttgcgggatgatcgacgccggctcgcgtgccacctcgctctcctttgtctgccgtggcgtgttctacgaagatgcaattcccaccggaagttggcagtcaaagttgccactgctcggtcagatcgacggatgctccccctatttctgccttgaacctcagacgctaaactatctgatcgacgaccagccactcgactccatcaccctcgcctacgactacgcaccaaacaccgatgaacgccacatgaaccaggtcctcgacaagatgcttgaacagtgcgggctcaccgaggaggccggtcgaaccatctatagcgaccaaaaattaaagcgaacagaactccgccgtgtcggaaaaatcgaagggcgaagtggggccgcctactggcaggcctgggcaacacgcgacaagagcgaattcggacacagcacctatatggtcaccgtctacaccaaagacggaattaaggacaatgttgacgatttcgcgtcgtccaaactcggcatccccaaaacaaccaaacccgccaccccagatgaaatcctgtagagacattcattgttgtactcaatgagcgcaacaatgttggccgtcatagccgaaaccaccacaaaggggacacctttgtggtggtttcggctatgacggccaacatctcgatctgtaacatctagcggccatttttgaccccagatgttacagattgagatgaaatgctcagcggcgcccgtttatctaaatctgtaacaactactcggtaaataagggtccacctgttacagatcgagacaaacggaaaatgcctgaaccgataatctaaatctgtaacaccaaacccacttttagcggcccagatgttgcagatcgagacaggccgagaaccaccacaaagggcacctttgtggtggtcgcgttctctactcttttgccgagcctgtgcttcccgattcggcggtccagggcatctcatcctcgaacagccatgaacgggcagacccactatcgcgtgcagtctgcgggtcgggcaagcaggtctggtcgtacgcgtccatcacgcaacgatccaaaaaatcgatcacctgctgctggtcgccttcaagaatgtaggtcacgccgccatcttggatatagacgccgtccccacctccggcttttgcgtattccggattgtagttaacggtgcgcatcagtttgccatcagatgaatacagcttcagcgttgtatagtagccaccgttcacagaaccacgtcgacgctcataggcatcccaaccgtcccagcgtttgaacgaacgcccatttagcaagtccagcgcctgtcgggacaacttctcgtccttggtatagcgagacgagccaagttcaatcatggggtagttgcttatgcttagaatgcccggcgtttcctcgatatcgagcgttatctcatcgggctttgtaacgtccgaaatcatttgcccgggcatcgatgcaacaagggacgccatctcgaccgtctgctcaaccccactcggcccatagaagataagcgagccaaataggaccacgcccgcagcagcgacgacgcaagccaccaacagcaacaaaacagaagtgcaacgcttcatcttcaactccacaaacgagagtgttttgagctcactttaaagcgccaacttcatactgtcaattctagatagcatatgaacaaaggcgcactcccccatagaggagagttgcaacctcgattttagcgtccctcaagacccaacgagaacgcagaaatgtagcccggggcttaccctttcccgaacgcgaccctcgcgaagcgcgtgagcggacgggaaagggtaagccccgggcggacaagtatgtgcgttactcggcagcggccttgaacttgttgtagttgatcaggcagccggccttgacgatggcgcgctcctcggccgtcatatcggcaatgtagagctcaatctgctcaaccgcaccgtcggcacgcaccacgtaggcagcgatgttctgcaggtcgccgtcgagcgcggcgcggatacccggcacgaagacgtagtcgcccacctcaaagttgggctcggcctccatctggaagggcaccatgccccagttcatcacgttggagcgataacgcttggtggcgtactcgtggacgatgttggccaggccgccgatcacgcgctggcagcttgcggcctgctcgcgggcagagccatcgccgggcttcttggcgtagagcatggagccgtactcggtagccttggcatcggccgcgacacctgcgccggccagcgcctcaaacacaccggcaagctcggcatcgagcgcggtcagatcgcccgcggactcgccggcaacgcggcgcttctccaccgcgtcgacctccttggagcggcccacgtaagccgggtcgcggcggctcagcgtaaactcggccaggcccagcgggttggagcggaaggagctcgtctcgcccgagggaatgagctcgtcggtcgtggtgaccgggtccatgatcttggagcacaccttgagcaggatgtcgtcgccgagcggctccatcgcgggccacggcttgatgttggggccctcgaccagctcgtcggcaggctcagccttaccaaagccccagtacacgcgcttcttgtacggcgcgtcgtcaaaggtgtactcgcaggcctcgtcccaaatctcctcgggcaggtcggtcgccggcgtcaggacgccgccgttggcagccgtcgccgcaatggagcgggcgtccatcagggccacggcgctcagctgaccgttgcccggcttggaaccctcgcgattggggaagttgcgcgtggtgtggcggatcgaaaggccgttgttggcaggcgtgtcgccggcgccgaagcacgggccgcagaatgccgtgcgcacaatcgcaccggcctccataaggtcgtagatgtagccgcggcgtgtaagctcgagtgccacgggctggctcgtgggatagaccgacagcgagaactcgccgcagccggtgttagcgcccttgagcacgcgagcagcctggaccacggagtcgtagttgccgcccgagcagccggcgataacgccctgctgcacgtgcagcttgccgtcgacgatcttgtcgagcaggctaaagtgcgtcttgccctcgccgatcttggcggcctcgagctccacctcatgcaggatgtcctcgaggttctcgttgagctcgtcgatctcaaagccgttagaaggatggaacggcaacgcgatcatgggcttgatactcgacagatcgacttcgacgcagccgtcgtagtaggcgacatcggcgggcttgagctcacgatagtcgtcgccgcggccgtgcatggtcaaaaacgcatgcgtatcctcgtcggtagcccaaatggaggaaaggcaggtggtctcggtggtcatgacgtcgacgccgttgcggtagtcggtcgtcatgctcgcgatgccggggcccacgaactccatgaccttgttcttgacgtaacccttggcaaagacagcgcggatgatggcgagcgccacgtcatgcgggccgacgccggggcgcggggcacccgtaaggtagatggcgacgacgccgggataagcgacgtcgtaggtgtcgcgcagcagctgcttggccagctcgccgccgccctcgcccacggccatggtgcccagggcgccgtagcgggtgtgcgagtcggagcccaggatcatcttgccgcagccggcaaagttctcacgcataaaggagtggataacggcgatgtggggcgggacgaagatgccgccgtactttttggcagccgagaggccaaagacgtggtcgtcctcgttgatggtgccacccacggcgcacagcgagttgtggcagttggtgagcacgtagggcagcgggaactgcttcatgcccgaggcgcgcgccgtctggataatgccgacgaaggtgatgtcatggctcgccatggcgtcgaagcggatcttgagggcctcggggtcgcccgacgtgttatgtgcctgaagaatcgaataagcgatggtgccgcgcttggcatcctcgggcgcctgggtgataccgcgctctgcagcttcggccgcaggcacaacctcgttgccaccacgcaggtagatgccgtcctcgtacagcttgaccattctgtctcccactctgcccgaaaactcgggcgcatagcatacattcgttcaatatcgtgccatagaacgattgccagcgggttacgaatctcgtcgttcactttatctcagtaaagcagagggcggtatcggtgcaaggagtgtccccaagtgccggcacaaaaggaacgtccccaagtgccgaatgaaaatgagagtggataatctcccgtttctggctctcaagcggaccaaaagtgggagattatccactctcgtgttaagacttgccgtgcaaaccgcgtaactacaaatcccctccggcgcccagcagcttgcgcatgacttgctcggggttgactgagccgtcgcgcggggcaagggcggtgatcttcttctgcatcttgtactcgtggagctcttcctcgagctggcgcacacgggcacggagtttctcgttctcgcgctcgcgctcctcggcacgctccttcatatcgaggatacgcaccacgccggcaaggttgatgccctcgtcggtgagctggttgatgagctccaggcgctcgatatcggcacgcgaatacagacgcgtgttaccgcccgagcgctgggggttcaccaggcccttggactcgtagacgcgcagagtctgcgggtgcataccggtcagctcggccgccacgctgatcatatacagcggtttgttcctattgtcctcggccatactcacagaccccttcttaatcaacctcatcccaaagcggctttcccaggcacccgaccttggccttcaaaccgtcgctcgcgtacccgagtacgcgtcgctcctctttcaggccaatctcgagcacctggaaaacccgcctcgggctccatttttaatacgtcgccttgtaacggttgaccttctcgcgatagtcgcgcgtgtcggcctcgcgcaacttggtcatggcctcgcgttcatcgtcggacaggttcgtgggaacttgcaccttgatctcgacaagcaacgcgcccgtgcggccgcgatgcttaacatcgggcgcgcccatttccttaaagcggaacttcttgcccgtctgggtacccgcgggtaccttcaggcggaccgtcgcgccgccgggcgtgggcacgtccaccgtgcagccgagcgccgcctcgtagaccgagatcggcacctccatggtcacgtcggcacccttgcgcttgaacagcgggtgctcctccacatgcgtggtcacgaccaggtcgccgcgctcgcctccggcaacaccgtactcgccacggcgcttgtagcgcagcttgccgccgtcgaccgcgcccgcgggcaccgagaccgtaatggtctgctgctcgcccgtcgagggaatgcggtaggtaaccttgtgcgtcacgccgcgaaacgcgtcctcggccgtcacatcgacagtcagcgacaggtcgccgcccttgcgcgcgcggttgcggcccgcgcccgcaccggcagcgcccgcggtcccggcaaagcccgaaccccaatcgctgccccaggcaccgttgccgctaaagatactgtcgaagatatcgccccagccgcttgcgccagcaccggcaccatagccgccgccatacgcaccgcccgcgcccggcatgccgccgaacatgagcatctgatcgtactctttgcgcttcttctcgtccgaaagcgtctcgtaggcctcgctaatctccttaaacttggcctcgtctccgccggcatcggggtgatatttttgcgcgagcttgcgaaacgcgctcttgatctctttgtcggaggcgctcttggatacgcccaggatgtcatagaaggttttgcctgcagccatcgtagctcctctcctgttacgtccgccgcccttgtggacgacggctcatgctttcatatggcactaggccagaaagggccccgggtgttgccccggggcccttctcaattactcctcggtgctctcggccgtatcggccgcagcatcctcgggcgccgcttcgggctccggcgcggggcgcttctcgccaccgtacgtcaccgtcaccatcgcggagcgcaggatgcggtccgccatgcggtagcccttctggtacacgtcgttgacggtctcgtcgtactgcgccgcgtcctcgacacgtcccacggcctggtgctcgagcggatcgaacgcctcgcccttggggtcgatgggttcaacgccctcgtgcgcaaacacgtcgagcagcttggcatgcaccgcgtcaacgccatcgacgaactgcttaaagtcgtcggaaagctcctggctgcgggcatggtcgattgcacgctcgatatcgtcaaccaccggcagcagcgcggtgacgagcttctcggtcgcgcgctcgcgctcggcgatgcgctcgttggcggtgcggcgacggaagttctcccagtcagcctgcagacgggcggtacgctccgtggcgtcctttgccttgtcctcggcggccttctgagcctctgccgcagcatcgagctcgctgcgcacgtcggcgagctccttttgggcctgctcgaacttgagcttaaagtcgttgtcggcggcttcctcaccggcgcggatagcggcttccaccatctcgtcctcggtcatcgtcgcctccttgttggaatcctctacctggttctcgacagcctcggcggccgcggcctcgttggcctcggtatcgtcgacggcctctacgggaatcttcacgtccttctccttggagtcaacgggggcggcgccagcggcggccgcctccgtgcgagctttacgggcggacatgattacttgtcctcgtcgtccacaacctcgtagtcggcgtcgacgacgtcatcgtcggcaggctgggcgccggcggcgccgtcggtctgctgctgagcgtcggcatagacaacctgagccagctcgtaggcgacagactgcagggactcgccggcggccttgatggcctcgacgtcagagccctcgagcgccttcttggcgtcggcgatagcggcctcggccttggacttcacgtcggcggaaaccttgtcgcccagctcgttgagggtctgctcggtggagtagcacaggctgtcggtctggttgcggacctcgacctcctccttctgcttcttgtcctcctcagcatgagcctcggcgtccttgaccatgcgatcgacttcgtcgtcggaaagcgcggtggagccggagatggtgatctgctgctccttgccggtgcccttgtccttagcggagaccttgacgataccgttggcgtcgatgtcgaaggtgacctcgatctgcggcacgccgcggcgggcagccgggatgccggtcagctggaacttaccgagcgacttgttgtcgcgggcaagctcgcgctcgccctggagcacgttgatctcgacgctggtctggttgtcggcagcggtggagtagacctcggtcttggaggtcgggatcgtggtgttgcggtcgatcatcttggtcatgatgccgcccatggtctcgacgcccagcgacagcggggtcacgtcgagcagcaggatgccctcaacatcaccggtgagcacgccgccctggacggcagcgccgtcggcaacgacctcgtcggggttcacggacatgttgggctgcttgccggtcatggtcttgaccaggtcctgaacggcgggcatacgggtggagccgccgacgaggatgacctcggtcagatcagagagcttgagcttagcgtcgcgcagggcgttggtgacaggctgcttgcagcgctcgagcaggtcgcgggtgatcttctcgaactcagcgcgggtcagcgtgtagttgaggtgcagcgggccggactggttcatggtgatgaacggcaggttgatggtggactgctgggctgcggagagctccttcttggcgttctcggcggcctccttcagacgctgcagggccatggggtcctgacgcaggtcgacgccgttctcctgctggaacttgtcggccatccagtcgatgacgcgctggtcccagtcgtcgccacccaggtggttgtcgcccgaggtggacagaacctcaaacacgccgtcggcgaggtcgaggatagagacgtcgaaggtgccgccgcccaggtcgaagaccaggatgcgctggtcggagccctgcttgtccaggccataggccagagcagcagcggtcggctcgttgacgatacgcttgacgttgaggccggcgatcttaccggcgtccttggtggcctgacgctgggcgtcgttgaagtaggcagggacggtgatgacggcgtcggtgacggtctcgcccagatacttctcggcgtcggccttcatcttggcgagcaccatggcgctcacctgctcggcggtgtaatccttgccctcgatgttgacgacggcacggccaccctggccctccttgacctcatacggcacggtcttgagctcggaggtgcactcagagtacttgcggcccatgaagcgcttgatggagaacacggtgttcttggggttggtgaccgcctggttcttagcagccttgcccacgacgcggtcgccgtcggcacggaagccaacgacggacggggtggtgcggtcgccctcggcgttcacgatgatggtcggagaaccgccctcgaggacggccatagcggagttagtagtaccaaggtcgatgccaagaatcttgcccattagaaattccctctctcttgtgcgtttgcaccgactcggcggtctgccgagcggtgtttcggcttgtctttcaggatgtagtgtatccccttatgggccggaatatacaaaatctaagtcaattcatataagatttcttattgctgagagtttaggttcttaaatgtgcaggtagatgcgctgattgagttctcggcagatctattgagatctatgtagagttgactgaggtttgagcttggagtcgcgcaggaggctctggggcggccccggggaaagcgcgacccggtttggaagccgattccgggatgtagtttccgccagaaggctcaaccggaaaatgcagcccagtttgagcgtagattccgggacgcagtttcccgcggagcgctcaactggaaactgcatcccgttttgagagcgaattctgggacatagtttccgctagacgtccatcgggaaagcgcgtcccagtctgagcgtcaattccgggtcgcgctttccgtaagcgtgctcaattgccctttatttcaagtcacctttagctaacatttgcgcagctcaacggccccacctgcgtgttttttagtaagccgtggcatactcggcgaacggtatgaagatgccggtcagagggtattgcaaacggtcgctgccgtggtatgtttttgcccgaatcaaaccgacgcacatcgcctgtagcgtcggtcaacagagaggaaactaccatggctcatcccgtaattgatgccgacgagtgcatcgcttgtggcgtttgcgtcgactcctgccccgctggcgttctggagctccaggacgtcgctaccgtcgctgacgaggactcctgcgtcgcctgtggcgcttgccaggacgcttgccccgctggcgcgatcaccgagatcgtcgaggagtaacaactcccccacttgcacactcacaagtacaccgtgcaaaaaagaggcctccgcatcgccgcggaggcctccttttttgtgcggataaccaattaggcaccatcgcaggttgagctcacgtcagcgaaaacgtccctaggcgagcaaggtgacgtgaaagaggagggaagcgtacttttgtacgcgaccgacaattgaacgtcagattgccgcttagggacgtttgcagcatcggctacgatagatcgtcctcgtagggcattaaatcggcaaggtagcccttctccttgagtatggcctcgatctcgtcgagggtctgctcgtcttccgcggcgatgcgatggaagtggtagccgctggtcaccgtcagcagcgggaagctcttgccgctggcgatgccctctaggtagcgctcgacatcgcggcggttgcggatgtccaggtcggccgtgatcttaccgtacacgcggtgattgacgatcacgttgagcacggcgccgccggcgtcgacgatactcgtgagctcatcgcctgcctgctccacgctgtggcgaaccttgaccaagcgcgtgggcacggcggggctgctgggggcctcctgcagcacatagccacggttggttgccacgacatcgtgcccatcggcgcgcaacagggcaatatcctgaaccacgacctggcggctcacgccaacctcgcgggcaagtgcgctgcccgaaacgggctccctggctccctcgagcacgcccatgatggcacgacggcgctcgcgggcgttcattatttaccgtccagcagacgcaggtgcttaagcgagaggtcgaggatcggggcggagtgtgtcagcgcgcccgagctaataaagtcgacgcccagatcggccagggcgcgaatattgctggcgtccacattgcccgagcactcggtcttggcgcggccggcgataagctcaatcgcggcagccatgtcatcgtgggtcatgttgtcgaacatgatgatgtcggcaccggcctccacggcctcgcgtaccatgtccaggttctcgcactcaatctcaaccgtcgtggtaaacgatgcgtgggcgcgtgccatctcaatcgcacgcgtcacaccaccggcggcgtcgatatggttgtccttgagcatgacagccgtcgacaggttgtagcggtggttgctgccgccgccgatctcgaccgcggccttctcgaagacgcgcatgcccggcgtggtcttgcgcgtgtcgacaagcacggtgttggtaccctcaagcgccgcagccatctgatgtgtataggtcgcgataccgctcatgcgctgcaggtagttgagcgccacgcgctcgcccgaaagcagcacgcgcgcgtcgccgcgcacttggcccacgtggtcgccggcgtgcacctcgtcaccgtcggcaacatcaaagagcaccgagctctgcggatccagcagctcaaaggtgcgagcgaacacgtccagaccggcgatgatgccgtcggccttggcgataagctccaccgtggcgggacgcgccgtggggcacacgctcgccgtactcacgtcctcaaacgtaatgtcctcgcgcagggcctgcaggatcagatcatcgacgacgagcttcatggtaatgggattcatggtctactcctctgcggcctgcgtgccggcggcacgggccaaatcatcgattgccaaggtgtcggcgcttaggacgcgatgacggccatcgagcgcgggatcgcccacctgctccacggccagcgactcgccggtgcgcatacgccaagcagcgcggcgaccccagaccagcgcctcgagcaggctgtttgatgcaaggcggttcttgccgtgaacgccgttacaggctgtctcgcccgcggcgtagagctcgggcatcgaggtgcggccgtccttgtcgacccacacgccgcccataaagtagtgctgcgtgggtgtaacggggataggctcgtccaagatgtcgcgtccgtcctccaggcagcgtgcgcgaatgttggcgaagtgcccggtcaccacgtcgcgctcgacgggggcaaagctcagccattcgtgctcggtaccgtcctgcttcatctgcccgcgaatagcggcggcgaccacatcgcgcggctgaagctcatcggtaaagcgctcgccggcggcgttgagcaaaatcgcgccctcgccgcgacagctctcgctgatcaggaaggtgcggcccggctgcggcgagaacagccccgtggggtgaatctgcacgtagtccaggtgctccatcttaatgccatgttcctgagcgatgtagcaggcatcacccgtgagctgggggtagttagtcgaatggtcgtatacgccgccgatgccgcccgtcgcccacagcgtgtggcgggcatggatcttaaacggctcgccggcatgcacgccctcggcggcatttgtcagctcgtcggcggggcgagctgaatcgtcctcgtccacggcgacagcgacgacgccggtgcacaccgtggcgccatcgcgctcggtggccaggatgtcggtcatggcaacgtgttcgagaatctgcacgttgtccagcttgcggacagcttggagcagcttggtcgtaatctccttacccgtaatatcggcatggaaggcgatgcgcgggcggctgtgcgcgccctcgcgggtaaagtcgaggctgccgtcggccttgcgctcaaagtccacgcccatggccagcaggtcgttgatgaccgagcggctcgagcggatcatgatgtcgacgctctcgcggcggttctcgtaatggccggcgcgcatggtgtcctcaaagaaggcatcgtagtcagaaccctcgggcagtacgcagatgccgccctgcgcgagcatcgagtcgcactcgtcgaccgcgcccttggagagcatgatcacgcgcgtgctcgtcggcagattgagagccgcatacaggcctgccacgccgcaaccggcaatgacgacgtcgcactccatatcggggtattgtttggtttccacaggaatcctctcccttgtaatgtggcataagggatgcccctcatgtcacattggcttagcgcgccgcgtactcaagcatgcggtcgagcgtgagcttggcctggtcggcggcctcgtccgacacgccgatctgcacctcgccctcgcccgtctccaggcagcgcacgagcttttcgagcgtgatgagatccatgttgacgcaggtgggctgcaccgcagggaagtagaacttcttgccggtgccctggcagcggcgctcgagctcgtagagcacgccgcggaccgtcacgataatgaactcgctcgcgtcggactcctcggcatacttgatgatgccggcggtagagccgatgtagtcggcctcagccaggacgtcggccttgcactcaggatgcgccagcacgagcgcgtcggggtgggcctccgtcgtgtcgacaatctgctcgacggtgatgatgtgatggcgcgggcagtaaccgttgttgaggatgacgtgcttttgcggcacctgctcggctacgaagcggcccaggttctggtcgggaatgaacaagatgtgctgctgcggcagctcggagacgatcttgacggcgtttgagctggtaacgcacacgtcactccagctcttgatctcgaccgtggagttgacgtagcagaccacggccaggtcgtcgccgtactcggcgcgcgccgcatcgaccgtctcgcgcttgaccatgtgcgccatgggacagtccgcgcccggctcgggcagcagcacggtcttggtgggattgagcagcttggcgctctcgcccataaactccacgccgcacagcacgatggtctgctgcggcaggctcttggcaagctttgccaggtagaagctgtcgccgacgtaatcggcaacagcctgaacctcgggcgccacgtaatagtgcgccaggatcaccgcgtcgcgttgggttttaagttgctgaatggcctcgacgagctctgcgggcaccagtgccgcgcgctccgttgccgtcgttgccgatgctaggccggccgcgatatcgcgtgcaagctccgacgcatccatgttcgcgctctgtgccatcaaggcccctctcttttggcgaatcttggggctttagtatgacacctaggtttacagctgacaagacagctgtaaacctaggtgtaaagttgaaataaagattcgaccatgcggcaagtccatattcgaactggcaagctgaggatagccgagctctcgatagcgcaggaggcatctttcgccaccgcaataccgctcggcgcgagttgcgcaccgtgaggcacgaacgggcgctcccccgcgagtggtccgcgcccaatgtggcaaaatcgaactactaagggggctcagaatgctcaagattattgcctgcgacgatgacgtcgcttttctagatagactgcaccggatgatcgaccgttggtcgatcgagacgggcacggcggtcgatgttgcgctcgtcacgcgcggcgaggacctgctggcgcgccatgccgcgtcgcgcgccgacatcatcctgctcgacatgatcatgccgctcgtcaacggcatggacaccgcacgcgaattgcgccaggccgacaccgccgtgcgcctggtgttccttacctcgtcgcccgagtttgcactggagtcctacgaggtccgcgccttcgactatctgctcaagcccgtgacttacgaacgcctggcgcagttactcgacgaactttcgagcatgcgcccggcggcaaccgacgagctcgtgatcaaaacgtcctttggctaccacgccctgcgcctgtccgacatcgaatatgccgaggcgcgcaacaagcacgtggtcttccacctgcgcgacggacgcgatatcgaggcactcgagtcgttccgcagcgtcgaggaccgtttggtgcaaaatgccaccttctttaaatgccaccgtagctaccaggtcaacttgcgcaacatcgaccacttcgatcgcacggacatcgtcatgcgctccggcgcgtgcattccgctgtcgcgcagcagcaagcaggggttccaagacgcctactttgcggtgcgctttgagggcgggaggcgctgatgatctcctcggtcgaaatggccctttgggcaatccaccacgccacgacgctgctctttggcgtctttgcctcggcggcgctgtgcggtatcgaaatcaatcgacgccatgcactcgagttggtgggggtcggagccgcaaccggcgctgccttttcgatcgccaatgtcgttggcggagagctttttgcccgtcaggtctatccgctcgtcgtgcacttgccgcttaccgtctacctatgcgcgcgctaccacttgagtccgctactcgcgacgttgggcgtcaccagcgcctatctgagctgccagttcagcaattggatgggcatcgccgcatttgccgcaaccgattcgcagatcgcgtactatctggcacgcatcgctaccacgctcggcgtctttgccgtcctgctgcattgggccggcgacattggaccccgcctggcgattaaaagccccaccgagctgggcatccttttaatcctgccgctcgtctattacatctttgactacgccaccaacgtctacaccacgctgttccactcgggctcggtggtgacagttgagtttttggcatttgcgctctgtgccttctatcttatgtttcttgccgtttacctgcgcgaatacgaagaaaaggaaaccgccgagcgagagcgttggatgctcgaaacccgcgacagcgccgccatcaaagagctcgaggcttggcgtcaatctgggcgcgagctgtcgattcttcgccacgatatgcgccacttcctacgcggcctggccactttaattgaggagggccacaccgacgaggcgctcaaacgcatcgatgagctctgcgaagccggcgaccgcaccgccgtacgccgcttctgcgccaacgagaccgtaaacatcgcgctttcgtcattcaactcagatatcaatagaaacggcattaccgccaacctgcgcgccgccgtacccgaaaccgtccacgtaggtgacgccgacctgtttagcgtgctctcaaatgccttggaaaacgctatcaccgccgcaagcgccgcaccccaaggaaagcgattcgtcgaccttgacctgcgacttgaggacggccagctgttgctgttagtttccaacacgtttgaccgcgcgccgcgcatggtcgacggcatgcccgtgacccggcatgcgggccacggctttggaaccaagagcatcaaacttgccgtggagcgcatgaacggcaactgccagttccgcattaacggcgatcggtttgagctgcgcgctgtgatgtaagggcgcgggcgcgacggatttgcgttccgcgggtacggctcgcccgctcggggtcgtttgtcgacgcgggctcgctacagcggcgcggccgccggggtcagctgcttaatgtaggcccacatgcgctgcttagcggccttgtcggtgagtgccgcctcaaagccgtcgagcgcgagcacgcggcggccctgcacatgggcgaccaggccgggcttgagcatggcggtgtcgaagtcatcgatcgccacgagcatatcggcgtaggtctcgcgcatggcatcggccgcgttgttgtcgagcagtagcaccgcctcggggtccaaggcctcaagtgcctcgcggaacagctcgcacggcagagtctcgcccgccgcgaccgctccgtcgcctgcgccggcgacgcttgccagcacgcaaaaatcctcgggcgcgtagccgatggccccaagcgccttgcgcaacgccgcgccatccgggccggcggcaagctcgccacccgaacgctcggcctcgtccaaatcgcctttgaccagcacgatcggcgagcacgcgttgcccacgatgcgcacgccacggaccgcaagcgatgtgagctcctgctcggccgcctgggcgatggcttcttttttctggctttgtgacgtggacatgcgctctccaatcgtttgcgtgcccaccattatataaaagagctgcccgcgagtggttgctttgcgggcggctgggtataagcacggtcgtactgagttttacgcggctgagccgcgtcacattatggaggtcaccatggctgacattaagcagattacccccgagaacttcgattccatcgttaacggcagcctgcccgtgctggtcgatttttgggcaccgtggtgcgggccctgccgatcgctctcgcccatcgttgacgaggttgccgatgagctggcgggcaagcttgccgttgccaaatgcaacgtcgacgacaaccaggacctggccatgaagtatggcgtcatgagcatccccacgctgattgtgtttaagaacggcgaagagattgaccgctcggttggcgctctgcccaaggcgaggctgcaggcgctgctggagaagcatctgtaatacgcttgttacttacccgccgtccatgagcggttttgcaccgctcgccggactgccgggtgcggcgcgtgcgaccatggatagtatggtagttacaaacagcccccagtgaacgggtgcgagtcgcacagactcgcacccgttttcttatgcagcggcgcgcagagcgggcgtagtaaaatctgaatcactggattaccgtccacacaaggagatttcccatgcatgatgttggaatgaacatgagccagcttgccatgagcgtcaagcaggtcgacgacaccatcgagctcgctcacgagtggagccatcagttgctgcatgcgaccgagaattttgacatggagcgcatcggcgccaagctcgaggcagccatggccgcgctgcacgaggcccacgacgcactcgagggctacgaagaggccatcgaggccgaccacaactccgtcggctccgtgaagctggtgtaacgtggccgaacacgagcacggctgcgggtacgagcacgagcatccgcacggggcggacggtgacgcaggctgccactgtagtggctccggctccgagctggtccgcttttcggttaccgcaccggacgacctgctgcgccgttttgacgaacagatcgcgcgccgcggcgacgtggccaaccgctccgaggccgtgcgcgacctgattcgcgcctcgatcgccaaggagcagatgcgcacgcccgatgagcatgttatcgggtcgctcaccatgatctacgaccaccataccggcgacctgacgcgccgtctggacgaagtgcagcacgactacaccgacgaaatcgtatcgaccatgcacgtgcatctggatcaccacaactgcttagagattctggcgctcaagggtcgcggcgagcgcgtctacgagctggccgaccgtctgctgggcctgcgcggcgttaagcacggcgagctcacgtgcgccgccaccaagcagagcctgggactgtagcgcacctgtccctatttggtcggttttgatgaggggtgtcgcatgcgacatgtgcatattcatgtaacgggcattgtgcagggcgttggcatgcggccgtttgtgtatcgcgaggccatggcgcatggcatttgcggatgggtgctcaacgcgggcgacggcgtgcatatcgaggcgcacgctccggccgatgcgctcgatgcttttgttgccgcgctttctgagcatgcgcctgcggcagcccgcgtagagtatgtcgaggttgtggacctggcagcccacggttgggataccgccaatgaacagggttttcgcatcgtagcatcgcaggaccagaccgcgcacacgacgctcgtctcgcccgatatcgccacctgcgatgattgtctgcgcgagttgttcgaccccgccgatcggcgctatcactacccttttatcaactgtaccaactgcggaccgcgctttaccatcatccggtcgctgccttatgaccgagcggccacgtcgatgaattgttttcctatgtgtcctgagtgtgccgcggagtatgccgacccactcgaccggcgttttcacgcgcagcccgatgcctgctttgattgcgggccgcatatcatgtggcgcgaagcgagcgtgggcgatgagccgggcgaagccgccgcgttgccggccgtcggcaccacgcgcgagaccagcgacgccattatcgaccgctgtgttgagctgctggccggtggcggtatcgtcgccatcaagggtctgggcggatttcacttggcatgcgacgcctccaacgagcaggcggtagccgagcttcgccgccgcaaacgccgcagcaacaaaccgcttgccgttatggtacgcgaccttgccgacgctgaacgcctgtgccatgtcaacgacgttgcacgcggcttgctggccggcagcattcgccccattgtgctgctgcgccgacgtgctgcttgcgagagcggcggctcccccgacgccctcgcgctcgcgccgtccgtcgcgcacgaccttccagagctcggtgttatgctcccctacaccccgcttcagcatctgttgcttgccgcggcagaagcccgcggtatgcacgcgctcgtcatgaccagcggaaacctgagcgaagagcctatcgagaccgacgacgatcttgcctggaaacacctcgttgccgccggcatcgccgacgcactgctcggcaatgaccgcgcgatcctctctcgctacgacgactccgtagtacgtgtggtcgacggtgccgttatgcccgtgcgccgcgctcgcgggtacgccccgcagccgttgccgttgccggcactcgccagcgccgcgccttgtgtactcgcctgcggcccgcagcaaaaggccacgatcgcgctcacacgcgaggacgcgagcggagcgtcgacctgttttatgtcgcagcatatcggcgatgtcgaaaacggcgcgactttcgatgcgtggaacgccgcgcgtgcgcgcctggaagacctttttgacctggcgcctgccgcgctggcctgcgacctgcaccccagttacctatcgagccagtgggcacgcgagcaggcgcaggaacgcaatctgccacttgtcgaggttcagcatcatcatgcgcatatcgcaagcgtgatagcagaagccatcgctacagggcagcttgcacccgatgcgcgcgttctgggtatcgccttcgatggcacgggcgccggcaccgatggaaccatttggggcggtgagtttcttgtcgccggccttgccgattttaagcgcgccgcacatctgcgtacctgggcactccccggcggcgccgcatccgtgcgcgatgcccggcgcaatgcctttgccctgctgagcgagctcggtctgctcgagcacccgggtgccgcggggatcctgagcagcctcgatgagcagacgcgcagtatcacgaccacgatgatcaagcgaaacatcaacagcccgcgaacgagcagcatgggccgctcgtttgacgccgcggcggcaatcttgggcatctgcggcactgcaacctacgagggtgaacccgccatcgagctcgaggccgccgcttggcgcgcacttgacggagaaatcagccgtttcgctggcaatcaggcgggtgtatccgcatccgcctcaacatcgctggacagtttgttcagatacgtattaactacagaccccctatccgacatttttgactcgaatttggccaaaaaaggctctccagacaccccgtttgcggcaagcatgcccggtgcaggcccaaaatcgacccatttggagtcctcgcagacgacttttgccacccagaaccactctaaaaaaaacgtatctgaactaactgtccaggcggcctcgaatagctccctcgttttggaccaaagaacatttttcgaggcgcttttgagtggaatcgaggccggcacgccggccgacaagctcgcactcggcttccatatcgccatcgcgcgtgcatcggcccgcatcgcaagcgaaatctgcgcccgcgaaggcatcgacaccgtcgtgctctcgggcggcgtgttcatgaaccggcttttgcttcggctcctcacccgtaagcttgaagacacagggcttactgtcttggttccccgcaccgtgcccgtcaacgatggctgcatcgcctacggccaggcggcggtcgcccgcgctcggctcgcgcagatcacaccgcagtaggctgtttggccagcccatgcaccgccgtctcacaggtgtaacgcgtttgcccgcaacccccgcgagcgctaccatcaactgatggattattaagcgcctatccagcgcaaagcgtataaaagggaaacattatgtgccttgccgttcccggtaaagtggtcaaacgcgacgacgaccttaaggcgaccgtcgacatgatgggcatcgagcgcccggtgtcactgcgactcgtgccgacggcgcaggtaggcgactatgttctggtacacgccggctttggcatccagattgtcgatgagcaagaagctcaagagacgctcgagctcgtcaataccatgaccgagctggtcgaagaagaccaactcgccaccaacccggccgaggcatactagtggcggcggcgcagccggttcgctccggtatcgacttttcggcatttcgcgatcccaagctcgctcgcgagctcatcgaccgtattcatgagcttgtcggcgaccgcgccatcaaccttatggaagtctgcggcacgcacaccgtgagcatcggccgctatggctttcgctccattatgccggtggcgctcaaattgctgagcggcccgggctgtcccgtctgcgtcaccgccaaccgcgacatcgaccatgcaatcgcgctttccagcatggacggcgccatcatcaccacctttggcgacatgatgcgcgtgcccggatcgtccacctcgcttgccgcgcaaaaggcagccgggcgcgacatccgtatcgtctactcgccgctcgacgcgctcgatattgccgagcacaaccccgaccgcccggtcatctttatgggcgtgggctttgagaccacgacgcccaccatcgccgccgccattttggaggcagacgcgcgcgggctccagaacttctcggtctactgtgcccacaagaccacgccgccggcactgcgcgcgattgccaacgaccccgagaccaccatcgacggctttatcctgccgggccatgtcgccaccatcacaggcctggcgccctttggctttttggtcgacgagtttaagaccccgggcgtggttaccggatttgagccggtcgatatcctgcagggcatctgcatgctggtgcagatggtcgttgaggggcggcccgcgatcgacaacgcgtaccgtcgcggcgtcaacgtggacggcaaccccgtggcgcgccagctggtcgagcaggtgtttgagccgtgcgataccacgtggcgcgggctgggaccgattgccgcctcgggcctttccatccgtcccgagttctcgcgttttgacgccggcgcccgctatgacgtgcccgttgaaccgacggtcgagccgcgcggatgccgttgcggcgacgtgctgcgcggggccatcgcaccgagcgactgcccacttttcggccacgcctgcacgcccgagcatcctgttggcccgtgcatggtgagctctgaaggcagctgcgcggcacattatcgttatcatgactagcccaaacaccctcgattggagttttcgatatgtcccatagcgtcaccgatagcactgtcctgctgggccacggctccggcgggcagatgatgaagcgcattatcgacgaggtctttctggatgcctttgggtcgcccgagctgctcgagggcaacgacgccggtgtcgccacgctgcccgcgagcgggcgcattgccatgtcgaccgacagctttgtggtgacgccgcagttcttccccggcggcaatatcggcaggctcgccgtgtgcggaaccgtcaacgacgttgcgacctcgggcgccaacgtgcgttatctttcgtgcggttttatcctcgaagagggctatcccatggataaactgcgccagattgtgcagaccatggccgagacggcgcgcgaggcgggcgtcaaaatcatcaccggcgacaccaaggtagtcgagcgcggcggggccgacggcgtctacatcaacaccgccggcgtgggcgaggttcccgcgggcgtgacgctcagcggcgccagctgccagcccggcgacgtcatcctggtctcgggcacgctgggcgaccacggcatcgccatcatgagccagcgcgagggtttggcgttctccagcaccatcgaaagcgacgccgcgcccctcaaccacctgattgccgacgtgctggccgctgcccccgacacgcgttgcttccgcgaccccacgcgtggcggcctggcatccacgctcaatgagtttgcgcaggcgagcgacgttgctatggaggtcgacgaggataccgtgcccgtgcgccccgatgtgcaggccgcctgcgagatgctcggctacgacgtgttgcaggtagcgaacgagggcaagatggtcgccgtggtgccggccgagcaggccgatgccgcgctggcggccatgcgcgccgcacgttacggcgagaatgccgccatcatcggtcgcgtgttgccgcttgccgaaggcgcccgacccgccgtgcgcgtacgcaccggctggggctcgacccgcattctcgacatgctcgtgggcgagcaactgccgagaatttgctaacggcaaaggcggtcgggcggcgcgacccgatacacagcagtcaaagttgttcagattccaagcatgcccgacacgccagccaagtatcatggggtgcgttctagaacccaaacggcgggagcacccatggcagcagcatattcccatgtgatctttgatttggacggtaccatcctcaacacgctcgaggacctggcggccgccggcaaccatacctgcgaggtgcacggctggcccacgtttgccgtggacgagtaccgctacaaggtgggcaacggtatgctcaaactagtcgagcgctttatgcccgccgagtatgcgggcgacggtcgcatgtttgagcaaacgcttgccgagtttagggcttattacggtgagcacaaggaggaccacactgccccctacgccggtacgatcgaaatgctcgaccgcctgcgcgccgtgggcgttcagcttgccgtgctcaccaacaaggatcacatttctgcagctccgcttatcgagaagtactttggctccgagcgctttgcgctggtacagggccgcgtggacgcgtttccgcccaagcccgaggcgcccgtcacgctgcatgtgatggaagagctgggggccgacccggcaaccacactctacgtgggcgattccaatgtcgatgttctgaccggtcacaatgccggccttaagagcgccggcgtcacctggggcttccgcggtcgtgcagaactcgaagccgccggcgccgactacgtggtggacacccaggacgagctcgccgcgctgatcctgggcgagtagcgagccgcccacaaagaagttgcggtgaaatagggactggttgccggcctactggccccaaacagtccctatttcaccgcaacttagatgggcacggggtagctaaaagagccccgtcccaaattagctacccctcaacaatggcgacaccacaggtagaggacggacagcgagcgggcaccagagcgaacaaattggcatgaaaagaggacggcatagaccttctggtcatgccggacttgcagcgacggacctcaggacactcttacaccacgtctgcgcgcgcgaccttggcaggggtcgctcggacgccattttggatggttttgcctgctactaaaattgtaacagtactcatatttgcccttttttgcccacgatcccttggtatgttgttataaagccgtccctggactggaattgacagcccaggggcggctttcgctcgtcgctggagcgtccccaggtgccggcataaaaggaacgtccctagctgccggattacttgtcgatgcccagcttgtgcggcttgaaggcgagggcgttgatgagcgcgtcagtggcagacttgacggccgccggctgaggatcgttgacgtgatcctcagggtgtacgggcaggtccttcttgaccgcgtcgtgaatcaagttgagatattcggtcacaccggtagtcgacaggtgcgtgccgtcgccatcgaacagatcgttgcggttggcactgtacccgtaccagtcgataacgcgcacgttcttgtagcgcgtggcggcgttggcaatggcctggttggtcgagccaacccacggctgcgggctgcgcgtgtttacaaacacgacaatgcgcttgtctcccgcatcggccatgatggcatcgatctggtcatcggtcaccaagccgttggtgcccagggcaaagaccacgattttgccggcaaggttctgctggagatagccctcaaatgtcgcacggcccgcatcgaactggcggcccttttcggcatcgatgtggctgtgggggaatacgccgtcaaaggcgtccacggcacgtagcgacacggagtcgccaatcatgagcaggtcgtaggatccatcggggaagccatcgttgtccttgtcggtgtcgtcggctgcctgttggtccgtgggcgcggcgtttttagcttccttgttgaggacttcggcgccttcgccgctgagcgcggaggtttccggcacaaagaccagaccgcccagcgcgatgacaaacacgatgccgcaagtggcacacgcaggaatatgcgcacgcacccagttggcaggcgtggtggtgccatcgcggaactcggagacggtgcgcccaaaggcaccctttctaaacggcgtctcgataaagcgataggagcattcggctacggcgaccaccagcagtacctgcaaaatgtactgccaccagggcgtatcgttgatattggcgaccggattcatgagcagcaacagcggatagtgccacaggtagatgctgtaggagcgcttgccgatccatacgagcggctcggcggacagcgcgcgggcaaccattccctggggctgcacgcaggctgcgatgaccatgagcgtgaggatggagcataacagcgtgccgccgcgatactggaacgcggtgtagccgttggtgagtgcgaccatggcggcaaggccaaccagacccacgacgcccaagacatcgatggatgcgggtgaggaccaaaagcgcacgagggcgctcggctgtgccagggcggtatcggctgattcgtcggccttcttgtcaggcttgtcctcggctttcttgccgtgcttggcggcgccagccaggcgattgagccccaaacgatgagcgagacgcaccggcgccaggtcgcgatcggggataaaggccatccaggcacccagtagcagcgagaacacgcgggtgtcggtgccgtagtacacgcggctggggtcggcggcgggattgtagagtaccatcatggcgagggcagataccgcggcaaggcccagagccacgcggcgcgtgttgggcttgctcacatgcatggataccatggcaaacagcaatggcggccaaatcaggtagaactgttcctcgatggcgagcgaccaaaagtgcgtgatcggcgaggggtcgcccagagcatcgaagtacgagacgttttgggcaatctgccaccagttattaaaaaacagcagcgacggcaggatgtcggggcgcatcttggtgagcatcacatggttaaagatggtgcacagcgcgcaggtcaccaccacaacggttaccacggcggggaacaggcgacggatgcggcgaatccagaagctcttgaggtcgatgcggctggtctttgacacttcgttgatgagcaggcgcgtgatcagatagcccgagagcacaaagaaaatcgtgacgccaagcaggccgccctgtgcccatgtgaggttgaggtgatagagcactaccgcgacgacggcgagcgtgcgcaggccgtcgagggcggggatatatcgagatttggggcgcgtgggcgcctgttcttttgcggcgctgttggtgtgggcacccttgttggcgggcgcacgacgagagcctgcggcgtggcgcggctcggtggcttgtcggttagcgcgcgaacgttcgtgcggcgcttgttgatcgctcgcgtggcgtgagctgcgcgaactcgatcgcgggaattgttccataaaacatcatccaatgacgagaataatcagcacgtcttcattgtaaccgcctgctcctgtgaatgcttgctgccggcgcaagctcaagcgcgcgtccacatcaaagtgaactaaagttatagaggcgcgagagcgcacgattgacggccaacggcgggtgcagagcccgcggacgaggaggtttccatggcagatagcggcatcgttgcggtgttcggcagcatgaacatggacctttcggtggcgtgcgagcgcatgccgcgtgcgggcgagaccgttggcggcagcgggtttatcaccaacgccggcggcaaaggcgccaaccaggccgtagctgctgcgcgcatgggcgcgcacacgcatatgatcggcgcggtcggctgcgacgcatttggcacgtcgctcgtggcggggctccaagacgccggcgtggactgtgtctttgtagcgcgtcgcgatgacgtggagacgggaacggcgaccatcattcgctgcgagggtgacaaccgcatcgtgctgtcgccgggtgccaaccatgcgctcgcgggcgaggatgttgcccgcgcgctgaggcgtctggtagccgatgagctcgacggagacgccagcgatattgccccggctgccggaagcgtctttatcgcccagggcgaatgtgaccttgcggcgacggccgaggcgcttgtttgcgctcacgagctcgggttctatacggtctttaatccggcgcctgcctgcgagttgcctgcggaggcctggcctgcggtcgacctggtctgtcccaacgagactgagtgccaggtgctgacgggcatcttgcccgcggatgatgcgagctgcgccgcggcgctcaatgccctgctcgccaagggtgccggagctgcggtcatcacgttgggcggcgccgggtcggttacgctcggcgatgacggcgagccgctgcgcatgccggcgctctcgagcacgttggtcgatacgacggccgcgggcgatacatttatcggtgcgcttgccgcggctcgcctggagggcctgccgctctttgagtgcatggcggcgggcgctcgcgcctcggcggtgacggtgtcgcgcctgggcgctcagcaatcaattcccacgcgtgcggaagtcgagcacaagtttggtttagaaggtttggatgtagacggagaagcggagtagaacaatggcaaccaagaagctgatccttgatctggatatgggtgtggatgatgcgatggcgcttgcctatgccatcgcgagccccgaggtggagctcgtcggcatcaccacgtgctttggcaacgtgcgcgtcgagcagtcggcgcacaactgcttggcggtgctcgacctgttgggtcgtcccgaggtgccggtgtacctgggcgccgatcgtcccgtgagggcgaccgaaccctacacgccgccggcgtccaccacgcttatccacggcaagaacggcatcggcggcgcaagcgtgcccgcctcgccgtacgagccggtgggcgcgatgtcggccgatggcaatgcggcggtcgattacctgattgatgccgcgcgtacctatggtcccgacttggtctatgtggcgaccggtccgctctccaacctggcgctcgcccttgagcgcgacgcggcggcgatgatgtctatcggccgcgtggtggtgatgggtggcgccctgaccgtgcccggcaacgtgagcgccggtgccgaggccaacatggcgagcgaccccgaggccgctgacgccgtgctgcgctcgggccgcaaactcaccatggttggtcttgacgtgacgcatcgcgtggtgctgacgcgccgcgacattgccggttggacgggctcgggcaccatggcgggctgcgcatttgcgagtatggtcgagcactacattggctcgtacgagatgaacgccccttacctgggcggctgcgcgctgcacgatccgcttgccgttgccgtggcgattgatcccacgctcgtgggcgcacttggttgcaacttgcgcgtcgacctgctcggcgagtatcgcggccgcactatctgcgacgagcatcgcctgtccgaccccgacaagagcgcgcttgtggcactcaccgtggacgccccgcgctttctgtccgagttcaaggcgcgcatggcccgcatcctaggctaggctcgggatcgaagcacgcccatctgctcgatgtggccgctggcgggtcgacatctaccgttcgccagcccgatggtccccggggcggggagagcgctataatgcattctgcatcttggattgttactcctgtgtggaggcatgcccaagagcaatacaacacggattgttacgtaaggcatgaccgcaatagcactgctattggctatcatgcctttttctgtgagtgttcttgaaaggaggttcaccatgcttgcaattaaaaagcttaacaacaacgcggttctttgccgtgacggacaggggcgagatgtcatcgccatgggcaggggcgtcggtttcggcggagattttcctcgagagctccctctttctaaaatcgagcatacgttttacgacattgatcctaaaggacaagatgtcatgagggatcttccctcggatatcgtgatgtttgcggcgaaagttatggacatcgttgccaacgaactgccctacgacctctcgaccaatgcgacgctgttcatggctgatcacctgtcgtttgccgttgcgcgagcccaaaagggggtccgcatcgcgatgcctcttgcctatgaagtgcgggagacgtatccgaaggaatacaaggctgcccagtttatcgtcatgcgactcgagaaggagctcggagagcggcttcccaaggatgagattgccagtattgcgatgaatctcgtgaacgcacgggttgttgaagccgtcaaagccacggccgagcccgcaaagcagttcgacgatatgctcgaggacgttatcgagattctcgaaagcgatttccgcattattgtcgaccgcgattcctttgatttcacccgcttcgccacgcatctgcggtacctgttcaagcgcattcaagccggcgagtcgctgaacagcgccaacatgcagatgtacaagaactttcgtgaggagtttccgcagttggcagagtgcgtgaagcatatcggttcctattgtcgtgaaacgtgggacgccacgctctccgaggaggaggaactctatctgatgatccatctcaaccggatcatctccaaaaaaggattgtaacccgtagccattcggggcatgacctttgccgattcgaacagtaagccaagattgtgcaaaggagccaatgatggcaaattacaaaaaggtggcagagcagattctctccactgtgggcggggcggaaaacgtggcttcggttacgcattgcatgacgcgcctgcgcttcaacctcaaggatgaaagcctctcgaatgatgagaagcttgaggacatctcgtctatcatcagcgtcgtgcacgccggagggcaggtgcagctggtggtcgggcccacggtcgacaaggtctacgacgaggtttgtaagcagggcggattcgaggtcacggtatcgattgacgaggaactcgatggccctcagcttagctggaaggagcgcttggcgcccaagcacctcttcaatcagctgctcgatgccgtgagcggcgctatcaccccgatccttccgatcttttgtgtcgccggtatcttcaagatgttcgttattctgtttgggcccgaaggcgccggttttatgtccgaaacgagcgacctgtatcggatcctttccctggtgggcgatgcggcgtattactacttcccggtgtttgccgcctatagctcggctaagaagttcaaaacgagtcctgtgctggcactgctcatcgctgttgtgatgatttatcccgacatgctcgctattgttgaggacggaaagcctttcagcgtcttcggcatccccatgcagctcgtcaactacacccaggctgttcttccggtcatcttgatcacctgggcccagtcctatgttgagcgcttctttaagaagatctcgcctgatatgttgcgcattctgatcgtacccgtgggtacggtgctcgtgatgttgccggtcgcgctgtgcctctgcggccctgccgtccaatttgtcatgggccttgtggccgatttcatcatttggctcgcctctgttgccggtcccgctgcgaccgcggttatcggcgcattctggaatctgatcatcgccaccggcatgcacgtgccgatctataccgccatattgcccgccgcgctccagaacggttacgacgccatcttataccccggcaccgcggttgtagcctacaccacgcttgccatcgcgctcgcctatggcctgcgcgctaaggacaaggagagtcgagccacgggctggaacttgttcatcacctatgccttcggtcgcgtgagtgagcccatcatctacggcatcctgtttcgcgacaagaaggctcttgcctggaacatgattggtggtgctgtcggtggtctgctggtaagccttcttcatgccaacgtctatatcttcactggcgttggtttcccatggatgaacgtgctcatgtttgctcaggatatcatccctggcaccatcgggtgtcttgctggcggtgccgtgacgtttgcgttggcgatgatttttggatttgaaggacaggagaagatgccgttgaagtccaagagcggcgattctgaggccgttgaatccgtcgaggcataagaggctactacacaaatatgctccccagccgttgcgcggtccgaccccttggccgcgcaacggtactgtgctgttgcgcggcacttgccgagtccgttgcgttcgacagtgtgggccgggaatttgatagaaaggacgacaccataatgtttagagaagattttttatggggcggggctctggctgcaaaccagtgcgagggaggatggaacgaaggcggtcgcggtttagccaattccgacatgctgccgtttggcgatcaacgcatggacgtcatgcggggagaccttgatccgcgtgcgttggcacccgacagcttctatcccgctcgcaagggcattgatttttaccataggtacaagcaggatattgaactgtttgcccagatgggttttaaatgcctgcgcttatcaatcgcctggagccgcatttttcccaaaggagacgaagccgagcccaatgaagaaggccttgccttttacgaggatgtttttaggacgtgtcgcgcgcatgacattgagcctttggtgacgctcaaccactatgatgtccccatgcatctcgtcgatgcgtatggcggatggcgcgatcgcaggttggtcgacctgttcgagcgatattcgcgtaccgtgttcgagcgctatcggggattggtcaattattggctgacctttaacgagatcaacatcatgacgcaggcgtgctttatggcggcggggatcatcttcgagcaaggggagaatcgctatgcaacggttcacacggccgtgcaccatgtattggttgcgagcgcccgtgcggtcggggcgtgtcatgaactgtgccctggggcgaagatcggttgcatgctcaacgcaggtgtcttctatccggctacatgtgatccggacgatgtgctggctgcgcaggctgagaatcgcagccattacatgtttaccgacgtccaggtgcgcggtgcgtacccgagctatgttctcaaggaatacgcccgccatggttttgaggtgccctatcgggatgatgaccgcgaagtactggctgcaaacctggtcgatttcgtctcgttttcgtattactcgacgcgcgtcgcaaaagcgcatgcggaaggtcagttcgattcgaaccttcttcgctcggcgcctaatccgtatctaaaacaggagccttgggggaggtttatcgaccccaaagggctgcgcgtcaccatgaatgaaatctgggatcgctatcaaaagccgctgttcatcgtcgaaaacggtttgggtgctcctgatgtgccggaagattcgggtgaaatagaagacgactatcgagttgaatacctgcgggcccacatcgaggcgatgagggagaccgtcgagctcgacggggtggaactcatgggatatacctgttggggcccgatcgatttggtttcggtcgccacaggacagatgcgtaagcgctacgggtttatctatgtcgatcgagacgatagcggtgcgggctcgtttgagagacgtaaaaagaaaagcttcgaatggtaccgacgcgtaatagcaagcaatggcgaagaccttgcgtaataacgttaagatggacaaatgcgcccgttgggggaatagtcgggccacttcgcttgacaacaggctaaactagctattaaacatttactattctgtttagattgaatttgcggtcgtttagttgccgagccacggggcggtcaagccacgatgctcggccgcgaccgatgctagggggaacgatggctaaagcaagcgtccgcgagatcagccgcattaccggcttttcgcccgcaaccgtgtccaacgcgctcaaccgcaagcgcagcgtgagcgaggagaccgccaaggtcatcctggagtgcgcgcagtcgcttggctatcagcagtcgacgcagctcgagagcatccagtttgtgcttgcgcgcaagacgggcgccatcctggacgagagcaccttccatcccgcggtcatcgagggcgtggagcgccaggcgcgtcgccacggcatgagcacgagctttgtctcgctcgactttagcgacctggacgccgtgcgcccgcaggtcgagggccttatcgccgatccgtcagccgctatcgtgctgatgggtacggagctgggcgaggaggactacgccctgttcgccgacgctgccgcccacctgatcgtgctcgatggctggagcgaccgccagtacttcgacgccgtggtcattgccaacaccgattcggtgctgcgtgccgttgattaccttatcgagaagggtcacaagcaaatcggctacctggcaggcgaccttcgcatccgcaatttcaaggaccgcgagcgtggctatcgccaagcgcttgaggacgcgggccttgaggccaattcggcatggcgcgtcaccctgggcaccacgctcgagggcgcctatcgcgacatgggtgcttggctcgatacggtctcgcacgacgatctgccgacggctttctttgccgagaacgacgtgctcgccgtgggtgctatgcgtgcgttgagtgagcatggcattcgcgtgcccgaagatgtctcgatgattggcttcgacgatctttccgtgggcgccttctccaacccgccgctcaccacggtgcacgttccaaagcacgaggtgggcgagatcgcggtgcgtcgcctggtgggcaacatccgcaaccccaagagctatacctgcaagacggccgtgtcgacctactttgtcgagcgccagagcgtgtgcgagatctaggcgaagaaaacgccggggcgcagggcggcaaagctcgctaaggcagccatatctaacgctactaagagagggtccttcggggccctctttttgtttcccttgtatgttcagtttgtttacataccgtttaggctgatttctctaccgtttacgggactttcgcgctagactattaaacaaaagagtaaaacatttagtaaacagaacaaaacgaaacatgcgtctgtttactgaacatgtgattaggggaggacgtacatggacaagatcaagctcggctttgtgcccacgcgccgcagcatctttagcgcgccggacgcaatcaagtatcgcggcctgacggctgatcgcctgcgcgagatcggcgtcgacatcgtggatatcgacgacatcaatgacgagggcctgctgttcgacgacagccacattgagcctatcgtcaagaaattccgcgccgagggcgtcgatggcattatgctgtgccacgccaactttggcaccgagtacgtttgcgctcgccttgcccgcgagctcggcctgcccgtgctgctgtggggcccgcgcgacgagcgccccgagcccgacggcacgcgcctgcgcgatagccagtgcggtctgttcgccaccggcaaggtcctgcgccgcttccaggttcccttcacctacatgaccaactgccgcctgaccgaccccgagttcgagcgcggcgtttgggactttttggccgtttgcaacgtggtcaagaccttcaagcacacccgcatcctgcagatggccacccgtccattcgacttctggtcgaccatgtgcaacgagggcgagctgctcgagaagttcaacatccagctttcgcctatccccatgaccgaacttgtccaggctgtgcgcgacgcccaggccgacgagcaggccatggccgccatgcttgcccacatcaacgacagctttgagatctgcatccccgaggacaaggtccctgcggtcgccggtcttgccatcgccatgaagcgcttggtcgagaagtatggctgcaacgccggtgccattcagtgctggaacgctctgcaggacgagctgggcattatgccctgcgccgccaacgccatcctcaacgagatgggcattcctatcgtatgcgagaccgatatccacggcgccatcaccgcgctgatggtcgaggccgccgacctgggccgtcaccgcggcatgttcgccgactggaccgtgcgccatcccgataacgagaacggcgagctgctgcagcattgcggcccctggccctgcagctgcgcggccgtcaagcccaagctcacctacccgctggctttcgatcaccccggcgcgctgacggccgaggccaagcacggcgacctcacccttgcccgctttgacggtgacaacggcgagtactcgctgctactgggcaacgcccgcggcatcgacggcccggccggcatgggcacctacctgtgggtcgaggtcgacaacctcaagcgcctcgaggccaagatcgtcgagggtccctacatccaccactgcgtcgccattcacgccaacgtggtgccggtgctctacgaggcgtgcaagtacatcggcattgcccccgacttatacgacccgattgaagaagacgtcaaagcctacctgcgaggagagtagaaatggcaactatcgaagagcttgagtccctgcgttgggaccttcgccgcgattgcgtcgatatcatcatggctggcgccggcggccacatcggcggcgacatgtcggtgattgacgccctcatgaccctctatgccaaccacctcaacatttcgcccgagaccgtcgacgatcccaaccgcgaccgcttcgtgctctctaagggccacgccatggaggcttactacgcggtgctctgccacgagggctatcttgacctcgacgacgtcaaggcccgcttctccaagttcggcagcccctacatcagccaccccaacaacaagctcaagggcatcgagatgaactcgggctcgctgggtcacggcctgcccgtggccgtgggcatggcgctcgccggcaagatggacggccgcgactatcgcgtctacaccatcatgggcgacggcgagcttgccgagggctcggtctgggagggcgccatgagcggcggcaactaccagctcgataacctgtgcgcgctcgtggaccgcaaccgcctgcagatcagcggtagcaccgaggacgtcatgaagcaggattcgcaggaggagcgctgggccgccttcggttggaacgtgctgtccattccgggcaacgacgtccaggccatcgacgccgcgctgacgctggccgccgagaccaagggtaagcccacggtcatcatcctcaacacggtgaagggctacggctcgccggttatggaggacaaggccgcctggcatcatcacctgcccaacgatgaggaatatgcccagattatcgccgatttcgctgcccataaggaggctatcaatggctaacaagatcgccaaccgcaaggttatctgcgacacgctgctcgaggccgccgcaactgacaaggacatcgtcgtcctgtgttccgactcccgcggctctgcatcgctcacgccgttctttgaccagtatccccagcagtccattgaggtcggcatcgccgagcaggacctggtgagcatcgccgccggtatggcctcgtgcggcaagaaggcctgggccgcctcgccggcgtcctttgtgaccacgcgttcgtatgagcagtgcaaggtcgacgtttcgtactccaacaccaacgtcaagctcatcggcatctcgggcggcgtgtcctacggcgctttgggcatgagccatcactccgcgcaggatatcgccgccatgagcgcgattcccaacatgcgcgtgtatctgccgagcgaccgcttccagaccgccgagctcgtgcgggccctggtcgccgataacaaaccggcctacatccgcgtgggccgcaacccggtcgaggacgtgtacaccgaggacgagtgcccgttccagatggatcgcgccacctgggtacgccgcggcaccgatgtaacgctcgtcgctaccggcgagatggtccgccatgccgtggacgctgccgacctgctggccgagcagggcatctcggcaacggtactcgacatgtactgcgtcaagccgctcgacgccgaggccgtgattgaggccgccggtgccacgcgcgccgtcgtgaccgtcgaggagcacagccccttcggcggtctgggctctatggtcgcgcaggtggtgggcgagcattgcccgcgtccggtcaagtgtctgagcctgcccgacgcgccggtcatcaccggcacctcgcccgaggtcttcacgcactatggcctcaccggcgaaggtattgccaagacggtcgccgacttcctcggcaactagtagaaacagacgctgcgcggccgccaagcaccgcaccttgccgttcaaaccgtcgcttgcgtacacaaagtacgcggcgctcctctttcacggcaatctgcggcacttggcggccgctcgctccttgttcgccgggctgtctttgctttggcggaaggaatgggagagtacatgagcaactacatcatcggaatcgatcagtccacgcagggcaccaaggcgctgctggtggacgagggcggccatctgattcatcgtgccgaccgcgcgcatcgccagatcgtcaacgaggccggctgggtgagccatgatccggccgagatcgcggccaacgttctggccgtggcgcgcgccgtggtggaggagaccggggtcgacccggccgacgtcgccggcattggcatttccaaccagcgtgagaccaccgttgcctggaaccgtgcgacgggcgagccgctgtgcgacgccgtggtgtggcagtgcgcccgcgcccgtgaactgtgtgacgagctggccgcccgcgagggcgtgaccgagctggtgcgcgacacgacgggcctggtgctctcgccttactatccggcgggcaagatggcctggattctcgcaaacgtgccggcggctgctaaggccgctgcggcgggcgagctttgccttggcacgattgacgcctgggtggtctggacgctcacgggcggcgccgagttccgctgcgactggtccaacgccagccgtacgcagctctttgacctgcgccgcggctgctggagcgagccggtgtgcgaggcctttggcatcgacactgcctgcctgccgcaggtgaccgattccgacggcctgttcggtacaacggacctgggcggctttttgccggcgcccgtgcctgtgcacggcgtgctcggcgacagccatgcggccttgtttgcacagggctgccacagccgcggcatggccaaggcgacgtatggcaccggcagttcggtcatgatgaacgtcggcgacgagttcgtcgccagctcgcacgggctttcgagctcacttgcgtggcgcatggacggcgtgaccgagtacgtgctcgagggcaacgtgagctacgccggcgccgtcaagacgtggctgcgcgacgacctggagctcatcaataaccccgaagaggtcaccgacctgtgctatgccgccagcccggcgagccgcgtctactttgtgccggcgtttaccggcctgggtgcgccgcactgggcgagcgacgccgagggctgcgtctttggcatgacgcgcaccacgggtcgcgcggagttcgtaaaggccgccgacgagtcgatcgcctatcagatcttcgacgtgatcgacgcgatggtcgaggattcgggtgcggcgttggccgagcttcgcgttgacggcggtcccacgcgcgatgcgtacctgatgcagtttgagagcgacctggtgggctcgcccatccgcatcgcgagcaacgacgagatgagcggcctgggcgcggcttgggcctgcggcattgcgctgggcatgtacacgcgcgacgtggtcgacgtctacggtgcccgcggcatcgtggagcctgccatgcccgccgacgagcgagacaaaaagatcgccggctggcgccatgcagtggccgcgactatctcgtacaccgcctagcatgatttttctgggacggggatcaaataatcatcggtcctcgtcccaggtggctaatttgggacggggcttttttgactggtatgattggtgtgaccattcgaaccagctaaaagagccccgtcccaaattgactatcgagaggatctgccatggagcgcattgcgagcttttctgtcgatcatctgctgcttgagcccggcgtatacgtgagtcgcatcgaccgcgatccggcgaccggcgctgccgtcaccacctttgacctgcgtctgaccacgcccaataaagagccggtcatgaacacggctgagtgccacaccatcgagcacctgggtgcgaccttccttcgcaatcatgccgagtggtcgagccgtatcgtttactttggccccatgggctgccgcacgggcttttacctggtcgtgtttggcgaggtgacgagcgaggagatcctgccgctcgtgcgcgagctctttgagttcgtcgccgactttgagggcgatgtccccggtgccgctcccgaggagtgcggcaactacctggaccagaaccttcccatggcaaactggctcgcgcgccgctacctcgaccgcgacctggccgatatcgacgggaaacacctgcactatcagcaggcataacgctgcccgcgggaataacgtttgcaacagaagcgcctctgctctttgcggggcgctttttcgcatcgaatgctcaaaatagtatgcgtttgttctagaatgttcgtatagtcacaactacgaacaggagtgaacatgcatatctactctgttaccgatcccgagttcaagtcctacggccgcgtgtgggacgacgtgccctccaacctgaccgccccactcgtcgaggcgctttccgccacgcccatccccgagggtagcaagtatgtggcctccgcgcccgagctggagcaggtcgaaggcgccgacacgctcggtctgctcatgtacggcggccgccccttccagctgggctggtgcaacggccataacacgaagctcaattgcctggagtatcaccgcgccagcgagtttaacctgggcgcccgcgattttatcctgctgctggccaagcgcgagcagatcgtcgacggtaagctcgacaccgcgcaggtcaaggccttccgcgcgccggccggcacgctcgtcgaggtctacgccaccacgctccactacacgccctgcatggtcgacgacggcggcttccaagtgatggttgccctgcccgcaggcaccaacggcccgcgccccgaggctgcagccgatatgcccgccgccggtgacagctactgctactggaaggccgataagtgggttctctgccacgccgatagccccaaggctgccgagggcggctacgtaggcctcaccggcaagaacctcgacatcacctgcgactagccccactaacttgcggtggaatagttcctgtttaggggtgcggtgccaaaaacaagaactatttcaccgcaactgatgagaccaccacaaaggtgcctgccccctttgcggtggtttgtctatatagaacatctgtacgactcctttcctttctttcctattttttcctttttttcctattgaggcgggcggtcagatttccgtctgtctcaatctgtaacatctagcaggcagaatcgtctctacctgttacagatcgagacaaacgagcggagcctcccgaataatctcaatctgtaacatctgacccggttttgacggcctttccgttacagatcgagacaaaccggtctccaaccaccacaaaggtgcctgtcccctttgtggtggttgggtatcagaaagtgtcaggctcgggcggctgctgggcgcctgcgtgcgaaaagaagtgtcgacctgcgccgttgtcgttgagcggcgcgctgtttgtgggggatactgaaaccacgacaagcagcgtatgaaaggaccgatgcatggctttccgtaaagacttcctgtggggcggcgcgacggccgccaaccagtgcgagggcgcctacgacgtggatggccgcggcctggccaacgtggacgtggccccgcacggctccgagcgcttcgcggtggtctccggccagcgcaagatgctcgacttcgaggacggctattactatcccgcgcagaccggcatcgatttctaccatcactacaaggaggacatcgccctctttgccgagatgggctttaagaccttccgcatgagcctggcatggacccgcatcttccccaacggcgacgagaccgagcccaacgaggccggcctggctttctacgaagacgtgttccgcgagtgccaaaagtacggcatcgagcccctcgtgaccatcacgcacttcgactgccccattcacctcatcaaggagtacggcggctggcgcaaccgcaagctcattgacttctacaagaacctggccaccacgatcttcacccgctacaagggcctggtgaagtactggctcacctttaacgagatcaacatgatcctgcacctgccgtttatgggtgccggcctggtctttgaggagggcgagaacaaggaggccgtcgagtacctggccgcccacaacgagctcgtcgccagcgcttgggccaccaagatcgcccacgagatcgaccccgaggtcaagattggctgcatgctcgctgccggcacctactacccctacagctgtcgcccgggcgatgtgcgccaggcccagctcgacaaccaggacaactacttcttcgtcgacgtccagagccgtggctattacccggcctatgccgtcaagaagctcgagcgcctgggcatcgatgtgggcatgaccgacgaggaccgcgagatcctggccgacaacaccgtcgacttcatcagctttagctactacagcacccgctgctccgcgggcgctgacaatcccgacgtcgagaagacccagggcaacgccttcgccggcgccaagaatccgtatcttcagcagagccagtggggctgggccatcgatccgctgggcttccgcatcaccctcaacgacctgtacgaccgctatcagaagccgctgttcgtggtcgagaacggtctgggcgccaaggacgttgtcgaggaggacggctccatcaacgacgactaccgtatcgactacctgcgccagcatatcgccgcgatgcgcgatgcggtgaccgaggacggcgttgacctgctgggctacaccacctggggcccgatcgacctggtgtctgccggcacgggcgagatgtccaagcgctacggctttatctatgtcgaccgcgatgatgcgggcaacggcaccctcaagcgttccaaaaagaagagcttcgactggtacaaacacgtcatcgagacgaacggcgaggacctggcctaaggcttcccaacaaccatagcctcctaaccaaaacgcccggcgagcagttaatgcccgccgggcgttttgttaagaagtgaaagcactcattggggacgtacttaaatgagtgcccgcagaatgagagtggataatctcccgtttttagcctgtttgtgggctcaaagtgggagattatccactctcgccatttgggcgtccaaaaatcctcgctcgttttgtcttagtcattgggggcgttcttaaacgactagtcgctggcgacgtccctcgccgtcggcggattttgggacatgtggcccgctttttgggcccgcctgtcggtacactaaaagcactatgggtacccgcgagcgacatatcggccacgcgaccgcccgatccgcgcccgtggcggatcttaggggcggcaggctcttcgccatgccgcgattccttgttggcatatcgcatggcgtgtatcgccaccgcgtctttgttatcgccggcgccattaccgcgctgttccttatgcttttggcagtcttgccggcactgtttgcctccgaccccaagctttccaacaccgtgcccgcctatagcgaggtgtccgaagaggtcgtggatgcgctcgtccactcgagctctctcccgctgcttgtcgccgcaattgcattttcaatctggggtgtgttggcgtacctacgctgcttggactacgtcttgcgccgccgccttgttgccatcgccgccatttgtgccctgtggatgatcgaggtcatcctcaaatataagtcgttcacgccgttctatgccaccgtgctgtggtacctgtactacgtgcccatgacgctcattccgctgatctaccagctgtgcggtctgcgcctcgcgggtttggaacagcatcgtatggggcgtcggtaccgcaccgttttgtgggtcatggctgtcctgcttatcggctttgtgcttactaacgatgttcatcagcaggtcttccatttcgatcgatcgagtggaacctggagcaacgattacacatatggttggggctacggtaccgttctggtatggacagcctttaacttcgttgccttttttatcctggtgggccggtcctcgtcctttcgcatccagcgtttctcgggcacggcggcgctcgtactgctgggtggcgcattctttgccatctcgtatgctctgcgcgtgccctgggcatggaggctcaacttttcgctcgtctattgcgtcctgtgcgtggtggcgatggaaatctgtctcgattgcggtgtcattccgtcatatcacgacattgctggcatcttcgataccttgccgctcgacctcaaagttctaacgcgcgacctgcaggaagtctatgccacaccggtgtcaaagccaatgccggcgggcgtgtgcgaagagctgcgggcccaggaacacgggcatgcccatgcctttgccgtggcgtccgatcccgatgtaatgtaccgtgcctttccactgctgggcggatcggccctgcttgcccaggacgtctcggagctcaacgagctcaatcgcgagctggcgcatcgtcgcatggagctgcagcgccaaaacgagctgctcgccgccgactacgaccttaagacgcatctggcagatcaagaggccgagaccttgctggtccaagacgtggaccaggcgcttgcccgcgcgttcgaagagatgtacgacctgttgagctcgctgccgccgttgaccgatgaggcatcttcgcacgagcgttaccgcatgctgcagcgcgccaagatgctcgtcgcctattgcaaacgcaaggggtcgctcacgttggcacagcacggggagagcggttttgaccgcgaccgcattcagctcatcgccaacgagctcgcaagtgacctgcgcaccatcgatgtcgattgcgcctcgattatcgccatacggcgcccgatgcacgccagtacggtaagcaccctgtacgactgcgtgtatgactttgcgttttttgcctacaccaccgaccatccggcgcttatgtatcacttgggcgaccatgaccggtgcagtgtcgagctgcgcgccacgcttttttccaacgatgatgaagatctttcgcagacgcccgctgcgcaagagctcgaaagcgctctgcaagggcgcaacgtggcataccgccttgagggcgagcccggccagctgcgcatgatcgtcttgatgccgagggcgggtgagtgacgatgcagatttcgttcatccttccccaaatcgttgcgctcgatgttgtctttgccctggctgcgtgtctgcagatgatccacgtcccgctcatcgcatcgcgccgctcgtcctataactgtaaggtgatttgcgcctacgagacgagccttgtgcttcacctgatgatttcggcgctcatcttattcgcgtcgtctggctcgtatctggtggcgccgcttgacgtttgcgccagggcaatgggcggagtgctgtggctcaatgccgcgatctttgcctatggcgtggtcctcatggtgcactatcgtcgccctgtcatgctggccgagctgctgcttgttggcgccgtgacaccgccggtggtttttgccatgggctcggtgtgggccgttgtccttatcgcagagggagcgttcttcctgttccgttccgtcgcggcgctcttgatggacgtccgtagccgccaagaggatatcaccgcgttctcgacgattgaaaccatcaacgtgattcccgtgggcatcctgtatctggactcgaggggccgtccactgctcatgaaccgctgcatgcgcaaaaacctggtggagcttcatatgcccaccgacctaggcgatatgagcggtacatggaacgacctgcgcaagctcagcatgcaaatgcccgaaagcagccagagccgcgtgcgcatcaatttggaccgctttggtgaggcgcgcgttgtggtcgaggtttctcccgccgagattcgcttgtttgtgcacgatgacgttatggtttctggccgcctcttcgagcgcattatcggtttggatgtaacagagtacgcgcatgctcacgatcgtttggcgcaagccaaccacctgcttgagcttgcgggccaagagctccaggcccagatcgaagaagtcaaaaaagttgccgacaatgcggcctatctgcgcatgcgcgcccgcgttcacgatgtgatcggccagcgcctatcaatccttcatcgctatttggaggaggggcgcttggacgacgagtcgctcgagcagatcgacccgctgctgcgctcaatcgctgccgatctgcgcagcgggggcgacaccgaaccggcagagcaactgggcgatatcgtccatgcttttggcctggtgagcgtgcagatcgatgttgagggtgcgctgcctgaggacgcgcgtgtcgccgccgccttttcgcagattatccgcgaggcctcgaccaacgccaccaagcatgcgcaggcgcatcgggtccatgtgcgcttgtggcaggaggggtcggatggcggtgccattgcccacatgacggtatcaaatgacggcgcgcctgctcccgtatcgtatcgcgagggaacgggtattcctggtatgaggcgtgtcgcgcaaaatctgggcggcagcctggaggtccatgccgccccgccctttacgcttgcggtgtccattccgctgaactccaacgcaacggtccaaaggagaagctcatgattcgtatccttatcgtcgaagaccaggccatcctgcgcgagagcctcgcgcgctccgttggggaccagcccgacatgaccgttgttgccgccatcgccgatgcctcagatgccttggacgtcgcgctcaaggagcatccggacatgattttgatggacgtgtgcaccgagcacgattccaacggcatcgtggcggcggcgcgcatcaaagagcagctgcccgagtgccgcgtcattatcatgacgggcatgcccgagattacgtttgtggatcaggcgcgcgaggcaggcgtcgacagctttgtgtacaagaacgtcggcatcgatgagctctttgccgtgatgcgctccacgctggcgggctattgcacgtttcccaagccgcccgaaagcatcttttcgggcacggcggcgctcgacgacgttgagttgtcgattttgcgccttgcctgcgaaggcaagagccgtcgcgagaccgcggccgagttgtttatgagcgagggcaccatcaagcgccgcatctcggagattctcaacaagaccggctacgacaacatcatgcgcctggccgtgcacgcggtaacggagggcagcattgttcccaacatggagcgctaacgctcggtacgcatcggcataaaagcgacggggccgcaggattaactcctgcggccccgtctggtgtgcgcggatgtgtccgccaatccgcggctgatgttacatgccgttacgcgatggttgcgctgtaggaggcgacgtcctcgtaggaatcggtcaggtaggcgtcgatgccgatggtcgtgttgaccaggtcgtcgaggctatcgagctcgccgctcgagaacgtgaattcctcggtggcgttggtgccgggcatcaggtgagccgagaaccagggttccttcatggtgccgttgacgttggtcttaccgctgggagcgtagaaggtcaggtccttgtcgctcttgttggtgatgttgatgacaaagccgatgtcgccccagtcgtccttgaacttctcggtgatggtgatggtgcacagatcgtcatcggcgacggtgacggcgggggagatttcgacgctctggacgtcgtcgtcttcgacggcctcatcgatctcatcttccttttcggcagcctcgcgatccttcttcaccgtgccggacagatccttgtcggacttggtgaagatgagtttgtcatcgtccatcttgaggacgagtttgccgtcctcgagcttcatgtcctgcgactcaccttcggcggtgatggttgcggtggtggcgtccttagcctcccatttcaggtcgataacctcaaggaacaggtcgaggttgcctgtgccgtcctcatcgaggatcaggatggcgcggaggccccactcctcgagcatatccatgtactcatcggtcagctcttcgccctccagggttcctcccgagagctcccaactgccgacgaagttggccttgggatccttgccgccgccaccgctgcagcccgtcagggcaaaggcgagcgccaggacgcatgtcaggaatgcgagtacggactttttgaacgttgtcttcatggtgtcctccttaatcgaacgaaacccatagaagcaggagcgggggcggcggatcccccgccaattaccagatagaggggctagggcctgggcgttccgcagttgctgcagaacttgccgccgttttcgctaccgcagttggggcagaaccacttggccggtgtcggggcaggtgcggggctgccgcactcggggcagaacttgccggtgttggtggcgccgcagctgcaggtccacgtgccggccgcaggcgcggcggcgggagccggtgccggggcgggggcaggtgccggttgcggtgcggcctgttgctgcgcctggccggcggcgaacagctggctggcgttcatgccacccatgccgcctgccatgcccatgcccataaagccggccatcgcgccgttggggttggccgctgccgcgcgcatcgcgtcgctctgggcgctggcgatattggctgccgccatcgtggggtcgcgcatgaccgcggccttttgcaggtccttgatcatctgctcgtcttcttgcgaggcggcgatggagttgacgccaaagctcacgatctcgacgccgcgcaggtcgcgccagtcggcggagaggacctcgttgagcgcacgggcgagctcggtggtgtgcccggggatggcgctgtagcggatgcccatctccgagatcttggcaaaggcgggctgtagggcggtgagcagctcggacttaagctggctgtcgatcttgtcgcgcgtgtagctatcggtcacgttgccgcacacattggtgtagaacagcagagggttggtgatgcggtacgaatattcgccgttgcagcgcacggagatgtcgacgtccaggccaatattgttgtcgaccacgcggaagggcacgggcgaggcggtgccgtacttgttgccgatgatctccttggtgttgatgaagtagacgcgctggtccttgcccgcgtcgccgccaaaggtaaagcggctaccgatattggcgaaggtctccttgatggagtcgcccaggttgccgctaaagacgctcggctcgctgccggtgtcgaagacgaactcgccgggctccagcgcgacttcgatgatcttgccgttttgcaccacgagcatgccttgtccgtcgttgacggcgatgaccgagccgttggagatgacgttgtcctcgccgcgcgtgttggagctgcggccaccggtacgtttgctgcccttgcaggccaagacgtcagcaggcatcgattcgcagtagataaattccttccactggtcggccatgacgccgccggcagctcccaatccagctttcaagagtcccatggtgatcttcctttctcgtcaaaggccgggtggtattggttggattgcttagtcgtccttgtcgtctttcatgacaacggtggtctcggtgtggctgaaggtgtcgtgtttctcggtcaggtcgagctcgccacaatactcatcggcacaggttgcttcgttggccgtcttgagctggcctaccagtagcacgtctccgataatcacgatgatcagcggcgcgatgatattgatgaggatgccctcgatatcaaaggtgaggtaatccggatcgaaggcgtattcccccataaagagaatctgggagaggataaatccgatcataaagaacagcaccgaggcgatgacgagcttgggcttggagcaggggagctcgccgaccaagcggccggtctggccgttcatggcaaacaggtagctcttgccgttccacgaggtggagagcatccagacggggaacagggcgtagtcgctgtcttcccaggtgtagtcgagctgcttgctttcgaccgtggcatcgtcgtattcgtcgacgacggtctcgcgcagggccgagattgtgctttcttccatacggcgctcggcgcgcgccttgcaggtctcgcagtcctcgtcgtaacggttggcgatgtagccgggcatatatgcgaccgagaacggacgcagtgcgtcgtagtcaaacggctcgatggcgtccatgtggccgtcgggcatcttggatgatccgtcgacgggcacgcgcttaaacgagatattgcccttgcgataggcatcgtagtggtcggtggtcgtgacggtgcggtcggattcctcggtcacggtctcgttggtcgcgtcaaagtacacttcgccgtcaacgcgggcgccgtagagccaaaacggcacgtagacaccttggacctcgtcgatgtggttgccggtgacaaagctcttgggcagcaagatcttgcccttgtagtgttccttgagtgcggccgtgacgtcatcgcgcccgagcttaaacggaatcaccaggtcgggcgagaagtcgccagagagctggccgggcgccacggcggagttgccgcagtacgggcaggtggtgacggcgacggtgccgtcggacacgagctcggcgccgcacgacgagcagatgtagccggcgttttgggcgagttcctgcaccgcgtcgtcggcgacgggcttgggcgttgcggctgctgcatcggctttggcatctgccttgtcctggcgctcgcgatagagggcctcgacttcttcgacttcaaaacgagaatcgcagtagtcgcagacgagcttttgctcggcactggcaaagtgaagggggccgccacacgcggggcattgatagttgatgctctcaaaggccatgatcggtcctttcgctgccggaggctatgcgccgatggcgccgccgcagtattcgcagcgcccgctggcatcgggaatggtggtggctccgcagaaggggcaggtcaccgcggtcttgggggctttggcggccacgacgctgtcgcgcgtctcctggcgcagctgcaccagcgcatcgcggacttcggttgcctggcgcttggcctcgcgatattcgatggagccgcgctgatcgatggtggagtcgttcacgcgcaggttgatctcggtaaagtacggcgtgttgacgtggatggtcagattaaagtcgtaatccaggtcgtagcgcggcgggttgtagctctcgcgctcgccgtccttggtctcgcgatagatctcggtgcggtgctcgtcgatatccatatcgcagccgagtacctgcgagaactcgatgatgtcgggattggcatcgcgccagcggctctgcgaagtgatgatcagcaggcccgcgtcctcatcgagcataatattggtgcgcccggccgagagtgtgcgcgtggggttgaacgacgccaggcgttcggcattggcctcgcggtaggcgagttgctcgcggatatcgtccgcggtgctggaacgataaccgtcaaagaagggggagagcttgccgacgcactctttgcacaggtagccttcgttgatcttggtcttacctagaagtcccagctcggtaccgcaaatcgcgcactctttcttctcgaacatcttgtcaaagaagcccatggctgcctcccatcaacaggtagcgtgtgtcacttttgatgatgggcgagtatgcagcctttcacgatacccaagcggctcaagaagtctccacaactgggacacaaggcccattttgggaagtcatcggggacgttcttaaacgactagtcgccggggacactctttgccagttggcacttggggacgttcctttctgccggcacctggggacactccttgtgggggggggctcttctcgagagacaggttggttatggcctcacccgctgtcggaaattcgatcaacgctttctaaaaaatgttcaatagaggtcaattccaattgagattatgttgaaatatataaatactcaattggaattttgcagttatcccagttaaaataggaaaagggaggcaagttatgctcaagcgtaaaataatcgagaaaattgaaagctggaaacagactaaaaccgggcagggactgcttattaccggtgctcgacaagttggcaaaacaagcgctgtcgagcagttcgcccgtgacaactatagaagcttcctgaaaatcgacttcgtggagagacccgacgcggtcgagctcataggggaggcaaggagcctcgatgacctcattgtgagaatcaccgcactggcttcatcgcccatcgcttcggatacaaagacgcttctgttttttgatgaggtgcagcgttgcggagacgccatcacctggatgcgctatcttgcgcaagacgatcgtttcgatgtcatttactccggctctatgctcgggattgaggcgttccattttcggtcgttgccggtaggtactatcgatatcctcgagatgtttcccatggatttcgaggaattctcctgggctctgggagtcgacgaatcattatgggatgtcgttcgtgcctgttatcgcaaacgggaacaagtgcctccgtttattcatgaacggttgatcgagacgtattatcggtatgtccttgtgggtggcatgcctgaggccgttcagctgttcgtctcaactcatgatacacaggcgatgcgcgctcgtcagcagggcattctcgaagcatatcgcgcagatatcgcacggtacgccgaagcccccgcgcatgctcaacggatcaggacgatctacgatgccatgcccgcgcagctcaataaagagaacaagcgctttctcgttaccgggatagacaagcggaaacgatttttggatttgcagcctgattttgactggcttgttaatgcgggcgttgcgatcccggttaagagggtgagcgagcccgtgttccccttgggtctctcgcgggaagacagttttttcaagttctacctgagcgatgtggggctgctgttctctactttttctcccgctgatgtcgaggccattgttgcgcagcgggaatcgatcaactttgggcaggcttttgagaatgcggtcgcccaggagctgcgcgcatgcggctactcttcgttgttctactttaacgcggccaaggttggagaagtcgattttattatcgaggataagcggagccccgtcgttttgcctatcgaggtcaaatcgggtaggtacagcacaaagcacgttgccctcgatcgcctgatgagcgttgaaaactatggattggctcgggcggtcgtgcttcaccgggacaacgtggtggatggaaaggcgatattgtatttgcccctatatatggcgggtctgctaaaagaaatgccatagatgaagggttgagagctctagggtagtcattggggacgttcttaaacgactggtcgccggggacactctttgccgagcaagcagtccacgtcgtgctccttctgggacagacggctcaaaaacgctgcacgccgtggactactggggtcaaattcgcggcatttcgagcttggcttcgttatcgggactgattctttattaaaattgaaattcaaacagttgagcggcgggggggggggatattcatgagaggcatgggagacacagccgcatacctgcgtcggggcattcgggagattatatgcctagcgctgttctattttacgtatttggctggcgagtatctttttgacgtgcgcgttgccgagtttgtgccgccgagcgaggtcgttgtctacgagagcttcatcgtcggcgcgagcgcaatcggctttcttgtgcgtccccttctgtactaccgccgtccccgtgcgatcgatacgacaagcgacatcgcgggcgtgttgctggcatcggcgttgctgctgttgatgatggcggctcaatttgagatgctcattgtcggcggtttgctgacgttctgcacgctgggctactgcgggtcgaccgcccacgccaactttgcgcgacgctttgcgcgtacgccgtatttggcgcgcgtgttggcgctttcgtatgctttgggcgttctgctgcaggtgttcaaccatatggtgatgcctgcggggattccgcagcagtttgttcttgttgcctgtgcggttgcgcaggtggtactgctccacaacgtccgtcgcgccaagctacacggtgggcctgaggttgggcgcgagtccgatatcgccgagctttcggtggatgcgtcggaatttggcgccaagtggcaagacgattctgaatcaacggcggcttttcggcgcgccgtggtgcgtctgacggtcgcaaccgcctgccttaccggtgtgtttgccgccctcaatgcagggctcacgacctcgcacgccgccggggccatcgacttgggcgattggccgcgcttgctgatgggcgtgagcgcactggtcgccggcgccctatttgacctgcacggtcgttcgtatatgaacatcaccatgacttgcactgccatgctgtccacactttcgttctttgtcttgctcgtcgacggcaatggcggcaatgcgcttgctgccatgatgattttctatctgggttcgggcttcttcgtagtgtttttcacgacgaaatttgctgccatttcggtttacgcgcactggttgtatctgtggccgtgcatgggtcgtgtcatcaacgtcgtttgcgcgacgctcgtgacggcgccggcggtggcgattgtttcgagccagagcgtgctgctggcggtgggtgcggtgctcgtgctgtttgtgggcattgcgatttcgctgctggggcagtctgggcatcggggcgatgacgctgcggtgcacgacgagctggcgtttgctgccgatgatcttggcgcggacctcgtgtctgctcagagcgagcccgccttcgcggaggtgccggaactcatgctcgacgaacgtctccatgcctttgtcgccgcccttgagcttacagagcgcgagcgcgatattttggaggccttggtcgcatcgcacgagagcgttcaggatatcgctgcaacgctcttcctttcgcgctctacgctctaccgtcatatcgcctcaatcaacaaaaagaccggtgccgcctcgcgcgtggcccttattaacttcttctggtcttggacaccaaatgactagttaatttgggacggggcttttttagctgttttgggccgctgcgactggcgggggcggatcgcggcggcccaggcattcttgacgatggtgctggcaacgctacagcagctcgccgtggcgggcgatgtagcggcgcttggccagctgggtgagcgcgatgtaggagccgacgatgccgatgagcagcgcgaagaagctcgttggcagcggcatgagccccagtgcatcggcgatggggcttgccggcagccaggtgacgagcgccaggcccagcacggtgagcacgcacagcgcgggggcggcgtggtcgcgcgggcttggcagacgcggggagcgcagcatgtggatcacgagcgtctgcgaccacatggactcgacaaaccaaccgctctggaagagcgccgcaaaggccgccatgcctgcgacgtcgtccgcggcggcaagctctgcccagctcgcgtccacggcggcggggcataccacaaagaagagcgcggcaaaggtcacgatgtcaaacagcgagctcacagggcccagctcgagcataaagtccttgatggacgcagcgtcccaggcgcgtggacgggcagtccaggcgtcgtcgacggtgtcccacggcagcgcgatgcatacgatctcgtagaccagcgacagcagcaccagctgcagggcgctcatgggcaagaacggcaggaacaggctcgcgacggtcacggacagcacgttgccaaagttggagctcaccgtggtcttgaggtacttgagcaggttgccgtaggtgcgacggccttcgatggcgccgcgctcgagcacgcccagatccttctgaagcaagatgatatcggcggattccttggcgatgtcgacggcggaatcgaccgagataccgcagtcgctcgcgcgcatggcggcggcgtcgttaatgccgtcacccataaagcccacggtgtgaccgagcagctcgcgcatgacgcgcaccaggcgcgccttctgcagcggcgagagtttggcaaagagatgagttttctcagcgcgctcggcaagctcggcgtcgtcgagcgcatcgatctcggagcccagcaagacgttactcgcgtcgatgccgatctgctcgcagacggtggcggccacgcggtcgttgtcgccggttaagaccttgaccgccacgcccttggcctcgagggtggcgacggcgccggcggcacttgccttgggcggatcgaggaaggccaaaaagcccatcagcaccatgtcgcactcgtcggcgatgccaaactcacccacgcagcgcggattggtcttttgcgccacggcgatcacgcgcaggccctcggcattgagttcggcgacttgcttgcgaatctgggcgagcttattttcgctgagcggctgggcgacacagtcaacctcgacaaaggagcaaatctcgagcatttcctcggcagctcccttggtaaccatctgggttttgccctgggcgtcggcgacgactacgctcaggcgacggcgtgagaaatcgaagggcacctcgtcgaccttggtatagcggtcgcgcaggctctggcccagcgtggagtcgggcgcgacagtcgagggcgtcacgtcggcacggtcgatgacggccaggtcgataaggtttttgaggccggtctggaagaagctgttcaaaaacgcatggcgcagcacgcgtgcgtcctcgttgccgtcagtgttgagatagcgctcgagcacgatgcggtcttcggtgagggtgccggtcttgtcacagcacaggacgtccatggcaccgaggttttggatcgccggcagctccttgacgataacctggcggcgggcgaggtccttggcgccctgcgacaggctcgtggtcacgatgacgggaagcatctgcggcgtgatgcccacggccacgctcgtggcgaacagcagcgcgtcgatgacgctgcccttggtggcggcgttgatggcaaagacggccggcgccataacgagcataaggcgtacgagcagcatggagacgctcgagacgccgcggtcaaacgcgctcttctcgccgcgcccgttgagcatcttggcgatgccgcccaggtaggtgtccgagccggtggcaacgacaagtgctatagcggtgccgttttgcacggaggtgccggtaaagacgatgtttttgcaggcagagagcggcagcgcggggctgccggcaccctcggcgacggtgatggcagcggtcttttcgacggcctcgctctcgccggtgagtgcggactcgatcacaaacaggtcgcgcgcggtgatgatgcgggcatcggccggcaccatatcgccggcagagagacggattacatcgccggggacgagatcgtcaaaggggatctcgatacgctcgccgtcgcgcagggcacagcaggtgttggagaccaggtccttgagggcctcggccgcattgccgctgcgagcctcctggataaacttcatgctgcccgataccagcagcatgatgccgatgacgatgaccgtggagggatcgcgctggggctcgggtacggcgagcacgtcgatgtagagcgagaccagcgcgagcgcggcgaggatgccggcgaagggatcgatgaacgcgtcggcgatgcggcgggcgagcgtcttggtcggcgcctcgatggtgttggggccggcggcgtccaggcgctcggcggcgtgctcggcagtgagtccgtcggccgtggcgtcaagcagcacgagggcgtcctcggcgctatgggtggcggcgaatatggtgttcttggacaggccggtgtgagcggcggggcgcgccgtgcggcggcgcttggagatagcttcgagtaccgtggcggttttgagcatcagcatagggtcctccttgttgaagggagttagcgtacgtgtcgtattgagttgcaaaaaacctagatgtcgctcacgtcaagctcgcgaaccaccacaaaggggacaggcacctttgtggtggttttgacgatcggatagtggcgtttatgcgtgtgcggagtccttgcggcgtgccgagggcgacatgcaggtttttcgactatgactgccttccatggcacacctccttaaggccgggcgcaatgcgcttcaggcatttcgtgcccgtttcaatccgcccgtatttttgatgagggggtttgccgtgtcaaccccattgttcggaaaaccattgcccctgacaaagcctttacagaatgccgtggcctcaaagcgcacccgcatcgacgccctgcctgcgctaaactggaaggcacgtacgcgattacgagaggagcccgcatggaggcttacaagcaagagttcatcaagttcatggtcgagtccgacgttcttaagttcggcaactttacgctcaagagcggccgccagtccccgttctttatgaacgccggcgcttatgtgacgggctatcagctcaagaagctgggcgagtattacgcccaggccatccacgataactttggcgacgactttgatgtcctgtttgggcccgcctacaagggtattccgctggccgtcgtgaccgcgattgcctaccacgagctgtacggcaaggaggtcaagtactgctgcgaccgcaaggaggccaaggaccacggtgccgacaagggtaacctgctgggctacgagccccaggatggcgaccgcgtgatcatggtcgaggacgtcaccaccagcggtaagtccatcgacgagacctatcccaaggtcaaggctgctgccgatgtcgagatcaagggcctcatcgtgtccctcaaccgcatggaggtcggcaagggcggcgtgaccaccgcgcagaaggagatcgaggccaagtacggcttccccgtcgcgagcatcgtctccatggccgaggtcgtcgagaccctctacaaccacgagattgacggcaaggtcgtcatcgatgacgagctcaagaccgccatcgacgcctactacgagcagtacggagtccgggagtaggtggttacgcggttctacgaaccgcgtaacagctcgacgctgcgcgggccgcatttggacaatctgacgttcaacttcaagggcgcgaccagaaggtcagcgccctttcgtttcacgtcaccttgtctcaaatgcgacccgctcgctcatatgacccaatccgctgtcaagagccacaatggccccgccgaccgcggtgggacctactccgtctcgcccggtcgagcgccgcgggccagggcgtcctggtattccttgactgccttgagcctctgcatcggcttcaatcgctcgaacatggtgttgccgtgaaggtgatcgatctcatgctgcaggcacacgcagaacaggtcgcccgttgcctcatagcgaatcaggttggcatccaagtcgtacgcctcaacgacaacgtgatcgggacgctcgatctcgcagctaatgcccggaatggacaggcagccctcgctaaacggcaccaggtgatcgctctgctcaacgatcacggggttgatgagcacatacgggtcgtagtcattcttgtcgctgtagtcgcagtcgatggtgacgagctgaatgagctcgccgatctgcggggcagccaggccgcaaccgccgttctcgaacatcatcttcttcatcttctcggcaagcgcctcgatcgccggagtgatctcctcgatgacggcgcactcctggcgcagacgagggtcgggcgacagtacgattccgttggcttccatggccatcctttcgggttgttacatcaaatcataggcgtcgacgtcaacgctcacgctcacgccgcgcacggagcccacctctttgagacaggcgtcgatatcatcagagacatggtaccctaccggcgacttcacaagcagatggaagcgataacggtccttggctctctcgattacacacgaagccggacccagcacctgcggcacggcactccccgcccgcaaatagtcgggcgcggcggcatgccagcggcgcttgaggagcttcgcgatgcggccgatgtagtcctgcgcgtcgtctcggttcgccgaccacaccaggatgttgaccaggcgcacgaacggcggatagagggcgtcgcgacgttggtccaggtcgtagtcggtaaagatcgagcggtcgtgctcggcgacggctcgaatgaccgggtcctcgggcaggtaggtctggatgatgacctcgccggggcgatcgccacgaccggcgcgacccgccacctgctccagcagatcgtaggcgcgctcccctgctctaaaatcgggcagcttaagggcaaagtcggcattgacgacgcccacgagcgtgacctcgggaaaatcgaggcctttggcgatcatctgggtgcccagcagcaccgcgcaatcggcggcgtcgaactgctcaagcagctttttatgcgcgtccttgccgcgcgtggaatcggcgtccatgcgaataatggcgacgtcatcgggcagcatctggcgcagcgcgtcctcgatctgctgcgtgcccaggcccatttttgccaggtagcggctaccgcacttggggcagcggctcgtgggtgccggatacggctgcacgcgccaggaagatccgcaggtatggcactgcagtgtgtgcgtgcgctcgtgatacgtgagcgccgtggagcagtgattgcaggtggggacgcagccgcactcgcggcacatcaggaacggcgcaaagccgcgacgattgtgcagcagcacggccttctcgcgacgctcgaccacgcgctcgaggccttccaacagcggttttgagaacatggagcggctgccgtgtgcgaactcacggcgcaggtcggcgattcggaccgtgggcaagaccgcgtgtccggggcgctcgggcatctcgacgcgcgtccaggtggcgccgttgtacgtgccgcggcggcaacgatcgagtgcctcggcagaaggcgtggccgagcccagcacaagaggacagcgatagcggcgcgccatctcggcagccacctcgcgcgcatggtagcgcgggctggacccctgcttgtagctggtctcgtgctcctcatcgataatgatgaggcccaggtcgctgagcgggcagaaaagcgccgaacgtgctccgacgaccacgcgggccgcaccgctcgcgaccatatcccactggtccagacgttcgccggccgaaaggcgcgaatggaagaccgcgaccgtctcgccaaaacgcgaacggaagcggccgacggtctgggccgtcagcgaaatctcgggcacgagcacgcaggccgaacggccggcggccaacacgcgctcgatggcggagaggtagacctcggttttgccggaaccagtgacgccatcgacgagcgccacgtcgccgtgggcatcgaggcgggcacgctcaatctgcgcgagcgcctgttgctggcctttcgtgagcgaaaccggtgccttgccgcttgccgaagacagcgtggtctgctcgctgcagccacgccacgcgcggcgctcctccaccaccacgacgccgcgtttttcgagtgccttgatagtcgccgacatgctgttgtagagcaggttaaggtcgcgcgtcgtgaccgggccgcactggagcgcctcgataagctggcgctggcgaacggcggtcttgggcggtgtatagtcgaagccctcgggcgtgagcatgacccaacggttttgaataggcttgacggcggggcgctcaaccgaccatgcgccgtcatcgcccttgaccacgcgcgggctaccgcccggaggcaaaaacaggcgcaggcactcggaaagcgtcgcgacatactcgcggctcatccagcgcgcgatgcgggcagcctcggcggtaaagagcggtttgctgaggatggcttcgacgggcttgatgcgcgaagggtcgagggcgttgttgccttgcaggtcaccaagctcggccgcaatatcgacgatgtagcctgcggcggcacgattgccaaagtggaccaggaccgtcgatccgacctgggcctcgttggcaagggactcagggatgccgtaagcaaacggttcggacagcgcacgggtggggatgtcgagaaccacgctcgtgtaggcggcgatgggctcaggcgcaggctcgggcttggccgaggcagcagcggatgccggtgccgccggagtctcctccggttccggcgaaccaaacagcgaaagttgctcggccatggccccagcacctcctatcccatgcgtctacagaaacaagagccccgctctgagtgaacggggctcggatacatacgtttgcgcagcgattacagcgccatcgcgcgggcgcggtcgatgcgcgccaggcagtcgtcgcggccgacgagcgccatggtctcgcccagcggagggctcaccatgttgccgcagacggcgacgcgcacagcctggaacaccacgcgcttcttgaggtccatctgctcgggcagcggctcaagcgcggcgtcgatgttggcggcggtccactcgtccacgccctcaagcgcggccttggcggcgtccagaatggcgcccatgccttccttggccaggcccttgttgacggacttctcgtcatactcgagcgtctcggccgtagcgaagatgggagcggcgacggtcacggcgtcggccggcatcttggtgcgcggcttgacgatggcggcaagcgcgtcgatccagtcctcgccatactcgacattaccttcgatgagacccgcctcgtgcagctcggggaccatgatctcgtcggcaaactgagcatcggacatgccattgatgtactcggcgttgacccagtcaagcttcttggggtcaaaggtcgccggattcttggagatgcggtcgagcgagaacttgctggccaggacatcgcgcgggatgatcgtggtctcgccgtcgagcgaccagccgagcagagccaggtagttgacgaaggcgtcggacaggtagccggcgtcgcggtactcctccaccgaggtggcgccgtggcgcttggagagcttcttgccgtcggcgcccaggatcatggagatgtgggcgaacgtgggcacaggcgcgccgagagcctcgtagaccatgacctgacgcggggtgttggacaggtggtcgtcgccgcggatgacatgggtgatcttcatcatggcgtcgtcgacgacggtcgcgaagttgtacgtgggcgtgccatcggagcggaagatgacaaagtcgtcgagctccttggcgtcgaaggtcacctcgccgtggacggcgtcgtggatgacgacgtcgccgcggtcctcgggcaccttgatgcgcaggacgtaggactccccagcctcgatgcggcggcgggcctcctcgggatcaagatcgcggcaacggcgctgatagccctggaaggggtccttgcgctcctgcgcggccttgcggtcggcgtcgagctgctccttggtgcagaagcagggatatgccttgccctcgtcccaaagcttctgagcggcctgcttgtacaggtccaggcgctcggtctgggcgtaggggccaaagtcaccgcccacctcgggaccctcgtcccagtccaggcccagccaacgcattgcgcgcaggatgatctgcgtgttctcgtcggtggagcgggtggggtcggtgtcgtcgatgcgcaggatgaacgtgccgccgtttgcacgggcgaaagcccagttatagatagcggtacgggcgccgccgatgtgcagcttgcccgtcggtgagggtgcaaagcggacgcgaacgtctgatgccatggaaatctcctcgattgcaggatggatgtctaactgcatcagtataaagcatcaaagcagcctccgcacaaagggcaccgacctactcattggggacagacttaaatgaccattctttgggcaacctgtcagcacttaggtaaggctggtcatttaagtctgtccccaatgagtaggtgcggaaagggtgtgaatgtttgatttacgcgctatgatgtgcccttgcatagagagcccggcggaatggtaacggtcgccgggacacgttattgaaaggacaatcatgtcagaagaacttcgttccatcccaccccaacacgggtcctttgtttttacgtcggagtcggtgaccgaaggtcatcccgataagatcgctgaccagatcagcgacgccgtcctcgacgcaatcctcgccaaagaaatagagctgcaggagcagggctacatcgcccccaacggcgtgcccgcgaacgtggagaacgtccgctgcgcctgcgagaccctcgtgaccaccggcaccgtcatcgtcgccggcgagattcgcacccaggcctacgtcgacgtacaggaaatcgcccgcagcgttatccgccgcattggctacaaccgtgccaagttcggttttgactgcgacacctgcggcgttatgagcctcatccacgagcagtcgcccgatatcgcccagggcgttgacgagtccttcgagacccagaccggcgctaccaccgacccgatcgacctgatcggtgccggcgaccagggcatgatgttcggttatgcctccaacgagaccaagaccctcatgcccatgccgcactacctggcaagccgcctggccgagcgcctggccgccgtgcgtcacgacggtaccctcgcctatctgcgtcccgacggcaagacccaggtcaccgtgcgctacgaggaaggcaagcccgtcgaggtcacgaccatcgtcatctccacgcagcacgccgccgagatcgaggacatgggcaagatcaaggccgacctcatcgagcacgtcatcaccccggtcatggctgccgagaacatgccgtgggacaacgcggacatctacgtgaaccccaccggtcgctttgtcgtgggcggccccatgggcgacacgggcctgaccggccgcaagatcatcgtcgacacctacggcggctacggccgtcacggcggcggtgcctttagcggcaaggactgcaccaaggtcgaccgctccgccgcgtatgccgcgcgttgggtcgccaagaacgtggtcgccgccggtctggccgaccgatgcgaagtcgagcttgcctacgccatcggcgtttccaagcccctctcaatcatggtcgacaccttcggtaccgcgcatgttgccgaggacaagatcgtcgaggccgtagagaagaccttcgacctgcgcccgggcgcaatcatccgcgacctagacctgcgtcgccccatctacgaaaagacggcagcctacggtcacttcggccgcgaagacgccgacttcacctgggagaaaaccgaccgagtcgaagaactcaaagcagcctgcggcctgtaagccaacggcaaaagctgcagccaaatatcgacgcatcaaaagaagtaccgcccccaaccggtacttcttttttatttaaacggtggtaaggatgcttcgatatgagcctacgctgcgtcaccagctaatgaattttgcagcacacgcgcctctaccatgtatccttagttccgagggctttggtatttggtcgatcgcgagttccgcacgagccggaggccacttaatgtggcctccgtgcgagcaggactgtccgagcaggcgaccaaataccaaagccctcgggacgacgggatagaacaggagcacccatggcaggcaagccacaaacactagctacgacctcggcattcgagatcttgggccccgtcatggtcggccccagctcatcgcacaccgccggcgccctgcgctgcgcccaagttgccgccagcctgctggaaggccgcatcaccaaagtcacctttggcctgtggaactccttcgcccaaacctaccgcggccacggcaccgatcgtgcgctcgtcgcgggcatcctgggcctcgacaccgatgacgagaacatcaagcaggccttcgacctcgcgcacgaacagggcctcgaatatcactttgacatcaagggcgacgacgcctccatccaccccaacaccgtcgacatcgacatggtcgacgacacgggcgcaacggcacaggtccgcggcgagagcctgggcggcggcaagatgcgcatcagccgcattaacggcgtcggcgtcgatatctcgggcatgtattccacgctctttgtggcgcacaaggacgttcccggcgtgctcgccgcgctcaccaacctgcttgcctacgcgcacgtgaacatcgccttctgccgcacctaccgcaccgaggtgggcggccaggcatattccgtctttgagactgatggcgctcccgacgataccgtcatccccatgctgcgcaagctcgacaatgtcgattacgccacgtttatcgagctcccgggctcggcctcgtcgctctcccccggcgtctcggccaaggagatcttcgacgacggcgaacagctgctcgatgcgtgcgccgagctcggcctgaatattggcgccgttatggccgtgcgcgaggcgcgtctaaccggcgagacccacgccgtcgccgccatgcgccgcgtgctcaatgtcatgcgcgaggagaccacggcccccatcgccaatccgcagcgatcgctcggcggacttatcggcggtgaggccaaactcgtcgatgccaccggccgcaacgacctgagctccagcttaatgggcgccgtgcagaccgacgccgtggcccgcgccatggccgtgctcgagcgctccgccaccatgggcgtcatcgtcgccgcccccacggccggctccgcgggcgtcgtccccggctgtgtgctggcgctcgccgaccacctgcaacttgatgacgaacaagtcatggacgccctctattgtgccgccgccatcggcctcaacctcaccacgagtgcctgcgtcgccggcgccgagggcggctgccaggccgaggtcggcagtgccgccgccatggctgccgccgcgctggtccagatgctgggcggcacacccgagcaggcgctcgacgccagctccatagcgctgagcaacctgttgggcctcgtttgcgatcccgtcggaggccttgtcgaggtgccctgtcaaaaccgcaatgccatcggcgtggcagcggcctttagctcggcacaactcgccctcgcaggcattaagagcctggtgccgtttgaccaaatggcacatgtcatgctctcggtgggtcacgcgttgccggccacgctgcgcgagacggcaaagggcggcatcgcgcaggctccggctgcactttcggcctgtgcaaaatgcggtgtgtgcggataacggcaaagaacgactcaaaggtgggacaaatgtcccacctcttttgaatgccaccgtttccgtaccacaaacagcagggcaatcgctataatgcaagcccagtaaaaacacgatgagccataaggcgaaattcgaaggatatgcatacgatgtcgcaaaacgatcgaactcaactgattcccgatccgcagcagccgagcaggcacaccggtggcgttcagtcgccgcgtcctatcgcgccgagccacggtcagcagcgtagtgcagcaaacgcttcccaacgcccgaaccaacagcgacagcagcgtcaacaacgtcagcagcgccaggcaaacggcaatgcgcccaagcagccccccacgcacgctcgaggcgatcgtggccccgcgcacaaacccgccgagaacaataagtcgggcaaaaagacgacgctctttgtcgtcctgggtctaatcgtcattgtctatatcgtaggcgtcgtagcattttcgcaggtagcctaccccaaaaccaccatcgtcggcgtcgacgtctcgttctccaacgcttcgtctgccgccaccaaggtcaattcggcatggaagcactataagctcaccgtgacaggcgatgactttaactggacctatcagcccgagtccgatgagcccatcgtcgacggagaggctgccgcaaaagagatcatcagccacaacgaagcctttatatggccggtccgccttgtggaatccttaagcggcaaaaccaaaacaaccgctacctccaacgaagtcgatcttgatcaagacgtcgacctgtcaatgctctccgacacctttgaccaaaagaaatttgagaaggatctgggcgccgccattgaagagtttaacgagggccgttcgggcacgttcgaggccaatagctcctatgacgagcaggccggcaagtttaccgtcgagaaggcgcgctccaacgaaaaactcaaccgcgagcatgtcattaagtatgccgagctcgagcttgcctcgctggccgagtccgtagatctttccaagctcggcaacgatgcctatgagccgctcaatggaacgctgaccgatgatcagattcaggccgcatgcgatgccgccaacaacttcctaggcgtcaacgtgaccctcaagctcaacggcgaggatgccggcaaggttgatggcagctccgtattgcagtggatcagctttgccgatccggccagccccacgctcgatacgtcacagatcagcagctgggcagccgagctcgctaacggctttaataccgtgggctccactcgctggtggacgcgcgccgatggcaagcagtgcgccgtcgaaggcggtgactttggttggtccatcgacagcagctcgctcgccaagcaggtcgaggacgccattaacaacaagcagaccggagaaatcgagatcaagtactcccagaaggccgacacctttaccgcaaagggagagcccgactggaaggcgtatatcgacgtagatctgtccgagcagcacgcgcgctactacgacgagaacggcaatatcgtgtgggaggccaactttatttccggcaaaccgggcgaagacgccacccccgagggcgtgtggcagatcaacagcaacgacggcggcagcaccctgatcggagccaaggaccccgagaccggcaagcccaaatacgagagcccggtgagctactggatgccgtttgagggcaatatgatcggcttccacgacgccacctggcaaaacgacaagagcttcgataatgccgagtcgtacaagtggtgcggcagccacggttgcatcaacctgcgcctgacagacgccaaggcacttcacgactgcatcaaagtcggcctgtgcgtggttgtccactcgtagtgcaacgcgcacattcctacaacatggagctgctgcgaccaatctaacagttccgaaagaaaccgtcccatgcgcccgccccaaccggtgggcgcatatactaatcgaggtactttctataaaggagacgctatgccgaatgtccccacgaccaccccgggcccggatgataccgagcacacgcccgaaggtgtcaccgaaacgattcctctgattacaaacgcacatgccgacaaacagagcggacgcgcgaacgatgcgaccgagatttccgatgaagaggcatatgccaagctcaaggcaaagcgtgccgaacgtcgacgcaaaaagctgattcgtcgcggtattgccgccggcgtcgtgggttccatcgcgctcattgccattgtcgcaaccctggttatcaatgcgcagccacagggcgctagtgggcctgtgaccgacatggtgaccgagggcgcgtttaccacaacggtcgaggcgaaaggccagctcaaacccattacgtcctcagtggtctccccttctgtcgacggtacggtcgattcgatcaacgtgcaggcaggccaatccgtcaacgagggcgacgtgcttatgaccatcaaaaacgacgagctcgaccgcaacgttgccgaggcgcagcgtgcagttgcagccgcccaggaagacctcaccaacgcacagaaagccgccgctgccgcgcaggccaccccaacgacggacgtcgatggagcttccgcagcggctggcgtctccgccgcatcagcggacacgaacgtcgtatcggccgcgcagcgcagcctcgcttcggcccaggcaaacctcgatcaggcgaatgccaaggcagccagccgtacggtcacggccccgagctcgggtagcatcgtggagctcaacgccaaggtgggcgccacggtaacaggcggcatgatcatgggcgaaagcgacacgagcggcggcaagcagtgcatgcagatcgccgacctgtccaaaatgaaggtgaccgtgcaggtgggcgaaaaggacatcgccaagatcgccgttgggcagagcgccaacgtcacgtatcccgcgtttcccgatatcgtgagccagggcaccgtcacggctatcgcgtcggtggcaaactccgacgccgccaacggtggcggcggcagcgtaacctttaacgtcgacatcctcatcgaggcgcccgacgcgcgcctgaagccgggcatgacggccgaggtatcggtggtgaccgagcagctcaacgacgtggtgatggtgccgacgatggcgctcatgactgaagacggcgaacactattacgtcaacgtggcgactgatgacgagggtaagcaaacccgtcgcgtgaaggtggccgtcgtgacgcaaaacgacaacgaagccgtagtcggcaagacacaggtcaagcgcgacgaccagggcaacgagatcaaccccaacgtgccggttaccaagctgcgcgatggcgacaccctcgtcatggacaccggagcgaacgcaacggctgacggcggctacagcgcggattcgggcagtatgtctgacgatgagggcatgtaatgcgtcccgttatcgacatccgcaacgtacaccgcatctttgagagcgaggcggcttgcgcccacatcctgcacaacgtgagcctagcggtagaacccggcgaattcgtcgctatcaccggcccctcgggctcgggcaaatcaacgctcatgaacatcctaggctgcctggacaaaccgacggcgggcgactactacctgcaagggctcaacgtggccgagctcgacgatgacgagctcaccgaagtccgcgccctgagcattggctttgtctttcagagcttcaacctgctgccgcgcctgtcggttatcgaaaacgtgatgctgccgctggcctacaccaatgtgccccgtagccagcgcgagatgcgcgccgtgcacgcgctgcaggccgtcatgctgcccgtcgaccactgggaccaccgcatatccgagctctcgggcggccagatgcagcgtgtcgcaatcgcgcgcgccctcgtcaatgacccgcccatcatcctagccgatgagccgacgggaaacctggactccgctaccggagcgcttgtgatggagaccttccataagctccagaagcgcggcaaaaccatcgcgcttatcacacacgaccccggcatcgccgccgaggccgaccgtgccgtgaccatccgcgacggtcgcattcacgacggcgcgtatattccacatgcaccgcggaccctacgcagcaccgtagatagcctgcccatgatttccgcctccgccaacccgccgaaaggagagatggcatgagcgcccgcgatctcatccaggaatcccttcactcgctcgaggccaacaaggggcgcagcctgctcaccatcctgggcattgtcatcggcatcgcctcggttatcgccatgacttcgctcatcggcggcatccaaaacagcctggtcaacagcctgggcctcaatgcggcacgcatggtgcaaatctattcgtcgcaagaactcaccgagtcggacatcgagaagcttcaaaaactggtgccgcagatagagcagatcggcattgtcgacagcgcgtataccgagtacaagaccggcgataaaagctataccgtcatggcgcagggcgtcgatagcgacatgctcgacgccgtgggggccagcaagctcgttgcggggcgcacctattcccaggccgagtcccaatcaggctcgcgcgtggcgctcatcagccgcaacggtgccgatcagctttacggcaacgaacaggatgcgctggggaaaaccatcaaggtttccaacggcgaggtgcagattgtaggcgtgattgatggcggcagcgactccatgggctcgctcacgttgtatatgccacgcgaaaccatctcaggcctgtttggcgacgagaatccctcattccccagcgtgacggcacttgccgccgagggcacggacatggatgagctctgtaagaccatcgagtccaaggtgcgcgcgatgaagggcatcacggaggatgatgagtacgacagtgtatcggcgacctccatgaaaagcgctatcgatgcactcaactcctttatgggcgcgttctcgctcatcatgggtgctgtcgccagcatctcgctgcttgtcggcggtatcggcattatgaatatgatgcttaccaacgtgaccgagcgcattcgcgagatcggcatccgccgcgctctgggcgccagtcgtcgcgatatcaccgcgcagtttttggccgagtcctcggcgctgtgcgtcaccggcggactgttgggtgtcctgattggctatctgctggcatggggtctcacgttctttgccgcaagctcgggcatcatgagcgagtttggagctaccgggacgatcacgccaagcttctccattacgacagtgttgagcgcgtttgccgtatcggtcggcatcggcgtaatctttggcttctatcccgctcgccgcgcagcaaagctcgacccggtggagtgcctacgctaccagtaagccaccaccaacaagttgcggtgaattagggactgaatatgctatctagcagcaaaaacagacactatttcaccgcaacttattgaagggctgcttgcgccagttccggcgtcgtcctcgagctattggcggatgacggtcttgtacggttcgagcttgctcgaggcgctcctcctcgcgggcgggagggcgcgcaggcgcggcgagcgcctagcgcgcgaactcccgtaagagcgcgtcttccacttcccgaagcgaaagggccccgcctccctcggcgggacgggcgaccacgatacagcgcgctcccacgtcgcgcgcggaggcgatcttctcggccgtgccgcctacggttcccgagtccttggtcacaagccactgggcgcccacctgccgaagcatcgcctcgttgagctcgcgagtgaagggcccctgcatgccgatgacgtgcgacggcgaaaaccccgcgtcgatgcacttcgttatagcaccgggcagcgggagcacacgcacgaagaagcgctccgcgaaatcggcgacgcgcgtgtagggagcaagcgccttgctccccgtcgtgagaagcgcgcgacccgggttctcggagagaaagcgcgccgcgcaggcgatcgacgcgaccgagacgacgcctttgggcagcgcctcgaccgggcgcgtaaggcgcaggcatcgtgcacccacggcgagcgaagcggcccggatgttgccgcttgcgagcgtagcgaaggggtgcgtggcgtcgacgacgatgcgcgcgccggaaagctcgcgctccatgtcggcctcgtcgagcctgcccgcatgcacctcgatgcccggaagctcgcccaaaagctcacctccgtactcggttgccgcgtaggcacgggcggggatgcccgccccgctcgcccattcgcacagaaggcggccctcggtggtgccggcgaagatgcgcagcgccggcgcggatgcgggcgccgtcacttcgggccgcctgggcgcgtgatctcgtagagcagcgcgttcataatggcggccgccacggtcgagccgcccttgcgacccctcgcgacgatggccggcacgcgtcgcgcgagtagctcctctttcgcctcgaccacgttcacaaacccaaccggcaccccaacgacgagcgcgggcgcgatcttccccgcgtccatgagctcggcgaggcgcagaagtgctgtgggagcgttgccgacggccacgatgagcggaccctcgatgccgcaagctttgtccatgctcgcaacggcgcgagtcgtgcccgcggcgcgcgccgttgcggcgacatccgggtcggccatgtagcacacggcctggcagccgatcttcgcgagcgcgggcttgcttatgcctgcgagcgccatgttcgtgtcggtgagcaccgtggcccctgcgcgcagtgcgtcgagcgcacagtgcgcggcgtcatgggtgaacacgagggaatcggcgtacgagaagtcggcagtggtgtggatgacgcgcttcacgacgggctcttcgagcggcgggaacgtgcggccgccaagctcttcggtgatgatctcgaagctgcgccgctcgatgtcgccgggcgccatctccttggaatccatctagtactccactccttcccttgcacatatcccctgagagtaggggtgtttctcgcaccgcatctcggttatgtagtcggccttctccacgatcttgcgggaaggcgcgcgcccggtgagcgctacttcgacgccgcgcgcggacatatcgagcgcgcggtccacgagcgcctcgtcgacaagccccttcgaaagcgcgtcgagcgcctcgtcgagcacgagcagcccctcctgcgcgccctcgagctcggcgagcgcggaagcgaggttcccatcgtgcagctcgcgcgtcgcggcaagttcttccgacgtcatcgaccaggcaaacttgtccgacgccttccccgcgaacacgggcacgccgaaatgctcggcgagtaggcgcacctccccgctttcgccgtctttcaggaactgcacgacgacgacgcggcggcctgcggcgagcatgcgaagggcgaggcccatcgccgccgtggtcttgcctttgccgtcgccatgatacacatggatcatacgccctcctcgataatgcggtagacatactccatgtcgagcgccccgcgcacggagtcggccaggcggtcgaactcgcacgcacggtgatcggccgcggacaccgcgccctcagcacccacgacgctctcgggcaggccgcgcatgcgcgcgagcgagcgtgcgagggcgagcgccactcccggttcgtcgaacaggccgtggagataggttccgaacacgtttccgcaggccgctccttctggtttgccgccaatcgtgcccgcaggggcgcaggagacggtcgtttcgccgtcgtgaatctcgtacccgcgcgccgtcatgccgttccacaccgagaacgcgccttgggcgcccgtgatgcgcagctccgactgggcgaggcgcttttcctccttgaacaccgtacttgcagggatgagcccgagcccgcgcgcggtgccagcgccttccctgccgtgcgggtcggaaagctcgtctcccaaaagctggtagcctccgcatatgccgagcaccggcgtgcccgcgcccgaaagcgcgcgtacacaggctccgatgccgctagccgcaagccagcgcgcgtcgtcgagcgtggtcttcgagccggggagcaccaccaggtcgggccggcccagatcggtcgtcgaggaaacgtagcgcacgcccacgccgggcacgcgcgaaagcgggtcgaagtcggtgaagttcgacagatgcggaaggcgcacgacggcgacgtcgatgaccccgcgcgcctcgcgggcagacaggcgcggcgcgagcgagtcctcgtcgtccaggtcgagcgtaagatacggcacgactcccacgacgggaaccccgcacatcttctcgagcggggccaaacccgggcgcaggatttccacatcgccgcggaacttgttcaccacaagcccccgcaaaagcgcgcggtcctcgggcgcaaggagcgcgaccgtgccgtagagctgggcaaacaccccgcctgggtcgatgtcgcccgcgagcagcacgggggaggacacggtgcgcgcaagccccatgttgacgatgtcgttttcagcaaggttgatttcgacggggctgccggcgccctcgatgacgataaggtcgttttcctccgcgagcgaatcgaacgcctccaaaatctgcggcatgagcgccttctttcgcgcgaagtagtccctcgcagcgaaggctccctgcgccttgccggccacgatgagctggcttcggtggtcgctttcgggcttgagcaggatggggttcatgcgcacgtcgggcgcgatgccgcacgcctcggcctgcataatctgggcgcgccccatctcgagcccgtcggccgtgacaccgctgttgagcgccatgttctggctcttgaagggagccacgcgcaggccgtcctgcgaaagcacgcggcacagccccgccgcaagcaggctcttccccgcgttcgacatggtgccctggatcatgatgggcttcgccctacccacgggtatcgacctccttcgccgggcctcggccatccgcgcccgccatagcgccgctgcaagaagcgccgccccgttcgacgggttcgccttcgcccgatgcgccttccgcccgaagcgcgcggctgaacgccatcgcaagccgggcattctccttgcgcgtgcgcaccgcgacgcggcaccagaaacgggacagtaccgaaaacgagtcgcacgtgcgaaccaaaaccccctgtttatacaggcgctcggggatgtctttcgccggcgtgcggactaaaaggaagttcgcatccgacggcacgacggaaagcccgagcgaggagagctcgtgggaaagccacgctcgctcgcccgccaatacatcgcgcgtgcgcgagacgtattcgacgtcttccagggcggcgatgcccgcggcctcggcgaccgaggagacgggccacgcctgccccgcccggcgaatcccctcgatgagttgggtgtttccgctgatcagatatcccaaccgcaaccccgccattccgtagagcttggtgaacgcggagagcacggccacatggcgcgaacacgcggcgcgtgcggccacgctcctttcgcgggcgtcgggcgcaaatccgaggaagcactcgtccacgacgagcagcgcgcccacctgctcgcagcggcatgccgcggcatcgatcacgcgggggtcgacgaggcgccccgtcgggttgttcggattgcagaggtacgccacgtctcccggtccctcgatcgcgcgggcgaaggagacgggcacgtcgaagtcgtccgcttcggagagcgggaactcctgcacgcatgcgccgtagtacgatgccgcctccgcatattcagagaacgtcggcgcgcacacgacgatgcgtttcgggcgcaccgccgcagcgagccgccagatgatgtcggacgcgcccgcgccgcagacgatagtatcttcgggaatgccctgggcgcgcgctagggcgcgaacgagggcgaggctttccctatcgggataggcgtcgattcgagaaagcgccttgcaagctgcggcgagggcgcgcggcgaggggcctgccggattcacgttcaccgagaagtcaatgaggtcggaggcgcccccttcgcaaccgatgccgagcgattgcgcgctgcccccatgcgtacgggcgcgcaggattcccccggcagcccggagcgcggcgtggtctttcctcatgccatcgcccccacggcgagcacgaccgccgcgcgcgcggcgccgaagacgacgagcgcgcatacggacgcggcgagcatgagccttgtcgcccgggcgatgtcgccccactcgatttcgcgggacgcgtcgcctatcgtcggtttctcaacgagcttgccgaaatacaccgcgggtcctgccaagcgcagcccgagcgcgcccgcgcacgctgactcggtctgcgccgcgttcgggctcgcatggcgacgcctgtcgcggcgccagatgcgcgccgccccgcgcgcgtcgagcccgaggatcgggcacacggcgatcatgagcagggccgataagcgcgagggaatccagttcaccgcatcgtcgaggcgcgccgaggcgcagccgaagtcgatgtagcgctcgtttttgtagcccaccatgctgtcgagcgtgttcaccgccttgtacgccatgcccaagggcgcacccccgatcataaggtagaaaagcggcgcgatgacaccgtcgctcgcgttctccgccaccgtttccacggcggcgcgcgcgacgccctgctcgtcgagaacagacgtgtcgcgtcccacgatgagcccgacggcttcgcgcgccgcgacaaggccgcccttcgagaacgcgcgggccacggccaggctctggcggcgcagctcgcatgtcgcgagaatctgatagctcgcccatgcctcgaccacgaagcgcaagccggagtgaaccatgccacaaagatgtaggataccccaggtcaaaagcccacacgcaagcggaagtgccacggcgagcacaagccctgcggcacgcgtgcccgcggacgtttgcgggaatgcgtgccgcaggcggccttcggcccacgtgatcgcgcgccccatggcgacgacgggatggggaagccagcgcgggtcgccgaaggcaaggtcggccgcgaacccggcggcgacggcaagaattgtcatcaccgggcatcgccccccgaagcggggcgaacgtcgcgaaggcagcgcccatcccaggtggcggcccatgcgccgcccggctcggtatgcacgtcgaaatatcccattttcgggacagctagctcggagagcagcgctttcacggtacccgcgtgaacgacgaagacggcgcgcccactcccctgggcgcgctccgattcgcacgcctcccgaaacgccgcgatgacgcggcgggtgaaatcgctcttgccctcgccatgcgggcagcacgtctcgcaccaggagtctacccaggcgcggtagcgcgcatcctctttaagctcggcggcgcttcgcccctcgaagtcgccgaaatccatctcgcgcagaccggggcacgccattagctccgcgttcgggaagaggatgcgcgccgtctggtcggtgcgggccatgccgctcgtgatagcacggaatacgtcacgatcgcacgcgaggtcgcgcaaagcgcgctcgcccgcgctcgacaggggctcgtcggtgcccgccccgctgtagcgatgatcttccgtgcccgccgtggcaccatggcgcacgaaaacgacttccaaaggcgcgcccacgccctgcgtccctcgaggcgcatcgtcaaggtttcctttgatgacctggggtatcccgcacgtcatgcgcacgacgacgtcggcgcgcgcagcgagcgcgcatcccaggcgccccgcgcgctcgcgccattgggcgtcttccgcgcgcatggggacgacccccgagccgaccaagggcagaatcacagcgtcgaagccaatcagccgctcgagcgcccggtcagcgtcgagcgcgcgtacgagttcctcagcacggtacgcgacacggccggcaaaagccgctggcacgccgccctccgcaagctgcgccgcgtcgacgaaatcgtccgccgcgaacccgagcttttcgcgcacgaaggtcctcttccccgaatgcgcgccacctaccacgagaatcataggagcatgccccccgccaccagcatggcaagcatcgcgagctcggcccattgcagaaaccatccggccaaatcacccgtcaccccgccgaagcgggacagggcaacatggcggtaccacgcgagcaccaaaagccccgccaccgctataagggcgccgacggcctgagcgcacgcgaccatccctgcagccgaagcagcagcgaaagcgcaaagcggcacgacgatctccgcgcgcttcttcgcaggcgagagccccgcggccatgccgtccgcccgcgcggcaggccagcattctacggcgagccccgaaagcgcgcgggagaacacgagcgagcacagaagcgcgaggaacgcccccgccgtaagcggcagcgcggtgaacagggaaaactgcagaataaggtacacaacaacaccgatgaccccaaaggcgcccgcccgcgggtcgtgcatgatctcgagctttcgctcgcgcggggcccaacttgcaagcgcatcggaggtgtcgcagagcccgtctaggtggatgcctcccgtcaccgccacaggcagcgccacgagcacggccgcgacgatggtcgcgggcacgccgagcaggttcgcaacgtgtccccacgccgtcatgaggaagccttccgcaaggcccaccaggggaaacgcggcaagcgcatgggttgacccgaaatcggtccaggccgatttcgggacggggatgcgcgagaacgttccgaacgccgcgccgattgcctctgctatcttcaccttgtaggtccttcgcctttcatccacacgggaatcccgcataccacttcgactgcgcggtcggccagcgccgccacgcccgcgttcacgcgcgcgagcgcgcgcctccatgcctcggtcccctcatcgtagcgtatcccatcggcgaacacgtcgacggtgaccaccaccgtatactcagcggcctgagcgagccgttcgatgcctccgagcacctcgcgcgccgcaacgtcggggtcacgtggggataagccgccttccgcgaagagttcgttcgcaaccaggttgcccacgtcctccaaaagaagcgtgcagccgcgcggaagcccgggcactgcggcgcacacgtcacgcgtgcgctcgagggtggaaaaccccttgccctcgcgcatcgcccgatggcgcgcgatgcggcgggcgccctcttccccgaagggctccatcgttgccaggtacacgcgggggccgtcgtgcccgaggcacagggactcggcgtaggcgctcttgccgctcgcggcggcgccgatgacgagcgtcaccgtcatttcccggcctcgaaatgctcgtaagcagccatgccagtcgccgtgaacgtcttcccatcccggtacacgcgcagcgccgaatccagaaggggcagatacgccatggcgcccgcgccctcgcccaagtgcatgcctgcgtcgaggggtgcctttattccgagctcgcgaaggagctcctggcttgcgggttcgcttgatgcgtgggtgcccacgaggtagcccaaggcgttggggcacaggcgcgccgcgcacagggccgccgtgcaggatatgaccccgtcgaggagcgccggagccttcgaggccgcggcccccaggtagaagccgcacatcgccgcgatgtcgaagccgcccaccttcgagagcacgtcgatcgggtcggcaggatcgggcgagttcgcatcgatagcgcgctcgaccacgtcgcgcttgcgcgcgagcgaggcgtccgagagccccgcgccgcgcccgacgaggctccgcgcgtccgcccggatgagcactgcggccaccgccgccgaggtggtcgtgttgccgatgcccatctcgcccgcggcgagaaggcgcacgccggcacgggcaagtccgcacgcgacggcgattccgacctcgatcgcgcgcacggccccatcgcgagacatagcggagccgtgcgcgatgttgccgctcccccgccgcacgttcgcgcgcaccatgcgcgcgtcttctatgccccgggccatacccacgtcgacgggcacgacctcggcacccgcgaacgccgccatgcggcaggcgctcgtggccccctcgcacatgttgcgtgcgacggctcgcgtcacgtcttgcccgctttgcgacacgccttcggcaacgaccccgttgtcggagaagaataccgcgagcgcacggggaaactcggcaacctcggcgctcccctgagctgcggcgatacacgcgacggcgtcttcaaagtcgcccaatccccccaaggggtgcgcgatggagtcccacgcggcgtacgcggcggcgcgggcgcactcgtctgcgggcgcgatccgggagagcgcggcttcgagcacggcgcccggcgccgacgagaacgcgcgctcgacttcctcgcggatacaggcaagcgcggtttcggttgcttcagccatgccgtctcctctctgcgaacgacgctgcggcagacgcgaacgcgcgcgcaacgtcggggttcgcaggatagtacacatgcgggaagcccgcaaccagggacggggtggtcgtcatgcacggccagcccttgtcgcgccggggcttctgcgcccagaagtcgccgcccgggcaggtggactgccagtagtggaactcgtgcgcgaggatgcgtgtgccgcgcggcccgtagagtccgtcgcgttgggaagtgagctccacgtacccgaaatgggacagccttcccccgttctcgcttgcgccctcaagggcgcccgcaacaggccagcgccgcccctcgctatcgacgatttcgcgctgcaggtacagaaacccaccgcattcggcgaccgtcggcatgccggattccaccgcgcgccgcaccgcctcgcgcatcggcgcgttctcggagagctgccgcgcatggagctccgggtagccgcctcccagatagagggcgcttgtcccccggggcaactcgctatcacacagggggctgaaaaaggccagctcgcaacccaggtcctcgagcgcgcgcaggttctcctcgtagtagaacgagaacgcctcgtcacgcgcgacggcgacgatgggccgcgctcccgcgatcggctccaaccggtaaggttcctcgcggatatcgggtgccgtcgccgctatttcgagcaagcggtcgacgtcgacgctcttttccaccagctcggccatcttgtcgatgcgcgcggagagctgcttgacctcgtcggcggtcacaagccccagatgccggctttcgagcgagaacgcctcgtcggcgggaatattacccaaaaccgcgacgcccgtgtgcttctcgatcgcaggcgccgcgtaggcgcaggcagcggcgctcgtcttgttcagcacgacgccgcgcacgttcgcacaaggcaggaactcggcgatgccgcggattacggcggcgagcgataaagacgccccacgcccgttcaccactaaaacgaccggcgtttccgtatcgcgcgcaacctggtagctgctcgcgtcggccacgccgggcgccatgccgtcgtagaagcccatgaccccctcgagcaccgcgacatccgcgcccgcggcgccgcgtgcgagcagggcgcgcagcgtcggggcgtcggtgaagaagccgtctaagttgcccgagcgcgtgcccacgacgcggcgatggaagagcggatcaatgtagtcggggccgcatttgaaggccgcgcatgcgaggccgcggcgcgcgagcgcgcgcaggagcgcacacgttacgaccgtcttgccgctcccactcgagggcgcagcgaccatgaagcgcgggatggacgtgctcaccgggcgccgccttccccacctgcaccacgcgcactgacgaggaacacggggttttgcgccttcataagatggtgcgagcctacagcctcggcgcgggcggccgacacctggcacgcctcgaaccccttaaagcgcgaacccgagaggagcgtgcacgcctcggtgagcgtctcaacggtgacgcatggcacgcacaggcgaacctgcgagttcttctcgagcgccgcctccacgatggagggaagctcgcccgcgctcccgccgacgaacacggcgtcggggacgggcagtttcacgagcgcatcgggggcgacaccggggaccgcatgcacgttgccgcacccgaatgcatccacgttctctcggatgagccgcacgccggccgcgttgcgctccaccgcccataccgagcccgctcgcgcgacgagcgccgcctcgatcgacacgctccccgtgccggcgccgacgtcccacacggtgtcggtcgcggtaaggcgcagcttcgcgagcgcgacggcgcgcacctcctgcttggtcatgggaacgtcgccgcggatgaagagctcgtcgggaatgcccgaggaagcgtacggccagcgggagctcgcggcgccgcctgcgaaatcgataagcatcacgttcaagtcgtcgaacgtctgacctgtgatttcacttgcggtcgcgcaggtgatgcgctcgtcggggtacgacaggcgctcggccaccgtcacgcacgcgtccccgaagcccgcctgcacaagctcgcccgaaagccgcgagggatcttccccgcccgacgtgacgaggaagagctcacctgcgcgctcggcctcggccacgatatcgcacgccacgccgtgagcgctcgcgaagcgccaatcctgccatggacgcgcgaggcgcgcggcgagatacgacgctgagcttatgccgggaatgacgcgcacgtccacctgcgcgtcgccggagagcgcctccaccagacggcgcgcgccgctgaacagccccacatcgcccgtcatcacgaccacggcacgctgccacgacgccgcatcggtgagcgcggcgacgatgtccgccgtcttcacgagctcgcatctcaccacgtgtggcggcacgtcgatgccgacaagcgcgcgatgagcgccgatgaccacgtcggcgatgtcgatcgcgtcgagcgccgcgcgcgagagcaagtcggggtttccgggccccgccccgatgatcgttacctttcgcatggaatctcccgatacccgcgcggcgtgaccatacggccgcctacgcgcttcgtgcccgcgttgccgacgaatacggtggtgaacatgtcggcatcaagctcccccagctcggagagcctgcacatgcccgactgctgcccctcgcgcccgatgttgcgtacccagccgcagagcgtgtcgggggccttccattcgagcataatcttcgccgcgcgcgagagcctgtcggcgcgctttctgctgcgcgggttgtacaaacagatgcagaagtcggcgctcgccacggcggcgagcctgcgctcgatgacctcccacggcgtgagcagatcggaaagcgacacgaccgcgaagtcgtgggcaagcggggcgccgagcacagccgacccgctctgagccgcggtggccccggcgataacttccacgtctacatcggggtagtcctccgcaagctccagcacggggctcgccatgccgtacacgcccgcgtcaccgctgcacacgagcgccacggcttctccactctgcgcacgcgaaagcgccaggcggcaccgttcgacctcgtgcatcatcggcgtcgcgagatgcgccgcgtcgggcacagcggcgagcgcgagctccacgtatttcgtgtaccccacaacgatgtcggccgcctcgagcgcgcgccgagccgcaatcgtcatgccgtcgaggccgcccgggccgatccccaccacgaagagctttcccatcaccgctccttaaacgaaagttcgatagttaccttggaaaacgcgacggtaacgccgccgtgagcgagcttcgggaaggtaagtttgcccccgtccgcgagcgccgcgcgctcgcacacgttgtcgacccccaccgtcgcgcgtacaaaatcagatggcgaaacactgccttcgacctgcgacaactcctctgcggaatacgtcgcaagcgggatattgcgcgagcggcagaaggcgagcagaccctcctcgtgcgccttcacgtcgatcgtcgccacctcgcgcacggccgaaggcgagatacccgccagcccgcacgcgagaagaaacgcctccccgatcgcttcggcgcacgcaccgcgacggcaccctatgcccgcaacgatgcagggcacgacaaggcgaagcggctcgggcgcaggcgcctgcgcccgcacgcccgccggcttccccgtctcaccggcgggcacgacctcgcccgttgtctccgccgcgcgaacggacgcacctgcattcgcgcccgcgaacggcgacacgacgatatcggcccgagcgcggtcggacgcaatgtcaaccccctcaggcggctgtcccgaaatcggcatgtcggaatagagcgccacgcgcccgcccgaaagcagccgcgccgacactcgcttgatggcctcgggattcgaaacggcgagccccgcacggcgcgcccacgtatccaccgcccacacgccgcggacgtcggtcgccgtggtgatgacggggatggcccctgccacgcgtgccacagtttgcgaaagctcgttcgcaccgcccaaatgccccgacaaaagcgggacggcaaagcgccccgcatcgtcgatcaccacaaccgcggaatcgtttgccttcgaggcgacatgtggcgcgatcgcccgcacggcgatgcccgccgcgcccacgaacaggagcgcgtccgacgcttcccacgcgtgcgccgtccatgcgcgcaggtcggccttcccctcgccgaacccgcgcgaaacggaaacgtcccagccagggtcatcttcacctgtctgcgcgcaatcggaaagcgcgtgtgcggtgcgctccgccaacgcataccccctctcagtgaacgctatgcaggaaaccctcatctagcgcaccaccatcgtcgagaagtagctgccccgatcgggcacatcgtcgagcgagcggtacacgcgctcgcccggaagcccacagtcctctactagctcggcaccgtcgaaggcgccctcctcgcgaaggatgcgcttcgtatccgcaagcgagcggcgcgccttcatgaccaccttcgtccccggccagccgattgcgcggtgcacgtcatcgtagccgccggatacgatgtgcagaggcgacgacatctcgggcgtgaggtcgcgctcgagcgccgcggcgaccgcgcagaagctcggcacgccgggaatagcgcgcgcctcgaacccgcgggcgcgcacgtcgggcgctatgcgctggaaggtggcgtagatgctcgggtcccccaggttcagcagcgcgacgtcgcggaccgcatccaggtgcgcgacaagctcgcgaacaagcgaggcatgctcggccgcgcggcgctcggcgtcgcgcgtcatcgagaatcgcacgggaatcaccgtcttgcctgtaaggtcgacggcgccgcgcacgatctcgagcgcgaccatgaccccgtccgccgtctgcggtgcggcgatgaccggacacgattcgattgtgcggacggccttgatcgtgagcagctcggggtcgccaggccccgtgcccaccccgtacagcacgcctttactcatacgtcgcccccaatttcccgataactgcatcggcgcccgacgtgcggaaaagctcgcggcgctcggcgtcgaacacgaccgcggcgatgtcgcatgcgcccgccgcgcggcggcgcaacctgtcctcgattgccgcagcgagcgaggcgcgcgcagcgtcccccacgccggcggcctcgattacctcgagcgccgctgtggtcgtgaccgacgacatgatctcacgcacggtcttcgcgcccgcgccggccaaggccgcgtgggcggccagaatctccgcgcggcagtcagcggtacgcgaatgagtgtccatgattccgcccgcgaccttcaccagcttaccgatgtgtcccacaagaaggacattggtgaatccctcgcgaacgcagcaatcaatcgcatcgcccacaaagttggagatgaagaccaccggcgcaccgtttaggtggaaatgccccgagatgaactgcgcgccgtagttgccgggcgtgagcacgactccgcgccgccccatagccgcatgttgccggatctcgagctcgatgctgtcgcgcaaggcagcgaggctgcgcggctcgacgatgcccgtcgttcccaggatggagatgccgtcctctatccccaggtgcgggttgaaggtcttttcggcaagggccacaccctcgggtaccgaaatcgtcacagcaatgtttccagaaaagccgtgcgcggcgcacacctcacgcaccgccgaagtaatcatcgcgcgcggcgtcgcgttgatggcggccgcccccaccggctgctcgagcccgggcaacgtcacgcgccccacgcccacgccgccatcgacggaaacttccgattcgtgcgcgggcacgtccttgctgcccgcagtacccgtgtccgaccccgcatgttccacgcgcgcgtacacgagcacgccgtcggtcacatcggcatcgtcgcctgcgtcctttcgcacggcgcactgggcgcacccctcgccgatgcatgcgtcgaccacgttcgcctcgacgggcagcccgccgggggtgacgatcgacacgcggccgacgggctttcgtgacaagagcatctcgcaggccgccttcgccgccagcgcggcacagctccccgtggtgtagccacagcgcaggcgggtcgtcccggtatatatgtagtgctcgaaggccacgctagctactcgccttccgataccccgtggcaaacgaagggtcgtaaagcttgctgcgctcgtacgaccccgcttgcgcaccgttgtgcgcaagcccgccgcgagctccgagcacgcggcccaccaccacgagcgccgtgcggtcgatgccctctcgcgcgcccgcatcggcgagcgtgcccactgtgcagcgcaccacgcgttcctcaggccaggtcgccttgtacacgagcgccgccggctcatcggagctgcggcccgcggccaaaagctcggcggaaagctcggcgagcatacccgagctcaggaagatgaccatagtcgagccgctttccgccatggtgcgcatgccctcgcccgcgggcatgggggtgcgcccggaaagccgcgtgatcacgaccgactggctgattcccggcagcgtgtattcctggcgaagcgccgccgcggcaccgcaaaagctcgagacgccgggcaccacctcgtagtccacgccgcgcgcgtcgagcgcgtccatctgctcctggatggcgccgtacaggcacgggtcgcccgtgtgcaggcgcaccacttcctcgccccgtgcatccgccgcgcacatcacgtcgagcacttcctccaaggtcatgtgcgcactgtcgtagacgacgcaggattccttgcactcagcgagcagctcggggttcacaaggctccccgcccaaacgaccacgtcggccgcgcgcagaaggcgcgccccgcgcagcgtgataaggtcggcggcgcccgagcctgcgccaacgatatgaatcatccgagccttccttcccgtttctcatcgcaaccgtttacgccgccattcgcgcagcgggcaaaacacggcgcctgcggcggcaatcggcgcaaatacgcaggcaggaggcgcaatgccgcccgccctgggctttgacacgttcacaagtgcccactatcatagtaaaagtttcggcaacgagcatatgacaatcggataaaaggaaatgaccggcgcggcgcccgcacagcccgcgctggcttgcggagggaaccaggtgggaatcctgggcaagggacattactgtataggacgcgcgggcgaaccgcctcgcgccccaagccagactgcttcgccttttcctcacggcatcgccgtggcgttagctccttgtgaaccccgaggggtgcgcttttctttcgcttgtgccgacaagcaactgtcgccgggggaccggcaaaccgaggaaaggaaaaaccatgtccgaccagatgtcacgccgcggcttcatgagcgccgcagcaaccggagccgtcgcgctcgccggagtcgcgctcgcgggctgctccaacacctccgcaagttccgaaaaatcgagtgaaaaggagaaggccgtgaagccggtcatcctcgtcacgagcttcggcacgagctacaacgactcgcgccacatcaccatcggcgccatcgaagacgctatccgcgagaagtactggcaggactacgacatccgccgcgccttcaccgcgcagatcatcatcgacaagctgaagaagcgcgacggcatcacgatcgacaacatgaccgaggcgctcgaccgctgcgtggaagacggcgtgaaggaaatcgtcgtgcagccgacgcatctcatgggtggcctggaatacaccgacgtgaaagacgagctcgacaagtacgccgacaagttcgacaaaatctcgctcggcgacccgctgctcacctccgacgacgactacaagaaggtggccgcagccattaaggagaacatggcgtccttcgacgacggcaagacggcgctgtgtctcatgggccacggcaccgaagccgattccaacgccgactatgccaagatgcaggaagtgtttaagaacgagggcttgacgcagttcttcgtcggcaccgtcgaggctgagccgacctgcgaggatgttatcgccgccgcgagcgccgcaggctacaagaaggccgtgctcgcgccgttcatggtggtcgcgggcgaccacgcgaacaacgacatggcagacgagaccgaccccgacagctgggcagcgaagttcatggccgccggcttcgaagtgacgtgcctgctccagggtctgggacagaacgtcgcggtcgacgacatctacgtctcgcacgtggacgacgccatcgccaagctgtaaactcgccgcgcacgggggcgccggtcgcgtccccgtgcaacgggcatgcgccttccccgactgacggcgcatgcccgttgcattcgcatcccgcccgcccaccgcacggcgcgggcggtcgaagcgattgaaaggaacccctccatgttgaagaaaaccctcgccttcgccctgtcggcggcgcttttcgcgttctcgctcgccggctgcggcggaaattcaatcgacagcgcaaaggcaagcgatgccgatacccaggaaaagaccgaacaggcggccgatgcgcccgagggcgcaagcgctgcccccatcaccgccgacaaggtggccgacggcacctatccgatcaccgtagattccagctcgaacatgttcaggattgtggacgcccagctcatcgtggaaaacggctccatgcactgcgtgatgacactttccggcacgggctacggcaagctcttcatgggcacgggcgacgaggctgccgccgcgaccgaggccgacttcatcccctatgtggaaaatgcggaaggcaagtacacctacgacgtgcccgttgatgcgctcgacgaggacaccgcctgcgccgcgtggagcattaaaagggagcggtggtacgaccgcacgctcgtattcgaatccgccggcgtcgatctgcgcgccgacgcactgaagtaacgccatgcggtcgattcttcccaagggggaaaacaggaagcgccgcagcatcgcggcgcgcgtaatcgcctgcgttctcgtcgccctgctcgcgcttcccttcgcggggtgcagtgcgagcccgaacgcgaccggtgccacggcgggctctcaggaatacactgtgagcgtctcgctttccggcgggtcagggcgcgcaagcatcgcctcacccaccacaattgtgaaggatggcgacacctacaccgcgaccataacctggtcgagttcgaactacgacaagatgaccgtcgacggcgtggactacgcgcccgtaaacgacggcggcaactccacgttcgagatacctgtcacgctcgacgaggacatcgccgtgtcggccgagaccgtcgccatgtcgacgccgcacaccatcgactacacgctccacttcgactcatccaccatgaaggagaaatcgagcgacgatgcaagcggcggctcccccgcgggaacggcttcaagcgccgcggccgacttccacaacgccgatttgggctgcggctgggagccgacgggggcgcttcagcttgaatacgccaagcacttcactgtcgacgagttcgaaggcggcttgcggcttatctgcgtttcgaacggggagcgcttcctcgtggtgccgcaagatgcgaaggtgcctgatgggctgagctccgatatcgcggtcataaggcgccccgccaacaaggtgtacctcgtatcgtcggcgacgatgtgcctggtcgacgcgctcgatgcaaacgacaatatcatcatgtcgggcacgaaggccgacgattgctcggtcgcgggcttcaaaagcgcgctcgaaagtgaggcgatcgcctacggcggcaagtacagcgcgcccgactacgagcgaatatcggcctcgggttgcacgctcgccatcgagaacaccatgatcaaccacacgcccgatgtgaaggaaaagctgcagaagctcgggctcgtcgtgctcaccgaacagtcgtcgagcgagcccgaagcactcgggcgcgtcgagtggattaagcttttcggcgtcctgttcgacaaggaagacgaggccgcgcacctgttcaacgagcagaaggcccgcgtcgagcaaacgtcggggctcgcgtcgtcaggtaaaaccgtggcgtatttctacattaactcgaacggggccgccgtcacgcggagggcgggcgactacgtggcgcagatgatcgagcttgcaggcggcagctacgcgctcgatgacgcgcagacggcgtcgacgtcaggttcgtcagtaacgctcgaaatggagcgcttctacgcgacggcgaaggatgccgacatcatcgtctacaacggcaccatcgacgaatcggttgccaccttgaacgacttcgtaggcaaaaacgcactattgtcgcagttcaaagccgtgaagaacggcaacgtctgggtcacaagcgccgacatgtaccagcagatgacttctaccgccgacattatcgacgagctgcacggggcgttcaccggcgatgacgcgagcgacttccattatctgaggaagctcgactagcaccatgagaagccggctttccatgacatacgacgaatcggggcgcgccgcgcggtgtcgcgtcgtgacggcgctactcgctgttgccctcatcgtgctcgtcggggccaacctgtgcatcgggagcgtgctcgtgcccgcagaccacatccccggcatcctttcgggcggcgcggccaattccatggaaagccaggtcatctgggagattcgcctaccgcgcgtgctttcagccgtgcttctcggcggggcgctttccctctccgggttcctgctgcagacgttttttaacaatcccatcgccgacccgttcatcttgggcgtctcctcgggcgcaaagttcgtcgtcgcgcttacgatgatcgtacttcttggcgcgaaccaggccatgtcctcgccggccatggtggccgcagcgtttctgggctcgcttatcaccatcggcttcgtgctcctcatcgcacggcgcataagttccatggccatgctcatcgtggcgggcgtcatggtgggatacatctgctcggcgacgacgaacttccttatcgccttcgccgacgaccagtccatcgtgaacctgcacaactggtctttgggtagcttctcgggttcgagctgggacgacgtcgcggtcatcgcggtcgtggtgatcaccgtgagcgcatgcgtattcgcgatatcgaagcccctttccgccttccagctgggagaagcctacgcgaaaagcgtcggcgtgaacgtcgcacgcttccgcgtggtgctcgttcttctagcgagcatgctctccgcctgcgtgaccgcgttcgccggtccggtgtcgttcgtaggcatcgcggttccacatctcgtgaagtcggcgataaagtcgtcgaagcccatccgcgtgattcctgcgtgcttcttgggaggcgccatcttctgcgcgggctgcgatttgatcgcgcgcacgctgttctcccccgtcgagctttccatcagcgccgtcaccgccatcttcggcgcgccggtggttatcgcactcatgttgaagaagcgggtgaggtagatgggggaattcgtgccgcggcccaaaacgctcggaggggacattccatgcttagacagtcctgagcttgcacgaaagcgccagaaggcactttcggctcgtgcggaactgcgcgcggaacgcctcctccgagcggagtcgaacctcgaagccccggtcgaaacgcaggctgacggagcgccgcttttccgcataagcgacctgtcggcgggctacgacaagaaggtcgtagtcgaaggcatcgatctggaggttcgcgcgggcgacgtcgtggcgctcatcgggccgaacggctcgggcaagtcgaccatcttgaaaaccatcacgcgccatctggcaccgcttgccggcgcggtcgagctcgacgggcgggagatttcccgatggaagacggcggagttcgcaaggaaccttgccgttatgctgacagatcgcccccggaccgagcttctcacctgccgcgatatcgtagaggcgggaaggcatccctacaccgggcgaatgggcacactctcgcccgacgaccatagtcgggtcgatgaggccatgaaaaccgcacatgtggaagagctcgccgagcgcgacttcatgcagataagcgacgggcaacgccagcgcgtcatgctcgcacgcgccatcgcgcaggatccgcgtgtgctcgtgctcgacgagcccacgtcgtatctcgatatccgctaccagatcgacctgctgcgaatacttcgccaccttgcgaaatcgcagaatgtggctgtcatcatgtccatccacgaactcgagctcgcgcagaaaagcgccgacaaggtgatttgcgtgaaggacggccgggtcttccgcgccggcgcacccgagggcatattcacgcgcgagacgattggcgagctctacggccttcaacatggcaccttcaacgagcgcttcggcagcgtggaaattgggcgcccacacggcgatgcgcacacgttcgtcatcgctggcgcaggtacggggtcggctgtgtttcgccagctcattcggcagggcaaggcgttctacgcgggcgttctgcacgaaggggacatcgactgcgagctcgcgcgcgacctggcgacggaatgcgtagccgagcgcgccttcgagccgatcggggataaaaccatagcccgcgccaaagagctcctcgtccactgcgcgcgtcttatcgtatgccccgccgccttcggcaccataaacgcccgcaacgcagagctcgtcgagttcgcacgctcgcatggtatcgaggtcatgcgagcgtgcgaaggcgcatcggaggattccaaaattggagtgggaaggataaactggactttcttttaaggatcctcaggctacagctcctacgccggcaaggtctccaaggcgccggaaaacctcaggaacaggaatttccacgccgacgagcccaactaggcctaatccaagcgagattccagactcgacagaccattgagagtcagatcgttggcgacctcagagacacgctcgataggaaccgagccgtcagacagcgcccacgtgcgatagataccgattatacccgacagcaaaaacgccagatagtagtcgaacatctcgtccttgagaccttggggcagcagatcgcgctcggcaatctcgtgctcgagcggtgcacgaagacgagccataaaatcatcgagcggaatattctcgatcagctgacgattgagcaccaagttgttgcacagtgcctcattaacggttttaaagaaggtcgccgccgcgccaagagcgcgctcgttggtgtcaccgtccatagaagcaagcgttttctcgaccgagtcgacaatcatctccaccacatcgacggcaatggcatcgagcaggccgtcaaccgtaccaaagtgaacgtaaaaggtcttgcggtcgacattggcctcgcgcgcgatggcactcaccgtaatgtctgccagcggcttttccatgagcaggcgctcgaaagccgaaaggatggcattacggctgcgaacgatgcggcggtcaagacgcggtttgatggttgccatgggcgtgtcccttcgatatgcgagcattcatcaacagatgagagataatctacgttagaggattatcccccatacggcacaaatatgccccgcatcatgaagaacgcacgactgccctactgagacttagggcgcttcttcttattgagtgccgacggagatacgcgaataccgtctcctgtctgacgcacataggccttatgagccggctttgcggtcccagaagccttctgagcctgcttcttgggatcaacggtaacagcattcgtggggtgcggcttagtgggcgcagagggcgtctgaggcgtgcggccgagcttgcgcatcacgcgatcccagcgcgcatggatgctctcgttgtgggcgctcttaagtcccagcaggggcgcagccaaaatggtaggcgcaataaacgtaatgagacgccacagcagatagccggcggtcgaagccgaaccgaagaaatgacccaagaacaatgcaaagccgccctcagcgccaccagttccaccgggcaagggaaccgcagagcttaacagctggacaaaggcgctcgcggccatgaccgagaaaaagtcgacctcgtggtggccaaaggcaagcatcaggaaatacggaaccagatagaaaaacgcgagctgcagcatggtgataaacacggtgagcagcatggaagaaaaatgtccggccgaaagcttgaacttctcggagaaggagtagatctcgccatcgacaaacgtgcgccaaccctcgatcttagtggccgagacaccaatgcgctcgagccaattgatgatgcaatgggcgatgcgcgtgacggtcttaggcatgagcgcgacggcgaagatgccaagcaagatgcagcagtgtccaccaaagctaaagacgcacagcagcgtcatgtcgccatagcgctcggcaaaaaacggcatgcgagcaagcagtaggatagcgccccaggcaacgaggccaaactgatacacgataaagcgcgtgaactgcgtggctccggcctcgccgacattttggcccgctttggtcaggcggtagatctgagcaggagtcgagcccatcatcataggggtgaggttgccaaagaagatgccactcgcctcgaccgagatcaggtcgcgaatgccgacgggtgaattggggtcgagccagacagcgatcgcataggccacaatgccaaagaacagatacatgaacatgcagagacacgcgacaacgagccatgacgcctggacgctcgacatagcggcccagaactgccccatctgcccggttaccaccagatagacgatataacccaccagcacgacgccgataaagatggcgccgcggcgtgcgctcttattgtcatctccgcccgaggcctcaacctcgacctggggcttagacgtatgctgagaggactccgtcatgagactccttctaacagtcaaaatatcttggatattgtacccgcaaggaccatagacagaacgcaaagctctggttcaaacgggaattgcagacggttgtttgaaaataaaaaacccggccttccatgggaagtccgggtatcagatgcgtggtagcccgtaccagattcgaactggtgatctccgccttgagagggcggcgtcggtcaccaagcacaacctcaagtaccgccgctactaccaccagttcgactactaattccatttgggggaaaccacaatgaggcaatatatcttcgccagccacgcgcattttgcgaccggcatcaaggagagcaccgagctgctctcgggcgcgcgcgataacgtccacgatctgtcgatgttcgttgacggtcgtaccgacgtcgccgaggaggctgccaagctcttggcgaccatcgaccccgccgacgatgtgatcgtgtgcaccgacctgtttggcggcagcgtcaacaacgagttcaccaagatcgtccagacgcgtcccaacacctacctgatcgccaatatgaacctgccgctgctgatccagctgctgttctccgaccaggaggcgcccgccgaccaggtcatccgcgagatcctcgctgccgacgatacgcgcgtcaagtttgtcaacgacctgctgaccgatacggatgacgaggaagagttctagtcaccgtcttgcttttaacagcgccgggtttccggcatgagacctttgggggtcaatcatgattcaactgcttcgcgtcgaccatcgtctgcttcatggccaggtggccgtctcttgggttcagggcctgggctccgactgtatcttctgcgtcggtgataaggtcgccaacgatcccgtctggaagaccacgctcaagatgggcaagcctgccaacgccaagctcgtcatcaaggatatggagcacgccatcgaggccatcaactccggcgtgaccgataagtacaagatgatcatctgtgtcgccagcattgccgaggccaagcaacttgccgacggctgcccgcagatcacctccatcaacctgggcaacaccaagtccaaggatgagcagcgccccgatgcccgcaagatctcccgccagatctttgtgaccgccgccgaggaagaagacattcgcgagctcgccggccgcggtatcgaggtcgagattcgcgctctggccgacgaccccaaggtcgacgccgtaagcgccctctaattggggaccacggggcggcgtgcacggcgccgccccatcggcgggcgtaccggctaaacgttttatccgatagcccgcctaccgttcaccgggagtacctgcccgttgagcgattggtattaaatagtttccgcatgactatataattggtatgaaatcatttgtaccggtttaggtgttagcagcacaccggtacaagctggatctgggtagcgattgtcggcatggaaaagggcgcgctgacaagtcggtaatcgccgcgcagatccaagagggatcaaagggaggaacaatgcttgttcaagcgatcctcatcggacttatcgctgccttcggtaagctcgattatcagctcggtacgctctatgcgttccgtccgatcgtcctgtgcccgctcgtgggcatagtgctcggagacctgcagtccggccttgccatcggcgcgagcctcgagctgctcttcatgggttctatcgccatcggcgcctacgtgccgcccgatgagacgatcggcggcgtgctcgcctgcgccttcgctattcagctgggccagagcaccgaggccgctatcgcgctcgcgatgcccatcgccaccctgtgcctggccatcaagaacgtcgtcaacgccggtatgccccttctggtcgaccgcgccgacgtctttgccagcaagggtaacctcaagggcatctacgccatgcactggatcatcggcctcgtgatcgtcgccctggccttcttcctgtgctccgtctccttctatctgggtgccgacgccgttcagggcctgctcgacttcatcccgacgtttgtcctcgatggctttggcgtcgcagccaacatcctgcccgccatgggcttcgcaatgctcggccgtctggtgcttaccaagcagctcgtgccgttctacttcctgggcttcctgctgtgctcctatgccaacgtgcccgtcctcggtgtcgccctgatcgcaatcatcatcggcatcgacaagttcgacctgctgggccttggtggcgcccagccccagctttctgtggaaggggatgaggacgatgacttctaattccgagaaccagattactcgctccgacctcattaagagctctctgaacaccggcgctctgggcatggagttctcctggacctactacaagcagatgaatattgccttctgcctgatggtcgccaacatgctcaagaagatctacgccggccgtcccgacgactacgccgaggccctgcatcgccacagcgcgttcttcaacatcaccccgcagctcgctcccttcgtgggcggcatcgcgatggccatggaggagaaggtcgctcgcggtgaggttgagcccgagagcgtcaacgacatcaaggccgccctcatgggccctctttccggtctgggcgactccttcttcctgtccaccctgcgcgtcgtcgccgctgccgtgggcatcagcctgtgccaggccggcaatgcctttggtcccatcgcctttttgctcatctacaacatcccggcgttcctgattcgtatctttggcgccatcaagggttatgagctgggtatcggcttcctcgacgaggctcagaagaccggcctgatgcaaaagatcatggcttgcgtcggcatcgtcggcgtcatggtcgtcggcgccatgagcaaggacatgttctgggcctcgatgcctatcgccatcggccagggcgactccgcccagaccctccaggacatcctggatggcatcatgcccggcatgctcggcatggccgccttctggctctactattggctgctttccaagaagatcaacccgatggtcctgatcctctgcaccatggtcgtgggcattatcggcgtctactttggcgtgcttgcctaatatgtttacatcgcgcttccatcgcgtctaacggtagcgtcgatctttgggggcttgtcgcaggtgcggcggccccctgttttttcaagcctgtacgaaaggggagggctatggacgtacccgagctttcgctcatgaacatcaaccatcgttattacagcatcgagacgttcttcaaggcggccagcgaggcgggctatcgcaatatcgagctgtggaccggctcgatgcacctgtatgtggattgccatgagcacgattcggtggacaagattcgcgacctggccgctcagtacggcatcaagatcgtgtgcgtctgccccgagcagaacaaccccaagccgtggaacgtcgcggtgcgtggcgaggccggccagaagcgtatcctgtcctactttaagaacgtgatcgatgtcgccgtcgagcttggtgcgccgcagattttggtgacgagcggctgggcctatctggatgagccggccgaggatgcctgggcccgcagcgttgccatgctacgttcggtgtgcgattacgccgattcgcgcggcattcgtgtcgcactcgaggcactgcagccgtcggagtccgtgctggttaacaccgcacaggacgtggcgcgcatcttggccgatgtcgaccgccccaacctgaaggcctgcatcgactttggtgccatggaggttgccggcgacacgatcgacagctattttgaggttttgggcgacaagatcgttcacacccattttgtggatgtgggcggcggtacgacgcaccttgcctggggcgacggcgagcgcgatatgcgcgccgacctcgaggcgctcatgcgtcacggctatacgggctatgcctcagccgagacttgcgacggtcgctactatcgggacccgtccaaggcgacgactcaggttatcgagatgtatcgccgcgtgacggcagagatggaagccgaataactaagctgtgcggttgcgccggaaacgctggggcgggttcggcgcaacgtgcttttgggcgttgagttgtggggcgtctgtcggctgcggtactcgaattagacaacttatggtgttgtaataccactcgggtggggaaatcgaccgttcgccgcaaatcttcgtgagtttggattggtattaaataacgcgcaaacgtatggctataattggtatcagcaagacgcgcgatgtatagaatcgcgcacatgtgatgggaggacacacatgaaggagaccgagaagatcgagatcgtgcacttcgaccaggagggctacctcgttagtagtcgaactggtggtagtagcggcggtacttgaggttgtgcttggtgaccagctcgtagttgcgcgagaggcggtcggtggtgagcaccgacaggatccagggggacacgatgacgcggaagtcgtcgtccaggcccgggatcgcgtactcggcggtgtcgatgatgacgtagtcctcgtcgccggtcacgccgctggtgaggaaggcgcggacgcgctcgtccagggcgcggcactcgtcctcgcccatgaacaggaacaccgggacgccgggctcgagcagctcgagggtgccgtggaagaagtcgtgcgaggtgatgtggcggatgcgcttccactgcatctcctcgagcaggcacatggagtacaggatggtctcgccccacagggcgcccgagccgatgaacatggtgtagtcggccagggcgtacttcctcgcgagctcctcggcgcgcggctcgaagcgcttgcggatgtcgagcatgtccttccagacgtcgcgggtctgctcgatgaacaggtcgaacttggggaagcagccgcggcggttgagcaggcgcaggccgaagcagtcggcgaggtagtagcccttctcgcagccgccggcgccgtggtcggaggccatcatgacgcagttctcggcgcccacggcccgcccgatcttgccctccgggttggtcatggcgtagacgcgcacgcccatctccttcatcttgccgatggcctcgaggacctcgggggtggtgccggactcggaggcggtcagcacgacggagcgctcggtcatgcgcttgtggcccatgacgttccactcggcggcgtggatcaggtagacctcgaggtcgcggtcgccgaacttgttcatgaggtactcgagctgcatgaactcgtcccaggtgccgccgacgcccatcaggaagacggcgtcgtagccctcctcgtgcacgcggtcggccagggcggtcatcctcttgccggcctcgtagacgttcctgccgtcctcgaggtagccctcctggtcgaagtgcacgatctcgatcttctcggtctccttcatcggatgcgcacctgttgagcgtcaacatctcgaacggctcggctccgctgcagctcggaagcaaggcagaggcgattcaggcagatttgggcgcgctgctctcggcggcgcggacgggcgacggtgcttaagcctccttgttggtcgctttaaggtatgcatcgtcgcccacgggctccagccactcgttggaggtctcctcgcccggaacctccaacgcgagatgcgagaaccagctgtcgggcgcggcgccgtgccagtgcttcacccccggggcgatgttgaccacgtcgccggggcgcagctcctgtgccggctttccccactcctggtaaaaccctcgaccagccacgcagacgaggatctgcccaccgccgcttttggcgtgatggacgtgccagttgttgcggcagccgggctcgaacgtcacgttgtggacaccgacctgctcggtggaaaggggcgcgaggtagctttgcccgataaagtacttcgcgaaggcgtcgttgggggcaccgatggggaaaaccatctcgttttggtgctgagcccttgcgtcggcggcatcgtcggccgcccagacctccttcgccatgcggaaggcagcccacgccttgggccaacccgcataaaacgccgcgtgcgtaaggatttccgctatctccgtcctggtcactccattgttctttgcggacatcaggtgatatttgaacgaagagtccgtcagcccctgcgacatcagggcaaccaccgtcaccacgctgcggtcgcgcagggagagctcactctctcggctccacacctcgccgaacagcacgtcgtcgttgagctgtgcgaatttgggagcgaactcccccagggcgtctctgcctgccgtctgtttaactgccatgatcgatttcctcctgtcgatagttttggcacaaatctgtttccgcgcggccaaacagcccggctagattcccatgcccattcgccgcgcctgctccagagcgggatgcccggcgatttcgcccacgccgttcacgccgccggcgaaaaccgttccagcgagcgtgcagcgggagaaacagtcaacccatccctgcatcgcctttttcgccccgtcgaaggtcgagcgcccgttctccgccgccgtcgccaacagatatgcctcggtgaatgcataatcggagccaaaaagcgggttagcgcggtccagcatggttttgagctggccgcagacgctgtagtagtagacgggcgttgcaaacaccagcacatccgcatcgtgcattttggcggcaatttccacggcatcgtcttggatgacgcaacgccccaactttaagcaggcaaggcagcccctgcagaagcccatttgcttctcgcgcagacgcacggtctcaacgctgtgacctgcctcccgcgcgccgttggcgaaagcctccgccagcgtctcggaattgccattctttcgtggacttgaagaaactatcaaaaccgttttgcccattacggaataccccttgcgctcccgatttacattgacgagaatgaaggtaatacctaaacctgactttaggtcaaggaatgaattcgacattgtttcggaggagccatgtacacaatcggacaggtggcggaaatgttcggtttgcccgcttcaacgctgcgatattacgacaagcagggattgttcccggggctggagcgggcatccggcattcgccgattcagcgatacggaactcgaagcgcttcgggtcatcgaatgcctaaagaaggctggaatggagatcaaggacatccggctgttcatggaatggtgcgcagagggtccctcaacataccccaaacgcaaggccatgttcgaggagcgcaaggcccacatggagtcggagatcgtgaacatgaaccgcgcgctcgacatgctgaagttcaaatgctggtactacgagcaggcaatccaagatggcaacgaggatagagtgaaggcgctgattcccgataatttgccagaagaaatcaaagatacctacgataacgcccacactcaataatgccgcccgatgctcaaggggctttggcaaggagtcgttttaggcagatatgcaaaaagatagcctccgaaccagagggtccggaggcttttattcccgttatttcgctggtggctttactctatggcggcgccgaaacagcatcaggcggtactcgacggtatcaaaacgcgagttcaaaagccagttcccgctattcccgctcagtgactaatccaggccgagtgttgtcgatgcgtgtcgcgtcgtaccgcctaagggctgattcgtgcgcaatttgggcgaatcacgcccttgattcgcgattttgtgaatgactcaattgattcgcaaaaccgcaggtcgcctttttaatcactccctagtttccgccggggttcgtagcgggtggcgtgaaaaggggtgattcaaagggtcggagagatgtctatagcgcaatcttctggtattggcgcagtgagggacttctcacctccatcagtccaaatcgtcaagctccgaaagacgtcgagctagagaaaaggacctatttcccgtcatggattgggtttacctgcatgactagagccctggtgtaattggctggatcaccgttccgggaaccggtatcgacctacctgtccgccaagctccttcttcagctccagcttagtatctgactcacaccgttataagcaaaaccgaagagatgcgtcttggccaagaaataaggttagccttatcttgctgcatgattcgtgtgttatagttagattgctctaactgtttggggggcgatagccatgcacgaacgcaagggcttctgggacaagaatgccggtcggtacgaccgtttcatgcgaaaggaccgggcggcgtatgagaagatgtatgagctgatcaggccggtggtgaaagcaaaaaccgtactggaggttgccaccggcacggggcttatcgcaaagagcatcgtggatgcggcggtgcacatcgaggctacggacgcttctgcacagatgatccttgaagcaaagcgggacaatcaatccgcaaagctgcacttttccgtacaagatatgttccgcctgccctatgcacagaagtccttcgaagtggtgatcgcgtccaacgcgcttcacatagtgccgcatccggaaaaggcactgcaagaaatcaggcgggtactgaaggacgacggcgtgctcatcgcgccaaccttcacccacgcggggaactcggtttccggcaaggcaaaagcctttttcatgagtatggcgggattccccctccacagcaggtggacaagcgaggaatacctgcgtttcctgcgtcaaaacggctgggcggtgcagaaaagcgcggtgctgaaggcctcgttcccattgacctatgcggaatgcacgaaatcggaggggccagatgtcgttctttgaaaacacccgcaagcccgtgggcctcggcggaaaacttatggttgccatgatgaatctgggccacagccctgtggcgcggtggggacttcgatttctacgacttgcgccaaatgccaaggtgctggattgcggctgcggcggcggggcgaacataaaacggctgctgaaaaaatgcccgcatggcgtcgtcaagggcgtcgactattcgcccgtcagcgtggagaagactagaaagctcaaccgaattgcaattcaggaggggcgttgcgccgttctgcaaggcagtgtggcggatatggtgtttgaggatagctacttcgatgccgccacggcctttgagaccgtctatttttggcctgatttgccccgatgcttccgtgaggtctggcggacgctgaagccaggcgggacaattcttatctgcaacgagagcaatgacgatacggacaaggacgagaggtggacgcagatcatcggcggcatgaccatctacaaggacattgaattaaaggcatgtctggagcaggcgggttttcacgaggtgcagatacacaaaaagaaaaagtggctctgcgtcacggcgcggaagtaggggtatcaagcacgggcatttttgcatccatcctgcacatggcgataggcatgacggtcatagcggctatgctggcggcaattatgacagtttttattcactgaggaagaaacctatgaaatgtaaaattgagaaaaacaccgtgcaggagacgctgatcctcccgctgtattcccggaagctgtgtacggagttgtacccgaacctttacagggatgaaacagcggttcgtctgctcgaccagatcgactacgacttttcagaggtagagaaaaactcccgcagcctgatgcagcgctttggtgcgctggaggtggccacacggcagagtgatcttgctttcgaggtgcgggattacctgaaaggccaccccaatgcggcggtggtcaatctgggctgcgggctggacaacaccggcagaacctgcgacaacggtagatgcaagatctacaatctggacttcccggatgtgattgccttgcggcagcagctactgcccgccggggatcgagaacaaaatatcccctgcgacctgaaagacaccgcatggtttagcaaaatcgatgcctcccgcggggcggtgttctttgcctccggggtgttctattactttctgacccagcaggtccgggaactggtgcgggggatggcggacgctttccccggcagtgtgctggtctttgatgctgccaatcggacggcggtaaagatgatcgcaaaaacatggcttaagactgcaaaaatcaaggatgtgggggcatattttgcggtttcggatgccgccaaggaaatcggcacgtgggacagccgtccgcaggtcacaagtcgcggctatatgctgggctacaacgatttgagagactcttctgtcagctgctttttccggtttctcgcaagggtcggtgacaacgggatgaaaatgcaaatcgtgaaaataagattttgagaggcgaaaacgaagcgcattcactttgacgtcgaagaagacggcttttacggcgcatattgggcgtgcaaggacacgcatacagcagcgggcacggattcaattgaaaccgtgcccgctatctgatactatattattttatcgaacgtatgttctattcccactcggtggttatagttttgccgtctcgtcactccagttgcacccagttttcggcggcatctcgaagtgagtgccgctgaatgacgcgacgtcgcgtttcatcggcttcggggacaaaagctgggacaacttcaaaaaccattttcaaactcagagtattgagtttttatttttgtcccaaggggcacggagagccgcctttggaggctcgatatcgccgaaaaacgcccgttttgaaactcaaccgcctttgagcctgcaaaccaccagcttcaacagtaagtgagtcgacgcgggtggcttacgagccgttcacaaaaccgcaggccacaggtctttgtcaacgataagcaaagtgaatagtctcaggtggcttgcccatgagttggcgtaagcctgtttagcaaaaggctaatcggacacgacaggccgcccgcatggcgacggcgtttcccgtgcgggcacaaacagccctgcgtgccctgtcgcgcgatatcccaatgcgacgttcagaaccctacccgccaagcagccacctcgcgaaattcagcacgagcacgccctcccgggtatggggctcatgcctcgtgcgagtgatgagaatcttcgggaatgcatccccgatggatagaatcggcgcaatctccctctcgagcgtcgaatcggcgccgatatcgtcgctcacatacactttccttcccggtttcgaaacttggaaggcagtatgcgcaaggatgcgtcgaggtgcgatcccagtcgtaccatgccagcagagatgtcgaggcacattcgttcatgctgcaatgcgggcatcggagatgaaaaacagcccgtcgggtagtcatgggcgtgcgggagcccgcatcagtaacctgcctcctcggttgtcccttctttgcatggtcgtctacataaaggaggaaccagccatgcagatcagcatgcttgcccttcttgggtcacggaccggggaggcgagggcctccgtcgggaccgccccgagcaaccggcatatccaaggaatgacaaggctcgattgctgtgctggtcaggatgccgaagcgggccgtccgccaatcggaatgcgggtcaggatgctgcaacgtgattccagctgcaggatacggctcctttgcggttgccgcaaaacctgctggcaacattcttactatccgaatgatgtacgcatcccttgggatcgtttcgcctgaccagggccatcttcagcgcctcatcggccagctcggcaggcgcctcttccacgcgtaatagccctggcgggtcacctatgcaaccaaagatacaaaaggaatcgaatggccagagaggattgccctttccgatggtcgattcttgacaggcaaactcaagcctcgttaatattacatggtttgccagaccgaattaacaaaggaggggtgtcgtggttggtcttttccgcacgtggatgagcgcctagaaagcggcgctgttgtggcgtcgcgctgtttttctgcacgccatttcacgattggacataaccatgatatttgaaacctctcggggcaggtctgctctgctgtgccattcatggcaattcaagctttgtttcgtatggggcggggagctcgtttcgacattgacgagttcgattctccagatgggtcttatttggcatctcgccctcacgacagggtcgtcttctctcctctccttagcatcgctggcaggctttctgccgattgctttgttcggaatccttgcgggcgccgttgtcgacagactgcctttgaaacgtgtcctcatcggcgccgacctcttcattgccgcggtgggtgccgccttggcgattgcctcgttggccggcagcttacctgcatggctaattctcatcgccttgtttctccgtgcagttggtacttcgttctacacgccagcctcccaatctctcacgccccatctcgccccaccggagcatctcgttcgcctatcgggggtgactcaggcgattcagtccggcggatacattcttggcgccgcgcttgcagcagtgatttatcccgtggcgggcattaccgctatgattgtcctcgacgtgctgggagcgcttttcgcttctttagccgtcctcgccgcacagatagacgcagggggcctcgacgaagccgaccgcagcttgtccttttccaataaggttcgagagctcttctctgagatttcggacggctacaagctgattagggggtacagggggctgttcgcccttctttggtgcgggttcgtcttcgctttcgcgttctctccgctcgcggcattgttcccaataatgaccttggggcattttggcggtagcacgggggatgccgctttggtggaaatccttttttctgcaggcatgctggctgggtccggtatcttggcggttacgggagggttccgcaataggtcgttcaccatggtcgccgcgattgccggcttcggcattgccgcaatcgtatccggatcgctcggcccgtcattgttcgctgctttcctgccggtgagctttcttatgggcgcatgctccccgttgtacgcgggaacccagactgcccttatgcaggagcagatacctcctgagtacctaggccgcgttttcggcctctacggaaccatcatggcttgggccatgcccatgggcctcgcagctccctccgtttttgcggatctgcttggagctccgttatggttcgtcggctctggagcgaccatggtactgcttgcgatggctatgctgcttgctccgagcgtccgaagcgcggggaaaagagataccgggcagattcaatagcccaagtattcgaaaaaaagaggcagcagccatcggttcaagcgtcagccttcaagcccttgcgacgacgaggtattgcactgacatcccacatcgcgctccttattcgtcgccaactatcattttcggatttgccggcttgcgcaaggtcaaaacgctcgcgccggcaattgggcaaaggcgaaaaatcgacgtgagcaatcttttttggcatggctgcgtttccagtaaaacgctaatacacaaaaggcggttcaacctatggaactcatagtcaaagctaaagacatctttttggaatatgccggccgcgatatcctagatatcgaagagttggaaatctactcctacgatcgcatcggcttggtgggagacaatggcgcaggcaaaaccagcctgcttaaaattctgagcggcaatcttaccattgcggacgccgacgtcaggcgtttcggcagcattgccctcatcggccaactcgatgaactcgaccttgatgcggctcagggcagtggtgagatgctctcccgtctcaacgtcgccggagtggcgcaggagacgatgagcggcggagaggagacacgcgccaagattgcctctgcgctctcccagcatgcaagcgcgatctttgctgatgagcctacgagccacctcgaccaagacggcatcagccttctcgtcggacaactcaaggcatttgatggagccctgctcattgtgagccatgaccgttattttctcgatcaggtagtggacaagatctgggagctcaaagacggcggtatttccgaattctggggtgactactccgactatctgcgacagaaagaagaagagcgcaaagctcaggcgactcgatacgaagaggcgatgcgcgagcgcgatcgcctcgaagccgccatcgaaaaacaacggaaaaaagcacggcaggtcgacgccaagcggaaggctgcgaaaaaaagcaacgagtatgcaggtcgattggggcatcagaaagcaaccggcaccaaacagaagaggatgtaccaggcggctaaggacatggagaagcgcctcgaagcactcgaagggattgaggccccagatagcattcgcgccgtgcggttccgccagagcaaggccctggaactgcatagtaaatttcccatctcggcagacgatttcagcttgagcttcggcaactgcatgctctatgaccacgcgaatttcgagataccgctcggtgccaaagtggccatcaccggtggcaacggtacaggaaagaccagcctgctgaaggcaatcgctcgacgcgccgacggtatcaacatctctcccaaggcagagatcggttacttcgagcaaacaggctacaagttcgacgcccgtcagtctgcgatctcgttcatgcaggatggttgcgagtacagcatgaccgaaattcgaggcatcctcgcctctatgggaatcggaccgcgcgacctgacaaaggacgttggcgttctctcgggaggcgaagtcatcaagctgctactcgcgaagatgctgctgggcagatacaacatcttgctcatggacgagcctggaaattacctggacatcaagagcgccgaagccctcgagcagatgatgagcgcctatgccggaacgatagtgttcgtctcccacgataagaggctggtcgagaacgtcgcagacattgtctacgaaataaaggacaccaagctagtcaaaatctttcagcgcgaatagccctaaatgagcaagaaataatccccgaacggagacaagggagtaaaacggcaaagaaagagcctccgtcccaacacagggaacggaggctctttaatcgcttttactcatctccgtcgctggtggctttgtcatgactctcgtacgaaacgaaactcagcggcatagtgcggcactcaaaatcgcaggtcagaaccctgtcgtcctactcccactcaatcgtcgcgggcggcttggacgtgatgtcgtagcacacgcggttggcgccggggacctcggccacgatgcggccggagatgcgggccaggacgtcgtagggcagtttggcccagtcggcggtcatggcatcactggactcgacggcgcgcaggataatcgggcgctgataggtgcgctcgtcgcccataacgccaacggacttaatgtcgggcaggacggcaaaatactgccagcagctgtgctcggagttgcgctcgccggtctgctcaaacagacgctggttgtaggcgtcgagctcctctcgcacgatggcgtcggcattcttgaggatctcgagcttctccttgtcgaccgcgccgatgatgcggatggccagacccgggcccgggaaaggctgacggaacacgatgtgacccggcaggcctaacgccaggccaagtgcgcggacctcgtccttaaagaagtggtcgagcggctcgataaggtcgaagtgcacgccctcggggaacggaatcaggttgtggtggctcttgatggtggccgtcttgccgcccgtcttgcgcgcgccggactcgatgatgtcggggtagatggtgccctgagccaggtacttgaccggcttgccgtcgcactcgagctgctgggcgaccgcgaagaactctttccagaactgcgtgccgatgatgcggcgcttctcctcgggctcggtcacgccggccagaagctcggcgtagcggtcctcggcgtggacgtggataaagtcgacgtcaaactgcttggtgaagacctcctccacctgctcgggctcgcccttgcgcagcaggccgtggttgatgaacacgcaggtcatctgcttgcccacggcgcgagcgcccagcgcagccacgacggaggagtcgacgccaccggacagggccagaatcacgcggtcgtcgccgaccttctcgcggaactcggccgtcatggtctcgaccaggttgtccatgctccagttgggctccaggccgcagatctcaaacaggaagttgctcagcagctgctgaccgtactcggagtgcttgacctcggggtggaactgcgtggtgaagatcttgcgctcgacgcactccatggcggcaaccgggcacacgtcggtgctggcggtaacggtaaagccctcgggcacctcggacacggcgtcgcgatggctcatccacacggtctgctccataggcgtggagttaaagagcttggcgccggccgtacgcgtgatggtggcgcggccgtattcgcccacctcggagtggccgaccttgccaccgagcgtcacggccgtgatctgatggccgtagcaaaagcccaggacgggaaggcccaggtcaaagatggcaggatcgatggacggagcgtcctcggcatacacggaggccgggccgccggaaaggatgagcgcagaggcgttcatctcgcgaatctcgtcggccgagatgtcgcaggggacaatctcggaatacacgttgaggtcgcggacgcgacgggcaatgagctgaccgtactgcgcaccaaagtcgagtacgaggacctttgcggaagccttttgatccatggtttccccctcttgttggcggggagccggtgcccacccgcgtgaatgaacgaaaataactttcatagtgtacacgttatatggggtttctcgtccctcgcagccatcagcgcacggcaaacgcacgaccggggccctatttgacggcgattgaagtgttaccaaacgttacagatgatgtaatacgtttgaacattggacgccctgtgccacaatactgccgaacgactccgcctctgcggcggcaaatacgataggaataccagcatgaagcgcatccttctcatcgccacgggcggcaccatcgcatcgaccgaggacggcaatggcctctcccccgccctgaccggtgaggagctcgcccagagcgtccccgagatctcgggcctctgcgagctcgacgtcgtgcagcccatgaacatcgacagcaccaatatgcgccccagtgactggatgcgtatccgcgacgtcatcgtcgagggttatgccgaccacgacggcttcgtgattctgcacggtaccgacaccatgagctacaccgcggcagcgctttcctacctgattcaggacagccccaagcccatcgtgctcaccggctcgcaaaagcccatgggcaatccctttactgacgccaagctcaacctgtaccagagcctgctctatgcgctcgacgagcactcgcacgatgtctcgattgtgtttggcggcgtcgccattgccggcacgcgcgcccgcaagcagcgtaccatgagctttaacgcgttcattagcgtcaactatccgcccatcgcctatatccgcaacgaccgcatcgtgcgcaacgggcttcacggcacgcatcagggcgaaaacccggtgcgcttctacgacagcatcgacccgcgcgtatttgtactcaagcttacgcccggcgtaaacccgggcatcctcgacgcccttgccgatagctacgacgccgtgattctggagacctttggcattggcggtatccccgagtttggtgaatcgggcgaatcgttccaagaggcaattttccgctgggtcgattcgggccgcaccgtcgttatgaccacacaggtccccgaagagggcctcgatctgggtgtttatgaggtcggccgtgcttacgccgaccatccgggtattttgcgcggcgatgatatgaccaccgagacactcgtggccaaaaccatgtgggcactcggccagtcacgcgatgccgccgagatccagcgcctgttctacagccaagtcaaccacgaccgcatcccgatggcgtaattcagttgtcgacgggtatcccctattcgatcccctcgagaagctctgacaccgtcatgccaagggcgggcgcgatcttaaatagaaccttgagcgtgaaatttgccgtcccatcttcgattcggtcgaggtagggtcggctgattcctgtcgccacacaaaaatcaaccttggagataccaaggtccctgcgtgtctcttcgacccgcctgccaagaatctgtttcgcacgttcgtccatgcagccgagtttgaaattgagctgaacaaaaacgtaaactatagtttacgttttgccgaatacacaggagttttctatgtcgggttcttcggtccgcatgtaccgagccacgcttcgcacaaacagcgcaccgcccaagctcgtcgtcgttgaagccgaatgcctttcgcccgatgagcgcacagcatttgcattgctatcaagtcgcgtcgccgccgttctggtcccttgcccggcgcaaggtgaacttgccatccaatgccaaacgcacagctgcccgctcaatcaggctgccgtaatcgcaaccagccaacgcggcctgccgctccttctagaagccggcatcgcactcgcccttcgtggcgccggatacgaaaacgagaccgccgccgacatggtctttaaaccacgatcgagcggcggcctcgcagcagccattgaatatatgtgcagactcgttgcctaaaaggacaagctagaaaccaaggccaaagcccgttccggtaatcgccgagtacataaagtaaacgttaaccacgttgaggaacacacccgtgatgcaaccgttgcgcaggtagcgttcgcacacgatacgcgccatggcggcggagtcatcattgtttttagcctggcgtcctgccgtaaagtacgtcaccacgctcagcagcaggttgagcaccggcagcgccagcaactcgtagctcttgccccagcgcgtcgcctcgccggcggcattaaactttgttgccacctcgggaccaatgttggggataacacacgctgcgaccaccagcggaatcaccgcaagtatgagcagcgcaatacccatgtagccggcttttttgccatatttaaacatgtgcgtcgtccttacacgttaaagcggaagtgcacgacgtcgccatcggccatgacatagtccttgccctcaatacgcagcttgccggcggccttggcgccctgctcaccgccgagctcgatgtagtcgtcatagccaatgacctcggccttaataaagccgcgctcaaagtcggtgtggataacgccggcggcctgcggagcggtcgcgccctgacgaaccgtccaggccttgacctccatctcgccggccgtaaagaacgactgcaggccgagcagcttataggccgcctgcgcgagcacgtccagaccgggctgctccaggcctaagctctccaggtagtcggccgcatcctcgggatcgagctcggaaagctcggcctcgatcttggcgcagatgggcagcggcttgacgccatcgatgggcgccaggtcctcgttgagcatgtcctcgtctacgttggccacatacaggatgggcttcatggtgagcaggaacaggcccttggcggcggcgcgctcctcatcggtcatctccatggacgcggcacgcttaccctcgttgagccaggcgagcaggcgcttggcgacctcgaacttgggcatgagctccttgtcgcgcttggcctccttctcgagcttaggcagctgcttctcgagcgtgcccatgtcggccaggatgagctcggtcatgatggtgtcggcatcgccggcgggatcgacgaactcgcccgtgcggcccacctcacgcatgacgttggggtctttaaagtagcgcacgacctcgcagatggcgtcggtctcgcgaatgttggccaggaactggttgcccaggccctcgccctcgttggcacccttcaccaggccagcgatgtcgacaaactcgaccgtagccggcacaatgcggccggggttaacgatgtcggcgagcttttgcaggcggctatcgggcacatcgacgatacccacgttggggtcgatcgtggcaaacgggtagttggcggcaaggccggtctttttggtaagcgcggtgaacagcgtcgacttgcccacgttgggcaggcccacgataccgatggaaagggacacgacagctccttttggtacaggtacttcaaactgcataagtatagcgccgccgcagcatctgggcgaacccggacgccacggcggcacgaatgaagcagagataggggtcgctgactagtccgcgagtttctccacctgatcgagcatcttgtcgagcttggccttcgcctcagccttgaccttctgggcttcttcgtgggccttagccttctgggcggccttttcctcggcctcgggatcgacgacgaccaggttggatgcatcatgctcaaccaacttgagcgcatgctcagggcacaccttgacgcaggctccgcagcccaagcaatacgtggactccagtgcaaagcggccgcttcccaccaggtcacaggcaaacgtggggcacacgttaacgcactcgccgcacgacgtgcacttgtcaaaatcgcattccggcgtgctcacctgcatgttctgggcaagctcggggtggttttgcaacgtcgagagcaccagttggcgcccgtgcgtgagcaaacggcgacgcttggccgacgtggtaccgcacatggtgttgagcgtacgctcaagctgcgtgatctggtgacggtgggccttcaacttctgcgtcaccgaggccagcgccgccgtcgccggattgagcttggtcaccgtcaggcccgtggtgcgggcaatcttttccatgtactccttgcgctcgtactcgcggcgcttatggcacttgaggctcttaggatcgacctccagacccatgcccgtgccggcccactcctcggccttcgcaatcgcctcgcccaagatgtcctcaccgccggtgttgcggcacttatcgcacacgcccagtggcaggtacacgctcacgttgggatagtccgccagtaccgagaaccaggtctcggccgtaatatcgcccacgcaggcaacgacgacctcgttctcgcgcggcatgcgcttaagggcacgcgtgcaggtaacgtaggcggtctcgtggctcgtagccgccgagacaatgtcgtcgtaaaggtttttgggcgccagacgcggcgaaataatcgcctcagtcggacaggcggcagcgcacaggccgcacttgcggcaggtatcgaggatctcgatagcgtcttcctcgacctcgatagcgttgaccgggcacacgtccatgcacgcggtgcagccgctcttttcgtttttgcaggtcaggcacggaatggtgttgccgcgcggacgctccttgtagtcggcaggattccactgcggcgccgatggatcaagtgcatcggtcacgccgccaagcgggtttttaagaaagtcgaaacccttgctgatctcgataatgtcatcaaacagatcgtgttcctgcgccatgcgcggcccctccctgagcagtgcaaacaagcaagagataatgatacgccatcggcccgtgcctcgggcaaattacacgcggagcacctttgcggcaaatagcctatggcctatcgccgccccgattgcacaaggtcaatcaagcgccaagctatgcctcgcacatgagctgcacgagcttttgtttggtcaccttggcctgctcgttggctatgttacgctcgtttctaaaggccgcatttgcaacactctgcaggtcggcatcggaaatctcgccaagacctagctcctcgagcgtcgtcggcagaccaacgcgctggcaaaactcgagtacctgatcaagctcgggcgcacgctccaaacgaagctgcaccaccagaccaaatgccacggcctcaccatgcatggccttgcactcgggcagaatcgtcagaccgttggcgatggcatgtgccaacgccaagccaccgctctcaaagccaacgcccgaaagcagaatattgcactcgatcaggcgctcaaccgccggcgatgtacgccccttttttagatcgcgcttggcagcgacaccgcactccataagtgtgtcgtagcaggcacgagccgcaaccagggccaagtgccccggcgcgccaccgtgctcgttggcgccgtgcgccgcggcacacgaacgcgcctcgaagtacgttgccagtgcgtcgcccataccagcgaccgtcatacgcagtggggccgccgcgaccacgttggtatcgaccacgaccaggtctggattcttctcgagcatcaggtagcggtcgaacgacccatcctcgtgatacagaaccgaaatcgcgctgcacggaccgtccatcgaagccgccgtggggcatacgcacaacggcaactcggcataaaacgcaacggccttggcgatatcgagcattttgccgccgccaatacccactaccatgtcgcaatactcggcctgggcttcctgagccatttcgacaacggcctcttccgtacacggaccgttgtaaattttaaagaaaggctcgctcagattatcgtccagaaatccatcgacgatctgcctgcgcagccgatcctcggtgccctggtcaaacaagacataggcagcgcagcccaaccatgacaaatacctgccctgacgcgaaagttcgcccggcccctgaacataccggccgggaccgccgtaaaccataggaagcgccatacgagaatccgcccttcatcaaacaacgattggtgcaaagtaacctgacccctttgcaccatagcaaaaaggggcaaagccgtctgtcggctttgccccttctttagcttgatttactcatccatgaggtagtagtgacccagtgcgtcggcacccagaatggcgtttgcgaccatctcgggcgtcacctcaaacggcatgttgcacatggtgtcatcgggcgcgcaggcggcctcggcaacaatcatggcctgctcgcgcgtaagctcggcaacgccaagctccttcatcgtgaccggcaggcccagctcaatgcagaagcccaagacttcctcgagtttctcagtcggagcatcctcgagtaccagctggacgatggtgccgaaggcgaccttctcgccgtgatacatgccgtggcactcgggcagcatcgtcaggccattgtggatggcatgagcagcagcaaggcccgagctctcaaagccaatgcccgaaagcagcgtattggcctcgatgatatgctcgacggcaggcgtgagcgcacccttttccagcgcgaccttggccttgacgccatcggccataagcgtctcgtagcagagcttggcgagcgccaggccggccatgccacccttaccgccggcgcaagtgccgccgtcggcatcgtgcgtcgcctgggcctcaaagtaggtcgcgagcgcatcgcccataccggaaaccgtcaggcgcaccgggctcgccgcgataaccgtcgtatccatcaggacaatgttggggtttgccttaaggaagagatatttatcgaactggccgtcgtcggtgtagagcaccgaaagcgccgagcacggtgcatcggtcgaggcgatggtggggcaaatgataaccggggactccaggtaataggcgacggccttcgcggtgtcgaggatcttaccgccaccgacgccgacgatgatgtcgcaaccgttgtcgcgagcgagcgcaaccaggcgatcgacctcacccttggagcactcgccgttaaagtcctcaaacagcagctcggccttagcctcagcaaaaccgccctcgatcttggcaccgacgcgcttcttgcccgaaggcgtcacgatgacgagggccttagcgccgagcggctcgacataggagccgagcttggcgagctcgtccggaccctggatgtacttgctggggctattgaaaattgcagccataactatcccattctctaaaagaaaaaagaaaggggctccgtacagatacgtgcggagcccctcgttacgataacaagagtcgattagaaatcgatgtcggtgtcgtagtagcaggccttgagaatcttctcgaagtcggcagccttggtctcacgcgggttctcgggcgtgcaggcgtcctgctcggcgttcgcggcgatctcgggcagcttggcgaggaactcctcctcggaaaccatctgcgggttctcggcgtcgaccttcacgccaccatttgcgtaatccttgatggactgcgggatgttgagctggtcgttgaggtcgcggatcttctggacgagcgcagcgatgagctcctcgttggtctcgccgggaaggtgcaggatctccttggccacgtaagcgtaacgctcggcagcacggggatccttggagttccactggataaccttgcccaggtacatggcgttagcagcaccgtggatgatgtggccgttctcaaaggctgcaccggtcttgtgagccatggagtgaacgatgccgagcaggcccgaggagaaggcgataccggcgatgcactgagcctcgtgcatgtgctgacgggcctcatggtcgccagcataggacttgggcagccactcgacgatctcgcggatgccgtgcagggcgttggcatcggtgaacatagaggcgaaggtagaaacgtaggcctccatgcagtgggtcagagcatccatgccggtgtgagcgcacagcttggcgggcatggtgtaggtgagctcggggtcgacgatggcgacatcaggggtgatgttgaagtcggccagcgggtacttgatgcccttggcgtagtcggtgatgacggagaaggcggtaacctcggtagcggtaccggaggtagaggagatggcgcagaagtgagccttctgacgcagctcggggaagctgaacggctggatgatgttatcgaaggactcctcgggatactcgtagaagacccacatggccttagcggcatcgatgggcgagccgccgccgatggcgataatccagtcgggctcgaactcgcgcatggcctcggcgcccttcatgaccgtctcgatggacggatcggactcgacgccctcgaacagcttgacctcgaagccgccctctttgaggtcggcctcaacgtcctgcaggaatccgccgcggcgcatagagctgccgccagaaacgatgatggccttcttgcccttgaggttcttcacctcgtggcgagcgccctcaccaaagtacagatcgcgaggattggtaaaacgtcccatactgtgcctcctaaacaagcccctcttagacttgcgtatataacggagcacccgattggctccgttaggaccgttttgcgcgttgccggcgatgacaatgcgcgatgtctaaacgtctcaacgctcagacaaacactattttaccgttctggttggtcagttattcacctaaagccgacaatgatgaaacgttttttctatccctgaagacccttgtggggcattcatactcccaagctgggcaaacgttttatcaaggttgaccacatatcccgggcaggacggtgcccctccaaaatgcgccccgttcgccgccaaaaatcgaccgtttgcggcaccgtgataccactcagtcgtccaaggcgccgacatttgtgcgacatccgtcttcgtggtgcaaaggtgcatgtccaagtgcggcacccccggtgtgccacatgcgggtaaactagaaccttatatagagacatttgaaccctaaccgcagcaaaggaggccccatggcattcgatcccattcaagaggattgccatcgcctcgttcttgaggccttgcgccgcgacaatatcccgctcaccgacggccccgccgtcgagcgtctgatggagcaattcacccgcaaccccgcgccgctcatcgtgcacgaccgcgaccgcgccgggcatctgattgccaaggtggtcgaggccgtcgactaccgcattccctttatccccgacgatgcccaagccgagcaggaagaggccgctgccgagaacatgcttcgcgaggccgccgcactcgatccggccaactgggatgcgcagcgcatgttgtgcgccctcaccgctgactccaacgaggaatacgtgcaatatctggtgtccaagtgcgacgaggtggagcacgacctggcgctcaagatcgcctcggcgcaggacccctacgagcgcgaggctgcaggcgacctgacccgccgtccctacctgcgctggcttgccgccttggcatcgcgcgcgctcattagcggccgctaccgcatgtcgctcgaagccgcaaaccgcagcctcgactttgcccccaacgatcctgccggcgtccgccacaccgcaatgctcgccatggcaaagctcgaataccccgctgaggagctcaagcgctttcgctctgcccactccgtcccctatctcgccaacacgccgctgcgccgtcgtcccaaggatgcagaacgcgacttggacccgtggacgctcatcgcgctgatgagcgctgcctggcgcgagctggattacgagggcgccgaacactacctgcgtatccttgcgcgctcgtgcccgcacgcagccgaggcgctctacttccaaaccgagtttcccgatggcgtctatgcccgcgtcaacgtgggtgcaggctccaccgacgagctcgtccttgcactctccgaggcgacgccggtactgcaggagggcctgggcgcacccgacaacgccagctttgccgcctgggtcgccaccaacgacatcgtgcgctcccagatcgacgagcgcatactgcgggcggccgagcagggcttgccgtttaagggaggagacctctaatggatccgagcgtctacatccccgcctacctggagcgcacctatctggcgtcgcaccccgagctcaccgatgcagcacgcgagcttgtccataacgacattagcgcgaatccccaaaagtatgcgcagtccgagcatgctcaggcgctgctgtcctatgccggtgttcatcgccacctgctcgacgagctccatcgcatcgaggacatgggcagcgacgaggagtttgagcagacgcgcaaccgcttgttcgacgatatgcgtgatgagctgctcaagatcgtccgcatcgatgcgcatgtcctcgatgcccagctgctcgccatcattttggccgacacgcccgttgacgcttgcctgggcgacctgatgaagctcgaagcgagcacggccgactacctgcaacagggcgtgcccgggtttgatatggaggccccgcactactgggccaataatgttttggccgacggtgtcaccgcagcggaccttaccgtgagcgagccggcccttatcgggtggcttcacacactcgaggccatctcgcagctgtgcatggcgagcgctcgttaccgcgccgccgccaactattctcgccgtgtccttaaggcggagggctattccacccgggccgccggcaccgtattgcttgccctcgcccgcttggaagaccaggacggcttttttgccctggcgcatcagctcgaggaacagatgggggcagacgcactcgaaaactctccttggtacttgctcgcccgcacgatcttgctgttcaaaacaaacaagatgcgcccggcgacgcgcgcgctgcgtgagttcgctaaccgttgcgagggtggcgcgttcttcttgctgaaccccatgtaccagacgccgtatcttccctgccgacccgagccgcgcgacccctgggacctctcgcaccaggcggtttgggaagccgacggcattatctcggacaccccagactttgccccctgggccaacgcctgcgaagatgtatcgcagctcgcccaggaatttgcgcgccgctacggcttttagcgacgcgatcgccccgactatgtcattcacgttaggaacgacttcatgaacttccgctcatctctcgcctgcacctcgagcgatatcgcccgctgggggctgcgctctatccttaagcgccagggcggcgtactccccggccgcatcgccatgaagatcgaccccgagttgctgagcgacctcgccggccttgtcgaccgcagcgtggtgattaccggtactaatggcaagaccaccacctccaacctcatcgctgacgccgttgctgccagcggcgctaccgtggtgtgcaaccgtgccggcaacaatatggagcctggtgtggtgggtgctctgctcgaggcccgcggcggccttaagcacaccagcagcggcaagcgcgtgggcgtttttgagtgcgacgagctctacaccgtacgcgttctgcccaagctcaaaccgacgtactttgtgctgctcaacctgttccgcgaccagctagaccgctacggcgagatcgaccacacccaggaggtcatcgcccacgcgttggagctttcgccggcaacgacgctcatctacaacgccgacgacccgctgtgcgcctcgattgccgcgcgcgttcccaacgcgagtattgcctttggcatcgatggcgccacgggcaccgagtccgaccgcattagcgactcgcgcttttgctcgcagtgcaacgccccgttggagtacgactacgtacagtatggtcaactcggcgcctaccattgcccctcgtgcggctgggcccgccctgcgcttgtccgtcgcgtgacgggcgtggaactcggctgcgacggctatggttttgacctggtgtttggatctgattccagcgcgccagccgcacacatcgtcacgcgttacaacggcctgtacatggtctacaacgttgccgctgcattctttgccgcacatgagttaggcgtggacgcggcgcacctgcagcccacgcttaatgcctacgtgcctgccggcggacgcatgggccgctgggatattgccggccgcaccgtcgaggccaacctagccaagaatcccgtgggcttcgatcgccagatccagtccattaaaacggcaggtggcaggctctgcgccttcttcctgaacgataacgatgccgacggccacgatgtctcgtggatctacgatgtcgacttcgagcgcatcgccgacacgccgggtcttgtcgcctttgccggaggcacgcgtgcgcacgacatgcaggtacgcctcaagtacgccggcatcgatgccgcgattatctcggacgtcgcgcaggcgatcggcgccgtggcagacgaggccgccgatgacaccttctacgccgtcgccaactacacggccttcccgccgctggtcaaggagctcgacgggcttaagggcgccgatgcgagctcggttgtctcctgcgccgtaacgcccgccgatggtagcgctgtccccaccgatattgtgccggtcgagctttcgcgcccgttgcgcatcgtctacctgtatcccgatgcgctcaacctctacgccgacggcggcaacgttatcgcgctcgaacgccgctgcgcctggcgcggcattcccgtgcgtgtggacgaagtccacatgggcgagacgctcgacctgaccgacgccgacatcgttatgatgggcggtggctccgatcgcgaccagctggcggttgcacatgaactgctcgctcaaaaagacaaggtcgcggcctatgttgaagacggcggcacactgcttgccatctgcggcggctatcagctgctcggccgttcgtactatatgggcgagaatcgcatcgagggcctgggcgtcattgccgccgagaccgtgcgtggctccgaccgcctgattggtaacgtcgccgtcaagaccgacctagcgcccgagcccttcgtgggattcgagaaccacggcggccgcacgcttctggatgccgatgccacgccgctcggaacgtccatcgtcacgggcaccggcaacaacggcgacgacggttttgagggcctcatctacaagggcgtcatcggcacgtacctgcacggaccggcactgcccaagaatcccgaactcgccgactggctgatcacccacgccctcgagcgccgcggcgatgcgcaggccacagccctgctgccgctcaagcccctcgacgacacctacgaacacgccgcccacgacgccgccatgaagctcctcccctaaccaccacaaaggggacaggcacctttgtggtggttttgacccatcccgttggttttctaacgcccaccaaatgttcgcagctcagaggctatgtcctctgggctgttttgttttatgtcgctaaatccgctggcagttccaaccgtcatcgcaacgtaacatcaattcacctgacgaatggcagccaaatatattcaataccccaacatcaacaatagccaggcacaaaactgcgccgcaagctgctccaaccgcccaactggtcaaaagccgaccatctacttgccaatttatctaacggcgtaaccaagcagtccgagccgcagcttctcagcaaaacgccgcgatgtctgcgccctgcggtatccttgagccacttgcacctgcagaaccaaggagccgccatgcgcaccgagctcgatgttcccttttcacgcaaagaagaagccaaggcgctgggcgccaaatgggaccggatcaagaagatctggtatgtacccagcggcgtcaaccccgagccctttgccgagtggctgcccggtgttgaccgatccgacccctcagcgccgtatatatatctagtactgggcaagcgcgagtgctggaagtgtcacaaagagacctcggtcgcggccttcggcattccctatcgaaccgatagcgacgagagcatcgtcatcgcgcacgcgcccaacgaagccgggcacattgccatcgacacggccaacgccaacgcactcgccatcgtgcccgctcttggccgcgtgccgggcgagatccgcgactaccttcataagcgctgcggctacaagcccgtaggcgcgcgagcctccaaagccccgtcgctcggcaacacgtgcaccagttgcgacgcgctgcaaggcagccgctatctgttcgaggagccctcgtccccgtttgccctcactgccatcaacaagctgccgacactggagtttgtacgcgtcgaagttgccggcgtctttggcgtcccggccacgcgcaccgactttgaccaggcgctctttacctgggcacgcgaccatcacaccgagttccacaggcaactcggtgagggggtttacttatagggacagagatgccttcacagccagctcctccgcatcacctatccctcgtcgccggcgtcatacacgatatcgaggccacaaacagggcatttctcctgatacaccggcatatgaacgcctgtccgttttctcacttcgtcgctaagtctgtcgcacgcatcgatgaaccgaatgtcgaggcacggtatttgcgagccgcagcaaggacaggcgacgacaaacgacccgcaatcaacttctacgctcggaaacattttgttgtctataagggcgcacggcagttttccgtacttccccatcgcaatatcgcctcgccagctcacgttcgctcccctctcgctatacaaatcaggaagagcatgcaccggcaggcgtgtgcgagattgcatcgccacgcgatccgatcaaacagcacgatcgaaaaagaccgccaaagccaaatttcatcgtcggtcgcaccctgtccggcaaactcaatatcgacgggtatgtgcttcagataactcatgtcgggcgcaaaacgagggtccggtccgcctttatgaacaggaccgtgcagaacaaaccatccgttttcgggctcgaaccgctcaacaaacgcaaggccgagcaccttatagcccacctcggttgcaaatatgactccgactggaacgccacattccatgcagttgagcattttacggttgtaattctggtctcgaaaaccaacggtacccggcgcttgaaccgagtacttaatgacccacgtaccatcgtccaaatagagcggaggcacattgttgatgctctcggcttgccgctggcgtgcttgtaccccgctaccccactcccctgtatactgatgtagcacgtgtttcatccgggcttgttgggccggattgttcatgggagggtcttatggctgcttcgaatccgcctaaggggagcgtttcttcttcgtccatcaagccggttacgcgcaaggccgtgcgttgccagcgcgaggtcgcttggcttgtcacgcaggcggcgggcaaactcgtggcgaacacggaagacgtcaatgctcccacaccgagctttgtgctggcagcggcgctggatcgagtacgccagctggaactcgccgcacaagaagacggcggccatcttggctaccaagacgctatggcgcccgacctgttgaccttttgtcgcatggccaagttgcccgccgcgcccaatgcgctttcagacgtaggctacatgtttacgctttcgggcgcggaccttatccgcgatatctacgcatactgcagcgagctcgccgagcgccacgtctttggcacggctgaagtcaaaccgggaaatgtcatcaagctggttctcaggctgttcctgatggacggacacgaggctgcgcaggaataagtcgtccggcagagccattaccgatccggcggtgacgccttgccgtagccgtcaccgcacgagcgaggattttcggacggtcggatatcgagagtggatatttgaacggtttttggggcttttgcggcagattccgtccaaatatccactctcgatcgataagtgtccgaaaatcctcgctcgtccgtccgaatatccactctcgtttggcgagtgtccaattttccacgctcgcgcgtccggatatccacgctcgtgcggcgggcgaaccgcgagtgatcgacgatcagccggcatcgtctccagttcgccgcagtgccgcggccccatatgggtatactctcgaggattcgactcgattcgcccccgctggggcgtcaaaggagactgcatatgcccaccacctcaaccgacccgcgcgccgctgccgccgcgctgctagtgcccggcactacctgccacggctttgccgtcgagcgctgcgagaccgtgcccgagctcgactcggacgcctatgtgctgcgccacaccgcctcgggcgctcgcctgctgtacctggcatgcgacgacgagaacaaggcttttgccattggctttaagacgccgccggccgattctaccggcgtgttccatattctcgagcactcggtactgtgcgggtcggccaagttccccgtcaaggagccgttcgtcgacctgatcaagagctccatgcagacgtttctcaacgccatgacctaccccgacaaaaccatctaccctgtcgccaccaccaacgagcaggatctgtacaacctgatggacgtgtatctggacgcggtgttcaacccggccatctataccaagcccaccatttttgagcaggagggctggcactacgagctggacctgccggagagcgtcgagatcgagggcagcgacagctccgcgagcctgcgcgagggcacgctgcgctataacggcgtggtgttcaacgagatgaagggcgcgctgtccgatcccatgagcgtgctggacgacgccgtcaacgccgcgctctatcccgacaccgcctatgcgcacgaaagcggcggcgacccgcgcgcgattcccgcgctcacctacgagcagttcctggacacgcacgcgcgtcactacaatccttccaactcctacatcacgctctacggtgacctggacgtggaccgcgcactggcctttttggacgagcgctatctgtcgcagccgagtgccgcgagccgccgcatggacgctgccgtcgccgccggcgaggacccgtccacgctggcgcccaatccgctgggcgtgcagacgcccgtgacctgcgagtacaagcgcgtcgagatggccactacacccgagaacgccctggtgggcctgggtctggtgctgggcagcgcgctcgaccgcaagcgcacgatcgcggcggatatcctgtttgaggcactgctgggctccaacgaagcaccggttaagaaggccattctggccgccggcctgggcggcaacgtggtgagctacaccgcggccgagagcctgcagccctacgagctcatcatgctgcaaaacgcgcagcccggcgtggcgcgcgagctgcgtcgcatgttccagaacgcctgccgcgacctgtgcgagcacggcgttccgcgcgagcgcctggaagccatcatcagcagcaacgaatacgatctgcgccagcgcgactacggcatcgccgacggcgtggccattgcgtgcgacgcgctgagcacctggctctacgatgacgacgccgcgacgctggcactcaagtacggcccggtgtacgaggagctgcgaggcgagctggacggcagctattttgaggacctgctgcgcgagctggtgctgcagaacgatcacatggcgctcgtcgagctggtgccggtggacgccgccgagggttcggagggtgccgaggccatcgagctggcagccaagcgcgacgccatgaccgattccgagctggccgacgtggtcgagcgcacggccgcgctgcgtgccgcgcaggaagccgaggacacgcccgaggacaaggccacgctgccgcgcctgcgcgtgtccgacattggcgaggcgcgccccgaaccgtcactggtcgtggacacgaccgcgcccatcccctgtctgcgccacgacatccctaccaaccgcctggcctacgccatgcagtatttcgacctgagctgcgtcgcgtttgaggacctgccctatgtgacgctgctctgccgcctgcttaagcagctgtccacgcgcgagcactcggccgaggaactcgacaacttgctcgctggcaagctgggctttttgagctttacgaccgaagtcatgacccagcccgacgtggacggcgtgcgcccctacctgctggtgagcgccggcgccctgtccgagaagattaatgcactggcgagtctgccgcgcgaggtatggtcgagcacgcttttggcagatgccgacgccgaccgcgtgcgcgacgtgctcacgcagattcgcattgggcttgagcagggctttatcaacaacggtcactcggcggcgctcggtcgcgcgatgagctacagctcgccttcggccgtggtgcgcgagcagctttcgggcgtggacttctacctgttcctgcgcgatctgctcgaccactttgacgagcgcctggacgacctgcgcgccaagcttgccgagctggcaggccgcatctttgtggccgatggctgcatggcgagctttaccggcagcgatgaggactttgacgcgtactgggatgccgcgggcaacctggggctgggtgcgggcgatggtgccggccgcgacgcgctcgtggtgccggcgccgtgcgaccgccacgaggcttttgtcatccccagcgacatctgctttgcggcaagcgcgtgcgacccgcgtcgcctgggcattgacgtgacaggcacttgggccgtggctgccaacgcgctctcctacgactacctgtggaacgagatccgcgtgaagggcggggcgtacggctgcggattccgcgcggcaggtgagcgtcaggcggcgttctacacctaccgcgacccggcgatcgatccttcgattgagcgcgtggagcgcgcgggtgcatggcttggcagctttgagcccgacgaagccgcctttgagggctttatcgtgagctgcgtgagcggcatggacgcgccggtgaagccgtacgcgctcaccaagcgccgcaacacgacctacctggccgggctcgatccgcatgcgcgcgaggagcgtcgcgcccagatgctcgccgccacgcccggtgagctgcgctcgctcggcaccgacgtgacgcgcatcgcagccgagtcgcccacctgcgtctttggcggccgagacgtcatcgccaagagcaacgccggctttaacgtcatcgacctgctcggctagccacagcaagcaaaaccaccacaaaggggacaggcatctttgtggtggtttcgacatttgcccagataaaacctgccaaaataaacctgtccctttttggtaggtttgggagagggggctgggatggataaggctgagttgcggcgggcggtgattgctcggcgcgatactcttgatttggacttgcgggcggcgaagtctgccgttatctgtgcgcagcttgttgagctgttggagcgctcggattcggcgacgccgcgtaccgtcgccgtctatgccgccatgggttccgaggcaaacccagccgcgtttgccgccgcggccgccaaacgcggctggcgcgtagcctatccgtgcatgctctcggcaattgatgccacagcttgtggccagcgcatgtgcatgagggcagttgccgccgacgatgcatccacgacaccgtttatcgcccaccccacgcaggccttcgcggccacggacatcgacagcagccgcttccctatcgtgcccgccgaagctctcgacatgatcgtcgtgccgctcgtagccttcgaccgcgccggcgcacgtctgggctacggcggcggttgctacgaccgctacctgtccacgctttcgaccacatgtcagatcatcggcatcgcctttgacgaacagcgcatcggccgcgtccccaccgacgcccacgatctgccgctgcccaacatcatcagcgtctaaccgctggcgggctgcaccccacaaaaatgagcgtggaaaatctcccactttgagcccccttacgagccaaaaacgggagattatccacgctcatgtgcaaacgtccgtttttccacgctcgtccgtccagatttccacgctcgtccgtccagatttccacgctcattcggcaagcgtccgaaaatccacgctcgtatgtctgaaaatccacgctcaatcaatgcgcgtccagatttccgcgctcgtgtgtccgattatccacgctcgtgcagcttaacgccccgcaaccgcctcaacatgcacgcggcacgccggcaactttgagcttgcgatcgagctttgtcgggtccctcagatcatcccagcacaagcgcacaatcttacagttatcgagcatcgaaagcctcgactcgcgctggcgctcgtcaaattgcgcctttgcgagcttgccctcctccgccgccttctcgcttttaacgaatccgtcaaattccccgatgatcagccgatctcccacgcgccacaagtagtcgacgcgatacggccgtcccggctcaaccgggtcgaacagctcaatttgcagctccggcgtctgccagccgcgctcgatcatcagggcgcgcgccttggactcgccaccgctttccgacaggccatcggcataccgtgcaaccctgcgcgccgtcacaacaccgcgacgatttaagccgagcttgtcgactgcctcaacgagatgctccttcgacaacagctgctcatggagcgccgagtccgcaatgatcagccccctcgacaaacgacgcgtcgaccaggcaatccgtaatcgtttgatcgatatcggtcatggcaatatccatttgactggcccgcgttcgataagcataacgatggcgaatgacctgagagcccggcgtcgtcgattgcgccggcatcgcggcgatatggatgtgcgtcaaattggcatgcgaaaccgaaagaccatagataacagccgccgtataggagcaaaacgtccagtcggggtgcttttgcgcaagcgcccgcacccgatgcagataacgttgccgaaacttgagctcggaccagtattccggacgcgcatacaaccccggcatgaccacctcgagacttcccgccaccacccgccgctcaatctgctttgcctccgccgtcgtgcgcgcgtacacgcagctcatctgctgctcgcaagctttaatgtggcttgtgagtctttgattcgccgtcatgtttgccatgtcgcctcccaactcttggaacggcgccaacgtaccaggcggtttcatgcgaagtctgaccaaatgccaaccaaaagctgaccaaatgcttgacggttttgaacgctttaggttaatggcttatatctgcaggtagaacggttgtcgagaggtccctgtctccacattttgagcctcaaaagccaccgacttcattgaaagaaaatatgccgtggatcaaaactacctagtttgcgatgcggcccgtatgtactcgacgcatgatgctgccgccggtacaacagctgcagaaaaatcgagcgtggaaaatctcccgctttgggcccccttacgagctaaaaacgggagattatccacgctcattcaacatgcgtccgattatccacgcccgtgtgtccgattatccacgctcgtcgcgtagcggccacgataaccgccgcagccacagccacgacagcggcctagtgctcttcgccggcgcgagccaggtcgtagggcgtggtctggtagacgtagtagttgagccagttggtatagagcagctgagcctggctgcgccagacgttgcgcggctcggcggtggggtcgtcacccgggaagtaatgcgccggcacctgagggttgagcccgcgcttcacgtcgcgctcgtactctaggcgcagcgtgtcggtatcgtactcgggatggccaaagacaaagaagcggcggctgtcggtcgacttgacgatatacaggcccacctcgtcggacacggcaacaacctcgagctgcggctcggcctccacgtcctcgcggcgcacgtcggtgttgcgcgagtgcacggcatagaagcggtcgtcgaagccgcgcaccagcgggctctgcggcttcaccagatgatgctcaaacacgccgctcgccttagccggcaaatcgtacttctgaatgccgtagtggtggtacaggcccgcctgcgcgccccagcaaatgtgcagcgtggagtgcacgtgcgtggtggaccagtccatgatctggcagagctcgggccagtagtcgacctcttcgaacggcatctgctccaccggcgcgcccgtgatgatcaggccgtcgtagtggatgtcgcggatgtcgtcgaacgtgcggtagaacgtctccaggtggccggcgctcacgtgcgtggcctcgtgcgtcttggtgcgcagcaggtccacctccacctgcaacggcgtgttggagagcttgcgcatgatctgcgtctcggtggcgatcttggtgggcatgaggttgaggatgagcacgcgcagcggacggatgtcctgatgcagcgcgcggtactcggtcatgacaaagatgttctcgctctcgagctgcgcggcggcagggagggcgtcgggaatgcgaatgggcatggatgctccttacgagtcagttgcagctatggtacaacgagcggccccattcgcgcgagcacatcgcccagcgatgccgccagcggcccaaatcgccgcaaaagtagagattaaggcatgtcccaaaaatctaaggcactttagtctagcaaagtgacggcaggacgctacaatgtttcaacgcgaaaaactcggccgaaaggatactcatatgtaccagacgcgtaagatcggtgtggtcggccagggccacgtaggagcacatgtcgccaacagcctgcttatgcagggcattgccgatgagctgtacctgtgcgatatcaacgaggccaaggtgacgtccgaggttcaggacctgcgcgactccctttcgtttgtcccgtataacaccaagatcgtcaactgctacgaccactacgaggagcttgcctgctgcgacgtcatcgtcaacgccgccggtaaggtcgcgctggccgccggcagccgcgatggcgagctgttctttaccaccgacgccgcccgcacctttgccaagcgcatcgtcgacgccggcttcgacggcatcttcgtgagcatctccaacccctgtgacgtcgtgtgcaccgagctgtggcacctgaccggctacgatcccaagaagatcatcggctcgggctgtggcctggattccgcccgactgcgcaccgagatctccaagaaggtcggcgtgagccccaagtccatcgacgcctacatgatcggcgagcacggctttagccagctggccgcctttaaggccgcaaccatcgccggcaagagcctcatcgagcttcaggccgagaaccccgacaagtacgccttcgaccacatggaggtcgaggagctcgcgcgcaagggcggctacgtgacctaccagggcaagcagtgcaccgagtacgccgtcgccaactccgccgcgcgcgtctgcgccgccgtgctgcacaacgagcacgccgtgctttccgcttccacgctcatgaccggccagtatggcgaggaaggcatcttcacctccctgccgtgcgtgatcggcgccgagggcgtcgaggaggtctacacgctcgacctgtccgagcacgagctcgagggcttccacaagagctgccagcacatccgcgacaacatcgcccagctcgactggtgggacgccgaggcctacgacgcaaagtaggccgtagctggtctggcctcacatatccaagtgccatgcaaagcgggccgcgccggaaatccccggcgcggcccgcttttttggctcacgcagcgcacttgcaaatccaaggtgaatacttttccaaacaaaccaaaaggggcgccacaacgcaaaacggggcctgcgcttggcgaaggccccgtcgtgagagattgttcctcggaaaattagtactgctcgatgcccatgtagcgacgaacctcggggctgtggtcgaagaccttgccgcgggcggcgcgcagctcgcagctcatcgcatagaagaagatcggctccaggaacgaacgcacgctggcgggcacgtcgcccacgccgtactcgagcgcgtcgagcaccatgatcgtgtcggtgtgcgtgttgaggaacgcaagcgcgcgctcctccatggggcggcactcgcccgcgccgagctgcacaaagtagaacacgccgggctcggtggcctcgaaggggccgtggaagtactcgccggagtgaatgtagcagcagtgctgccactgcatctccataagcgagcagatggccatggcgtaggtctggctaaagttggggccggaacccaggatgtagaagaacttgtgctgctggcaaagctcggcaaagcgggcgcccagctcggcgttgaccttctcgcgggcggcgggcagcagcgcgtccatctgcttaaggccttcgtacatgtcggcaagcgcctcgtagccctcctgctgatcgagcagctcggcggcaatcagagcaccgatgccctgcggtacctcggcctgcgacacgccctcgccccaggggtagacccaggtggtccacttgccgttatcgatcttggagccctcgcagtcggtcatggcaacgacctcggcaccggcggccagcgccatctcgcaaccgtcaacaacctcctgcgtgttgccgctgtggctgcaggcgatgacgagcgacttctcgccgaggctcttgggggccatcaggcagaactcacgcgcggtgtagaccgtcgaggtaaacgtggtggcctcgcgcttgagcagctcgttagccggcatcaggtcgatcatcgaaccgccgcaggcgatccaaaagacattctcgaccttgcccttgcgctcgataatttcctgaatcagatcatgtgcgttcatgctgatgctcctccttgtgtggtggcttttggtgacggctgctcgtacctgcggtcgttctatgttgtcctatttatagcacgcaagctgtcgtgggtgaagtcatttcgccaaacttgttctatgttgttctatctgtggacgttagatgtcgaagacgtagcgcgagcccacaatcttttggcgaccgagcaacagagggtgcccaccggcgtcggtaaagtaggcctccatatagaagagcggctcaccgaccggcacctccagcagcggggccgtttgggcatcggcaagcgcaatctccacggtgcaggggtcggacttgagcggcgcgcgacccgaatgctcggcaacgagcgcaaagatggaattgtccgtgaggttcttgtcggcaagcgtctgcagatagggatggtcggcgagcacaaaggcgttgttctcaagcatgacagggatgccgtcggctgtgcgcacgcgttcgaccacgataagctcgcagccgggctccacgccaaagaacgccgcatcctcgtgcgtcgctgcgaccaccgtgcgcgacaccagacgcgcacccggcaccatgtcgttggcagcacaaccctcagtaaagctctggacgtcacccttctggcgaatcttgcgcttgagcttgggagcgcacacaaaggtgcccctcccctgctggcggttgagataccccgcacgcgacagctcctcgatggcgcgacgcacggtgacgcgccccacgccgtaggacttcgcgagctccatctcggaaggaatacgcgagccggccacgtacacgccgcgcgcgatctcgccctttagatcgtccatgacctgctggtacagtggcacggcggacacctcggcgcgctcggaacgttcggtcttgctatcggctaccatcgttacgctccatcccgcgcatgctcggactcaaattcttcaatcgccgccataaactgctcgccaaaggcgtcggcctttttctcgccaatgccgttgacctggatcagctcgtcgcgcgtctgcgggcgcaggcggcacaggccgcgcagggccttgtcggagaagaccatgtacggcgccatctccagctccgtcgagatctccttgcggagggcacgcaggcgctcgaacagctcggcatcgtcgcccacgcgcgggcgttgatccagctcggcctcctcgcgcagcagatccaccgcacggcgggcgcgggccgaggccttgcgcttggacgcgcgacgcttaacggtaaaggcaaacgcctcatcctcgacctcggtggcacgcgggcccagccccacgaccgggtattgcccctgcgaggtggccaggtagccgcggccgcacagttggccgatgatgtccttgatgcgcccgaccgattcgctcgacagctcaccgtagccgcggtcctcgtccagatgcatctggcgaatgcgctcggtgttgccgccgtggagcacatcggcgatcagcgacttgccaaagcgcatgggacgcgtggccacatagcgcacagcggcgcgggccatatcggtgacgtcttcgacctcgaactgcgtcaggcagttgctgcagttgccgcagccctcggcgtcgtccgtggcggtggcgcccgcaccagccgcagcagcatgctcggccgcggcctcgtcgccaaagtagcgcagcatgtattcgcgcaggcagcccgtggtattgcagtagccctccatctggctgagcagacgatatcgattctggagcgcccacgcgcgctgctcatcgtcaagcgcctcgtcggccgcatcgccgcggtcgatcaaaaagcggcgcatgcgaaaatcgttgccgttccacagcaggtggcagctggccgggtcgccatcgcggccggcgcggcccgcctcctggtagtaggcctcgatgctctcgggcacgttgttgtggatcacgtagcgcacgttgggcttgtcgatgcccatgccaaaggcgttggtggcaaccatcacctggatgtcgtcgtcgataaaggcgcgctggctttggcggcgggcgtcattgcccatgccggcatggtagcggccaacgcgaatgccgctggggcccagcgcttcggcaagatcgcctgccagcgcatcgaccgtcttgcgggtcgagcaatacacgatgccgctctcgctcgaatgcgcgatcacgtagtcgcgcacccaggcggtcttggccttgtcgcccatctcttcgcaaccaaagtagaggttcttgcgatcgaagcccgtcaccaccgtcgccgggttttgcaggccgagcatctgctgaatgtccgtgcgcacgcgctcggtcgccgtagcggtaaacgccgccacgatggggcgctgcggcagggaatcgatgaactcacgaatctgcagataggcggggcggaaatcctggccccattggctcacgcagtgggcctcgtcaatggccacgagcggcacgccaatgccgccgtccgccgcggcctcccgcgcaaaggccaaaaaacgcggctcgagcaagcgctcgggcgccacgtacataagctggtagcggccctcgcgcgctcgcttgagcacggtgttttgctgggccggagtaaggctggagttgagatagctgggtcgcgcacccgccgcgagcaacgcacgggtctggtcctccataagcgacagcagcggactcaccacaaaggtgatgccgagcagcatgagcgcgggcacctggtagcaaatggacttgccggcgcccgtgggcataacacccagcgcatcgcgaccggcaagaatcgcatcgaccatgcggtcctgccccgggcgaaacgaggtgtagccaaaataggcgccgagcgtgtcgagcgccatctgctgcatgctatcggtcatggtttcctaacgtccaagtcatctgccgccgattatacgccgccacgcggacagcagcacacggccgccgcccagactagtcgtttaagaacgcccccaacggctaaggagtgtccccaggtgccggcagaaaaggaacgtccccaagtgccggcccggcaacgccgatgttttggcgcggacagcgaaagcccgccagagcgagcaaggtgccttgaaacgaggcggcattgaccttctggtcatgccgccgaagttgaaaggcagattgccgcaaagagaagaggcggggcatgccccgcctcttacaccacatctctgcgcgctaccgtcgaaatggcgatgaatgcacgattttgatccagctgttagtccttataatggacatatgttgcgtaacttaagcaaatactatctttttatacgttgtaagcaaggtagcagtactcatttttgccattttttggccacgacctttgtgacagacgtgctggcgggttcgaatcccatgaaataggcccaaacaaaaaacggtcccctttcgaggaccgtttccaaatcagtggtgggcgatgagggatgtccgcgtgcggctggcgccgcccgcgccccgcttcgtcgctccgctcctcgcgtgctgcgctggaaaacgcttcgcgtttcctcagctccgcacccttgcgggttcgaatcccatgcgctgagcccgaaaaagaaaggcctccagtgatggaggcctaacaaatcagtggtgggcgatgagggattcgaacccccagccttgtgcgtgtaaagcacctgcgctaaccgttgcgccaatcgcccgtgcggagagagtatagcaaaacaaccgcctcattcatctcatatccattaaaggtaaccggcacgtgtcacagcggagctgattcagttgagattgcctgaacattccgcccctctttacgccctcgggtatactcaaaagctactgattcgatttgatgcccagcaacagcagaggggatagtatatgtgcggttttgtcggttttgtcggtgggacggataaccaatccgaggtgctcaccaagatgatggaccgcatcgtccatcgtggtcccgacatgggcggtcagtttatcgacggccgcgttgccctcggcttccgccgcctgtcgatcctcgacctgaccgaggctggcgcccaacctatggccaacgaggacggtagcgtcgtcattgtcttcaacggcgagatctacaacttccaagaactccgttccgagctcgaagccaagggctacaagttccattgcggcgccgacaccgagagcctcctacacggctacgaggagtggggcgaggccgttctcgatcgcctgcgcggtatgtacgccttcgtcatctgggacaaaaagaagaacaagctttttggcgcccgcgacatctttggcatcaagccgctttactactatcccatggccgatgcgggcgacggcgctccgggcgtgctctttggttctgagatcaagagcttcctggactacccgcacttccacaaggcggtcaacaaaaaggccctgcgtccgtacatgacgctgcagtattcggcaaccgaggagaccttcttcgagggtgtctacaagctgccgccggcgcactactttaccgtcgatatcccgaccggcaagatgaacatcgagcgctactgggattgcgattactctgccgtcgagaagccgttcgaagagtatgtcgatgagctggacgaggtcgtgcacgagagcgtcgaggcccatcgtatcgccgacgtcaaggtcgcgtcgttcctctccggtggcgtcgactccagctacatcgccgcttgcctcatgcccgacaagaccttctcggtaggcttcgattacaagaacttcaacgagaccaactacgccaaggagctctctgacaagctcggcgtcgagaacgtccgcaagatgatcaccgccgacgagttctttggcgcgctcgaggacattcagtatcacatggacgagccgcagtccaacctgtcgtccgtgccgctgtggttcctggccgagatggcccgcaaggacgtcaccgtcgtgctttcgggcgaaggcgccgacgagctctttggcggctacgcctattacgaggacacggttccggtgcgcaagtacaaaaagatggtgccgctgcccatccgtcgcgcgctcggtaacctggcgctgcacatgccgtacttcaagggccacaatttcctggtcaagggtgccgagatccccgagaagtcgttcctaggacaggccctggtatggccggagcgtgaggtcgacggcgtgctcaagcccgagtacaacaccggcgacggcgccttcgagctcgccgcccccatctacgcgcgcgtaaagggtcagcccgagctggtcaagaagcagtacctggacatgaacatgtggctcccgggcgacattctgctcaaggccgacaagatgtgcatggcgcactcgctggagctgcgcgtgcccttcctggaccgcaaagtcatggagttcgccgagcacattcccgaccgctaccgcatcaacgagaacggcaacaaacaggtactccgccacgctgccaacaagtcgctgcccgatgagtgggccacccgtcccaaggtgggcttcccggtgccgattgtctactggctgcgcgagcaaaagtggtacgactatgtcaaggagtacttcaccgcgccgtgggcaagcgagttcttcgataccgacgagctcatgcacctgcttgatctgcactttgcgggcaagggcgatttccagcgcaagatctatacgccgctcgtgttcctggtgtggtacaagcgcttctttatcgacgaggaccagcccgctgttcaggctgcctagcctcggcttacgaacgcctgcgcgtaacggctcctccgggagccgtttttgcgtgggtgcgtttcagttactataaaaaccgtccctgccaaatggctgagaaaggcgaaagatgcaccattcggattccgcgaccgtgaccacggtcgatacgcttgccaagcttctcgatgtgtgcggcgagctgcgcgcatcagagcaggttgacgagcgtgccgtgaccggctgctcgtttgattcgcgcgcggtctcggcaggtgacgtgttcttttgcaaaggcgctgcctttaagcccgcgtttttgagcatggcgctcgatgcgggcgccgtcgcatttgtgtgcgaagagtcgctggtcgagtctctggagccgctggcgcaggagagcggtgctgcgatgctggttgttgatagcgttcgcacagccatggccctgttgccgccggaggtctacgaccgtcccgaccacgacgtcaagatcgtgggcatcaccggtaccaagggaaagaccacggccgcttttatgcttcagtccatcatcaaggcagcgggcgagtcctgcggcatgatcggctcggtgagtaccgacgatggtatcgagtgctacgagagcaccaataccacgccagaggcccccgaggtctggcgccatatcgccaactgccgtgagtccggtcgccagtccatggtcatggaggtctcgagccaggcgctcaagtaccaacgcgtcgagaatctgccgtttgacgtggcgtgcttcctcaacatcgggcgtgaccacatctcgccgatcgaacaccccacgtttgaggattattttgagagcaaactcaggatctttgaccaggcaaagaccgccgtggtgaatctgggcaccgaagaggttgaccgtgtgctggaggcagcgtcgacggccgagcgcttggtgaccgttggcgtcgagcatcccgaggcaagcctgtgggcaagcgatgtccgcgtggtcggctttaacatcgagtttaacctgcatggcctgtgtgccgacgagtccgaggcgggggagaagatcctgctgggtatcgcgggagactttaacgtggagaacgcgctggtcgctatcgccgctgcgcacgagatcggcatcggtatcgatgccatcaagaagggcctctccaagcttcgtgtgccgggccgcatggaggtcgtggagtcgaaggacggccgcgtgatctgcgtcgttgactatgcgcacaaccagctttcgttccgatcgcttttctcgtcggttaaacgtgcgtttcccgccagccccgtcattgcagtgtttggcgctgccggcggcaaggcgcaggagcgccgcgagcagcttccgcgcgaggccgcaccatattccgacctgatgatctttgccaacgaggacccggctcacgaggacccgatgaaggtctgtcgcgagcttgccgagcatgttcccgacgatacgccgaacaagattatcctcgatcgcgaagccgctgtgcatgcggcgttcaaggcggcgcgcgaggagtacgttaaccccgatgctcccaccattgtcttgctgctggcaaagggtgacgaggagctcatgcacgtgggtgacgagttcgtgcccatcgagagcgacctttcgttggccaatcgcctgatcgatgttacccagtttgactaatgaactatgatggcggcggcgccctgagtgcgctgtcgccataagcgtgttccctcaatcaaaacatgccgtccaagtccaaacccttctacgtaaacggagtaaccatgtcccacaacaccctgccgaccgttgccgagctttcgggcgagatgcgcgagcgcttggccaaggtcaagtacgtctttaccgacctggatgccacgatgctcgcgcccggctcgtgcgtgctgcgcgacaatgacggcaacccctcgaccaaactcgtcgaggccgtcgtggcactcgctcgcgctggtattcaggtggttcccacctcgggccgcaaccgtaccatgatccacgaggacgcgcgcgtgctcggcctcaactcttacattggtgagatgggcggcctggtcatgtacgacctcaaagccaacgattgggagtatctgactggcgacatgccttacgaccccgtctgcggccttactccgcaccaggtgatcgagcagaccggcgtgtgcgagaagatcctcgcccgctggccgcacaagatcgagtatcacaacgacatgtcgaccggctacaagtaccgcgaggtcaccgtcggcatgcgcggcgacatccccgatgacgaggcgcaggccatcctcgacgaggccggctgcggcctggtgtgggcctgtaacggtcacctgacgcatctgtccaagccgacgacgctcgagctcgatcgcgtcgaggacggtcgcgcgttcaacatcaaccccgcgggtctcaacaaaggcgtcgccattgcgcgcttctgcgagcacctggggatcgagcgcgaggagacgctcgcgctcggcgactccgagtccgacttctacatggccgatcacgtgggcacgttctgcctggtcgagaatggcctgacgagcgccggcgcgcccgagttcctggctgcttgcgagaacgctttcgttacgcgcggcaaaattgtcgacggttgggcggcgacggcagagttgctggtcgcggcgcgttcgtagcgcggcgtcgccgcacttggacatgtcttttcgagagagactggtgaggtaatgtccgatatcgagaatccggcaggcgacacgcgcccgattggcgtgttcgattctggtttgggcggtctgacggttgcgcgcgccatcgcgacggcgctgccgcatgagtccgtctactacttcggcgacaccaaacgctgcccctacggcacgcgcaccgaggatgaggtgcgctcgtttgcgttgcaggcgggccgttggctgtcgaagcacgacgtcaagattatggtcatcgcctgcaacacggcgacagctgcggccttgcgtctggcccagcaggtgctcgacgttcccgtgatcggcgtgatcgcgccgggtgcccgtgcggcaatcaacagcacccgcacgcgtcgcgtaggcgtgctcgccaccaacctcaccattcgctcgggcgcttacacgcgcgccattcaggacctagatgccggcgtcgacgtatacggctgccccgcctcgagctttgtcgaggttgtcgaacacgagctcgcctcgggtgcgcatctgcaagagcagtggcttgagaacgaggacatcttcgatacgcctgccgtgcgtgcgctggtgggtgccacggttgagccactgcgcgaccacggtatcgataccgtggtgctcggctgtacgcattttccgctgttggtgggacctatccgccatgcgctggggcctggggtacgcgtcgtgagttccgccgaggagaccacgcgcgagctgaccgatatcctcacgcgccgcgagcagctggcgggcgtcgccgccgagccgcagcatcgttttgccacgacggccgataacattgccgagtttgcggtggcgggcagctttatctttggtcagccgctcaagagcattgagcatatcgatatcgatgagctgaaatagatgtaaggccgccgtcagagccttcgccacaccttttgccgaaaggatttttctatggagtacatgcaggtcaaccgcgccaacggtcgcgccgccaacgagttgcgccccgttaagctcacccgtggcgtcatgaagcacgcccacggctcgtgttttgccgagttcggtgacacgcgcgtgttgtgcgccgccaccatcgaggagggtgtgccgggttggcgaaagggagctaaggccggctgggtgaccgcggaatacgccatgctgccggcgtcgaccggcaagcgctgcaagcgcgagcacgccaaccgcaagggtcgctccatggagatcgagcgcctcattggccgcagcctgcgtaccgtcgtcaacatgaaggcgctcggcgagtacaccgtcaccgtcgactgcgatgtgattcaggccgatggcggcacgcgtacagcgagcatcaccggcgcctgggtggcgctgcacgacgccctcgccatgtgggtcgaggcgggcaagatcgagcgcatcccgcttaccggccaggtggctgcaatctccatgggcgttgtcgacggcaatacgctgcttgacctcgattattccgaggacagccatgccgaagtcgacatgaacctcgtcgccaccgacaccggtgagatgatcgagctccagggcactggcgagcaggcgccctttgaccgtaagcgcctcaacgccctgctcgacttgggcgacaaaggcatcgccgagctcatcgagcttcagcgccaagccatcgcctaacctgccaaaaagggacaggtttatttggcaggttttatctgggaaaacgtcgaagtataagactgccgttgattgagaggggagaggcggaggccctcgtcgccctcggcgcggcattgctatagagacaaggagaccactcatggcacttgagaagatcgacatcgacaccctcgacccggcggcgaccatcgtcgtggcaaccggaaacgctcataagctcaccgagatcgaggccattttgggcaaggtcatgcccgaggtgcgctttgtggcgctcggccagctgggcgattttgaggaccccgaggaaaacggcacgacgtttttggagaacgccatcatcaaggcgcaggctgcggtcgaggagacgggccttatggccattgccgacgattctggcttggtcgttgatgccctggacggcgagccgggcgtgtatagcgcgcgctatgcgggcgtgcatggcgacgatgccgccaacaacgccaagctgctcgttaacctggaaggcgtggccgacgaggatcgcaccgcgcgctttatgagcgtcgttgcgctcatcgacacggacggtttggtcacctatgctgagggcgcctgcgagggcgctatcgcacacgagggccgcggcgatcacggctttggctacgacccgctgttcctgccggtcgacacgccgggcaagaccatggccgagctgacggcggacgagaagaacgccatcagtcatcgattccatgcgctcgagcacctatccgccaaactgacgggcgaggagtaggccgtgcgcgcggtggtgcagcgcgtgctcaacgccggcgtgacggtcgacggcaagtgcgtgggcaaaattgggcgcggctatctggtcctgctgggcgtgggccatggcgatacgcgtgccgaggccgacaagctgtggggcaagctccgcgggctgcgtatcaacgaggacgagaacggcaagaccaatctggcgcttgccgatgtcgacggcgagatgctcgtggtgtcgcagttcacgctgttcgctgactgccgccacggtcgccgtccgtcgtttaccgatgcaggcgcgcccgatgttgccaacgagctctacgagtacttcctgacgctcgttcgtcaagatgtcgaacacgtggcgcacggcatctttggcgccgatatgaaagtcgacttggtcaacgacggtccgttcaccatcgttttggacacggacaacctttaggttacgcggttttaccaaaccgcgtaacaactggtcatgcgaggttgtcgtctggtacgtatttgggatggggcttttttagctacttgcgtatggcggcagcagggtgctatagtattagagttttgtctatcttaggggtattatcccctttttgaattgcaccttctggaggccctgttcatggaagagatggaagtcaatcacgtcgacgacatccacgagaagctgaccgatatggtgggcgatcgcgttaaggtgaaggccaacatgggccgcacccgcgtcgtcgagcgcatgggcaccatcaagagcgtccatccggcagtctttatcgtcgaggtcgacgagcgccgtggccgcaagtcgcgtcagtcctaccagtatattgatgttctcaccggccaggtcgagctgttcgaccccgagagcggcgagcacatttttaccccgctcggcaatcagctcgaggagcactagcggtgaccgattggtccctgaccctttccgcgccggcaaagatcaacctctatctgggggttcataccgagcgtgacgaccgcggctaccataaggtcgattccctgatggcagccgttggtcttgtcgataccgtgacggttacgccggcacaggcgctgaccgtccagacgattccgacatccgactttcccatgcaaaagaatacggcgtatcgtgctgcgctcgctatggccgagcattatggtcgtgaagccaacgtctgcatcacgatcgagaagtgcatcccgttgtgtgccggcctgggcggtccttcgacggatgccgcggcggtcattgtcgccttggcagagctgtggggtatcgaccgtgccgatcccgcgctggacaacatcgcgcgcggcattggcgccgacgttcccttctttttgcatgccagccctgcattttacgtgggtgggggagacgtgctggcaaccgagtaccccgcacttcccgcgacacccgtcgtgctggttaagccgcgcgaggcaagcgtttcaacaattgaagcctatcgacgttttgacgagaccccagcgtctgcggacaagcccggagcgatcgcatctgcccttcgctcgggagacgcagaggcggcctacgcgctcgtccacaacaacctgggtgtcatttccgcgcagatggagccgcggattcaaacggtgctcgactggcttcgttcacaggacggtaccattgccacaaacgtgtgcggttcgggtgcctgctcgtttgctctctgcgatagcgccgccacggcagccaatcttgcggcgacggctcaacaaaacggctggtgggcttatgcaacggagctcgtttccgacacggttcgcattgaagcgccaaagaaataaaaatttatctagcacgcggcgaaaatctttgttactatagtcgagctaacgggttgtggctcagtttggtagagcactgcgttcgggacgcaggggtcgctggttcaaatccagtcaacccgaccagagcatgaggagggaccgcttcttgcggtccctttttttagctattgttgtgataccgcgatacccgcggtatactcattcgagcttgtctcgctgtattgtggaggtctacatgtttggactgagggctcctgagctcatcattattctcgtcgttgtcctgattatcttcgggcccaagaacctgccgaagctcggcaagtccctcggctctaccgtcaagaatatccgtgagggtatggagggcgacgataaggccgagaccaagcaggccgaggaggtcgtggtcgagcagtccgaggaggacaaggagatcgctgagctcgaggccaagctcgctgctgccaagaagaagcaggcagaggacagcgacgcggacgcagagtagtcccatccctttggggtgagcacctgaccggcttgcccgcaggctagccggtctttttcgttttgttgacagttgattgtttgatcagagttggggagatatccgtatggacgcaagccagatcgtactgaccgctgagggccgccagaagctcgtcgaggagctcgcttggcgtgagggcgattacgccaaggagatcgtcgaggacatcaaggaagcccgcgcgttcggcgacctttcggagaactccgagtacgatgccgctaaggacaagcaggcccagaacgccgctcgtattgccgagatccaggccatcctcgccaacgctcaggttgctgccaccacgggcgatctgaccgtctccatcggttccaccgtttctctgattgatcccaacggcgaggtcatggaagtcacgctcgtcggtaccaccgagaccaactcgctcgagcacaagatttccaacgagtctccggtcggccacgccatcatcggtcacggcgagggcgactccgtcgaggtcgttacgccttccggcaagactcgcgtctacaccatcgccaagattgcacgctagaccacggtcccgcgtaaaggtatgttttcgctccctgggaccgaatcctggggagcgttttagtttgaggagctaacttatggcagagaaccagaacgccgcagatcaggcatcgacgctcaacgacgagcgcgccacccgcctggccaagcgcgccgccctgttcgaggcgggccagaacccctatcccgagcactctgagcttgaggactacgttgccgatatcgaggctaagtatgccgagcttgccgatggcgaggacaccgaggacgtcgtgaagatcgccggccgtgtggtcgccaagcgcggtcagggcaagatcatgttcatcgtcgtgcgcgatgcgactgccgagattcaactgttctgccgcatcaatgacatggacgaggctgcctggaatacgctcaaggctctcgacctgggcgacatcctgggcgtgaccggcgtggttgtgcgcacccagcgcggccagctttccgttgcccctaagagcgcgaccctgctttccaaggccgttcgtccgctgcccgagaagttccacggtctttccgacaaggagacccgctatcgccagcgctatgtcgacctgatcgccaacgacgacgttcgcgagaccttccgtaagcgttcgcagattctctccaccttccgtcgctttatggagtccgacggctacatggaggtcgagacccccatcctgcagaccatccagggcggcgctactgccaagccgttcatcacgcacttcaacgcgctcgatcaggagtgctacctgcgcattgctaccgagctgcacctcaagcgctgcatcgtcggcggttttgagcgcgtgttcgagatcggccgtatcttccgtaacgagggcatggaccttacccacaaccccgagttcaccacgatggaggcctatcgtgccttctccgacctcgagggcatgaaggcgctcgcccagggtgtcatcaaggcggctaacaaggccatcggcaaccccgaggtcatagagtaccagggccagaccatcgacctttctggtgagtgggccagccgtcccatgaccgacatcgtctcggatgtgctcggcaaacaggtcaccatcgacacgccggtcgaggagcttgccgccgccgcgcgcgagaagggcctggagattaagcccgagtggactgctggcaagatcatcgccgagatttacgatgaactgggcgaggacaccatcgtcaacccgaccttcgtgtgcgattaccccatcgaggtcagcccgctcgccaagcgttttgaggacgatccgcgtctaacccaccgctttgagttggttatcgccggtcacgagtacgccaatgcgttctccgagctcaacgacccggtcgaccaggccgagcgctttgccgcccagatggccgagaaggctggtggcgacgatgaggccatggagtatgacgaggactacgtgcgcgccctcgagtacggtatgcctcccgcgggcggcattggcattggtatcgaccgcgtggtcatgctgctcaccaaccaggcttctatccgcgacgtcctgctgttcccgcacatgaagcccgagaagggtttccagtccggtgccgctgccgccaaggctgccgaggccggcaacgccgcgagccccttcgtcaagccgctcaagcccacggttgattactccaagatcgccgtcgagccgctgtttgaggagttcgtcgactttgataccttctccaagagcgatttccgcgctgtgaaggtcaaggcgtgcgaggccgtcaagaagtccaagaagctgctgaactttacgctcgacgacggcactggcaccgaccgcaccatcctctccggcattcacggttattatgagcccgaggacctggtcggcaagactctgctcgccatcaccaacctgcctccgcgcaagatgatgggcattcctagctgcggcatgctcatcagcgctatccacgaggaggagggcgaggagcgtctcaacctgatccagctcgacgcctccatccccgccggcgcaaagatgtactagggggttacgcggttctacgaaccgcgtaacggctcgacgctgcgccctcaggttccgccgttctaccgaacggcggaccggtcgacgctgcgcgccgcccagagcgacaatttgtcattcaaaaagcaaggcatgaccagaaggtctatgccttacctttttcatgccaacttgttcgctctggacggcgctcgctggcgtaggctcaacctgcgatgcggcagatggggagttccttttgtgtcggcacttggggacactccttgtagtcattggggacgttcttaaacgactactcaatggctattgagcacatggctcgcatggcagccgtctcttttatgtttcctttagccgttgctgcctaggatgggggttagtcggtaggaagggagcgtctatatggacgacgcgagcgagcgtgcaatcgaagaggacatgctcgatcagttcaattactttgacgatgaggatgaggagctaatcgatcgtcgcgagccggcatcgcttgactcatttgatctggtcgatgaagagactgatgaggttgaggacgaatcaacggagcccccacagtcttcgcgccttgactcgctgctttcgagagcccccatgcaccacggtgttcgtgccggcgcactccatatgaaaacagactggcaccagatcgtgacggcaggcgatgagcttgccgtcgatgcgccgctcaccgataagtcatccatcatctgccgcaccggtatgcttatgctcgcgagcggaacgggtgcctggcgtgtacgcgataccatgaatcgcgttgccgccgtactcggtgtcaccgtccacgttgacttaagtcttctgtcgtttgagtgcacctgcatcgaagatggccactgctttaacgaggttgtcagcctgcccacaacgggagtcaatacccatcgcatttggatgatggagagcttcctaaaggaaatcgagacgtatgggcgccggtttaccgtgcacgaataccacgagatgctcaagaccgttgagagttcaaaacccgattactctccctggcaacagggccttgcggcagcttgtgcttgcggcgccttcgtctttttgctcggcggcggccctatcgagatggcctgcgcattcgtaggcgctggtgttggcaactttgctcgctctcatattctcaagcagggtcttggccagtttagcgcgctgacgattggcgttgcgctcgcttgcgtttcgtatctgctggcattgctcggccttggccaggtcgtaccgggggcaatgtcgcaccaagaaggctatatcggcgccatgctctttgtgattcccggctttcccctcattacggcaggcctcgacatcgctaagctcgatatgcgaagcggcattgagcgtctttcgtatgccgtgtcgattattgtgatggcgacccttgtgggctggatggttgccgagtgtgtggggctggcaccggatgattttgccccgctcggcctttcgccgcttgcccttacgctcctgcgcgtggtgatgagctttgttggcgtattcggcttctcggtgatgttcaacagcccggtaaagatggccgcggcagctgggctgatcggcgccgtgtccaataccttgcgccttacgctcgtcgatgcgccgacgctgtttccctttctgggcctgagcgtaggtatgcctcccgaggcggcagcgtttatcggcgcgctggtatcggggctgctcgcgagcttagccgaaatcaagctcacctacccacgtatcgccctcacggtgccatcgattgtcattatggtgccgggcttgtatctgtatcgctcgatgtattacatgtgcaccttcgacacggtcaatatgctcggctggtttgtgcgtgcagtgctcattgtggcgtttctgcccgttggcctgggcgtggcgagaaccctcaccgactctcgctggcgccacaccagctaattggtgcaaatgaaactgatccgcaaaacatgaacgtggataatctcccgtttttggcctgtttacgggctcaaaacgggagattatccacgctcgtggaatgggtgtccgaaaatccacgctcgttgggccgatgcagacgcacctggcaattccttttttgtagacgttgtcgcgcggctacgggtgggaaaggtcccaacggttaacatatactccatatgggtaaagagaccaaagcgctgccgcggggcggcgctttgcgtttgaaaaaactagctcgtctaagaggaactagcatgttagaccgttttaccgatcgcgcgcgcaaggtcatgtccatggccaagcaagaagcgctcgatcttcactcaaataaggtgggcaccgagcacctgctgctcgcgcttgccaaggaggacgagggcattgccgccgaggcactgcgttcgctcgacatctcctatgatgacatcatggatactctcaaagaggtccagaccacggttcccgagcccagtgatgagaccgaggcggccaagctcgcctttacgccgctcgtcattagcgtgatggagcgttcattccgcgtggcgcgtgagaacaaccagacctacgtgtcgaccgagcacttgctgatcggcatcgtcgaagagggcaacggcatggccatggacatcctcatgcgcctgggtgtgtcgtccgcctccatcaaaaaggctatcgagaaactcaccgccaaggaccaggacaagaagcgtccgctcgccggcgccggtgccggtcgtcccggtgcgggcctgccgttctttagcggctcggatgcctctcagcaaaaggggggtggtaccgatacgctcaagcagttcgcgaccaacctcacgcagaaggcgtgcgacggcgagctcgaccctgtaattggtcgcgaaaaggaagtccagcgtatgatggagatcctttcgcgccgcaccaagaacaacccgctcattctgggcgatcccggcgtgggcaagacggccatcgtcgagggcctagctcagcagattgcagccggcaacgtgcccgagaacctcatgaaccagaatatctggacgctcgacctgccgggtctcgtggcgggtgccaagtatcgcggcgagtttgaggagcgcctcaagaacgtgatccaggaggccaccgaagccgacgacgtcatcctgtttatcgacgagatgcacaccatcatcggtgccggttctgccgagggctccatcgacgcgagctccatgctcaagcccgtgctcgcgcgcggtgccttccagattatcggcgccaccacggccgaggaattccgcaagtacctcaccaaggacccggcctttgagcgtcgcttccagaccatcgatgtcgaggagccgagcgtcgaggacacggtcaagatcctgaccgcgctcaagccgcgctacgaggagcaccaccatgtgcggtatacgcagggtgctatcgaggctgccgcgaacctttccaaccgctacatccaggatcgcttcctgcccgataaggccatcgacctcattgacgaggccggtgcccgcgctcgcatcgccgcgaatcgcgcacccgagccggtgcgtgaggccgagcatcgcgtggaggagcttaaggccgccgcgcaggaggccaccgagagcgacgacatgaacaaggccgccgagatcaccgagcagcagaaggccgccgagattgagctcgccgaggccaaggccgcctggaccgccgagctcgacgccagcccgctcaccatcgatgtgagtcagatcgccgatatcgtgtccgtgacttcgggcgtgccggtgtcctcgcttaccgagagcgagagccgtcgcctgctgcaggccgaaagcgtgctcaagacgcgcatcatcggtcaggatgaggctgtcgaggcagttgccaaggccgtgcgccgcagccgctcacccctcaaggacccgcgtcgccccggcggcagctttatcttcctgggtcccaccggcacgggcaagaccgagctcgccaagacgctcgccgagtacctctttggcagcaaggatgcactcatcagcttcgacatgtccgagttcggtagcgagttcgaggtctccaagctcatcggtagccctccgggttacgtcggccacgacgagggtggccagctcactaaagccgttcgtcgccacccgtattcggtcgtgctgttcgacgagattgagaaggcgcaccccgatatcttcaacatcttgctgcaggtgctggaggagggccgcctgaccgatagccagggcaagacggtcgacttccgcaacaccgtgatcatcatgacgtccaacgtgggcgcccgcgagattgcgcaggatgcgagcgtgggctttggtaccaccggcgagcagggcctcacctcgagtgagatccgcggccgcgcgatgggcgagctcaagcgcctgttccgccccgagctgctcaaccgtatcgacgacatcgtggtgttccagaagctctcgggcgagaacctgaccaagatcgcgcacctgctggtggacgacctgcgtcagcgtttgattgccaacggcatgaacatcaagctcaccgatgcggcctatgacaagatcgtggccgagggcaccgacctcaccaacggtgcgcgtccgctgcgccgtgctattcaaaagctcatcgaggacccgctgtccgaggagcttctggccggcgagtggggcgagggcgataccgtcctgtgcgacgtggccgatggcaagtttgtctttagccatggcacgggcgagatcccggcaccgcgtccggcgggcacgctcggtggcgataccgccccggcggcaccgcacaccggcaacgccgcgcccgtgagcggcggcgtgacctcgggccccggcggcatgatgcaagccggttccggcgcgctgtagggattgaatataaccttgcatgatagggggcgtttccgatggaggtgcgccccttttcttgtagagaagagtttccggtaacgataaaataattgaaagagttctgctggatggcaaaaggagttactatggcgaatagcgctcaaagaattgagatgtcgttcgataacatgagaaaaatcggaatggttctttgtgccgtgctggtacttatagccatcgctaccatcgccgtctttggttcggcatttgttgttgcatgccaaagtattttgaacggcgcagtggtaatcgagggggtcgttgagcttggtaagggcggcagcatcgcgctcccaaacttggcgctatgggcggttttgctcctggcaggggagtttacattgtcaagcattagcttcgatgtcgcccgtcgtcaatcgccttttactatccgacatgcacggatgattgccgttattgcctgcctatttgcaatcaatgccgtgatgggctctctacagattggcagcgatttaaaaataatgatgggcaattgtatgttgagctgtcgtatgaattccgctctccttcagattggtgactcaggcatcactttggatgtgggatccatcattgcaatgatggtcgctttcgctttgtcgatcttctggcgctatggggcgcttttgcagtcccagtccgatgatttggtctaggtgattgaccatggattatctcattattgaggttgagacgattttgcttaagaccgggaaaacaaatgccgatctaataagagcgactgggcatacgccagctaacatttctaaaatccgtaatgcaaaaatcaaagccatacgcttgaagacattgcttgatatctgtgttgagttggattgtcagccgggagatttgatccgtcgcgtgagtgaaatagaacttgaggaacttaccatcgcgcgtgcgcggaataagattttgcaaagacgcaatcccgacccctccgagatattgcccacagaggtttacgtagtagatctttctaaggaataacaaaacagaataagaagacaagaatacaaacacgtatacatgcaaggctcctactgaaacgatcgataggagccttaatttatttgaaaatagttcttgaaatcattagattatcgatatacgataacagcgtattaaaacagaagataaatcgaaaggaggtaattatgaactgggtaatcgatccgtgtagcaacgtgcagggtggcggtggtggctgccgcaattaccacccgtgttcgcgctgtagctgttttggcgtatatgttcatttctagcaacgcgaacgttaatgctggttaagacagcagagggtaagcagcgtggtcgataactgccatccgtcggccgcgctgccttttttaatgaggttcatgagacatgggtaatgcgatttcaatcaaggatctatcaaagcgctacggcaaaaactgggcgttgtctgatgtttcatttgatatagatgagggcgaagtgtgcgctctcgttggggagaacggcgcagggaagagtacattgatcgatattcttcttggcttgcttaaagcaacgaaaggctcaatcagttttttcggcgagtctgggagaacgggtctggcaagagcgcgcagaaacatcggattcgtccctgacggctgtggggcattcttgaacttaaccgggcgagaaaacttgacctcacgctgtatcgagtgggggctgccaaaaagtgaagtcaatcgagtgctcgctgccgttggtctagaaaatgcagcggatgcatcggtaaaacaatactctctcggcatgaagcggcgtctggatatcggaacggctctactgggcaacccgcaattgctcatcatggatgaaccgataaacgggctcgatccagtgggcgtgatcgaggtacgtgatcttctgctgtcgttaaaggacaggagggataaaacggtgctcatttcaagccacaacctagatgaactggagaaagtcgcgacatccttcgcttttctccatcaaggccgacttctcgttaaggaagagaattcctataaagacagaagtctggaaaagcggtttttggatttgatcggggaggcagataatgcaacttctgcgactgattagatgcgaagcccgtcggttgctcagaaatccagcctatttcgtgttgttgatctgggggatttggattgttaaagatgtctgtaatccaaatatgtatgggacctatggaacatctgatttagggggagtcggcaaacagatcggtttctttgcgaacatcctcgacaagactgacccggctggttcggcggttcggacggcactattcatgacctacgagtggtttttcgttctggtcggatgcattgttatttcctgtgcgatggattatcaaagcaggtcttctgaagtgacgtatgcaaagggtacgggtatagcaaaggccgttgtcgcaaagtggcttgttctgacgattgcaacttcaatagcgttcaacctgttttcgggatttactctcttcaaatctccgcttggctgctatgtggatgggcgggtgtttcttgatagatacctgcccgtgttgcttttgattgatgttattttggctgcattagtagctcagtcgatggcagttttctatttacttagaaatgcaccgcttagcattatgttggtgttggtcgggacgctgctcgcctccgatgaatatacgctggtggtcttttccaatcacgcatcgacgcaaattccctggtggctctcagtcggaccatacttacgccatcttggaaatctgtgctttcaaggcctagccattaatcagatcattcttttctctgttatttgcaccgttgtttcgttgcagctcggggtcatgggaatcaaagcgaggagggggtagaaatgcgctgcgaagatatgattaaggctgaagcctatcgagttatgaagagcaaagcgcctcttctgctgattgcggcaggtttcgtgctcgcattgctttattctgtgtcttatgaaccatggagagcctacggaacgagcgattggcttggcgacggtgttatgggcttctttccaaacccacaatatggttttgggggaattccgggagacctcgttaaagatggagctcgctacctttccgctgtggcaccgcttgcccattctctgttctttcctattgttgctgttctcgtcatcggctatgcgtttcgaactccgataacgggatctcaatggcttgtttcctatgcaaggggaatgaaaacagtacagttgttggttgcaaggactcttgtctcgattgtcacgcttgtcggtggttttgttctcttttcgatactcgttggtgcggtccaaagcgcgagtggcataggaatgacgatggatatgatcggagagtttcttcttcggctgtctcttgctgccttgatttgcacaacgttatgcctgctgctcgtcctggccatctcgctctttggaaatggcgcgtttgttctatcgttcatcatcctgctgctttatttggggtatgggaatccaaatatgccactgcacttgacatggctggcgacccttgcgtccccgcgaccaattcaattcatcgtgccggggacgttgctatttgtagcgctggcaacagtcgttcccattgtcatcctcggactttgttgggctatcaagggtgctatcagaaaacggagcatataaatgaaagagtctgaatttaacgttattgaagagaatgatgtgaacggtatcactatctacaatacccagtctggtggcgttctcgaccttgacgctgcgcacacgaatgagctgaatttatatcgcaagggtgctgccgccttggatggtgatttcgaagaggcccttaagatgggtggcatgttggtagatgacgatgttgacgagcggcgaatgttgatgcttgagagtttgtcggcaaggtttgcaaatgactatttaggactgacgattgctccaacgctggcatgcaattttaggtgtccctattgctatgaaaagggctgctcgcaccccactatgtcagaagagacaatgacggatatcgcagaattcgtgcgttccggctatcccgggatcaacgatcttcacgttgactggtatggaggcgaacccctactctgtgtggacatgatcgagcgactgacaaaagaactgagaggggcgattaggccaggcgctacttattctgccggaatggtaacgaacggatatctcctgacgcgagaaattgctcagaagcttgctgattgtcaggtcggttcggttcaaatcactatcgatggctcaaagagggatcatgattcgcggagggtcccggccgacggtcgtccgacatatgatgccattatcgacaatataatctcatgtgccgatgttcttcagattaccattcgcgtgaatgtcgatgagtccaatagcaaagaggtcgatgcgttgattgacgagcttgacgctaaagggcttcgcggtaaagtcgcgatttatcttgctgcggtcgacaatgttaacgatacttgcgcaaatgacattcattgtttttctcagcgtgggttctctcaagttgaaacgttctttatggataaagctagcgagcgcggattcaacgttattccgtttacgccgtatgaaccaggtgtctgctgtgcggtttcccttaattcgtttgtcatcgatccgcttggtagactttttaaatgttgggatgaggttggcaagggcgagtgcgccgttggaaatgttcgagaaggtgtgaaagctaattcgaactatttgaaatggatggagtatttaccaaacgacccggtatgtggcgagtgtgtaatgtttccggcttgtatgggcggatgtccccacgccgcgatggagggtcagagaaaatgcgcgagcgttaaattcaatgcaaggcagagaatgcggttggcttgtaattatcagtattcgcatgaggcaaatcacgatgtttagattttggaagatatatctcctccataagccaaggctttatgtctatctgcttctcgatgtcttgtctcaactgtgcagccttgctgaaccatatttgttgggactgactgtaaatgtgctggcggcaaaaaatgtcctcggaattagtttgcggacgctagtcttatgtattttcgcgattggcgtggtcgccattgtggggtcggtgttggcctattggacttccctaatctatgtcgaccttcaagcgcatgcgggatatcaacttaacgctgacacacttgaacacgtcaagcgtttgccccggaagtttttcatcggatttgatgcgggctattataatcagcaaatcaatcacgattcaaacgatctcataatattcggaataacatcggcgtcaaatatcattggcggtgttgcaacgattgtttgttccttgattatgttgatgaatataaacattgcgatggcgattgcctgtctagcctgcatcgttacgggggcagtagtttatcgattgtttagcgggctgctgttcaatcgaggctttgagtttcaagaaaagaccgctgctttctatgggactctccagagccagctggagagcgtctcctttcttcgtcgccattcattattcgatttctattccttgaggctgcagaaggctttcgatggtctttatccagctatattggctaaccaaaaagccggatcacggttcgaacttgcgaatcagttgattttttcctttgcgcagttctgtttgctcgcgattggaggctgtgagattgtcgcaggcaaaatgccggttggttttctgctgacggcattgagctattattcgagcgccaattctgctctggtgaacttgctttcttggggcaaaagctaccaggcgagcaaggtgagcgcccaacgccttaagcgcctttgggcaatggatgaagaggtgaacggttctgtccgcattggctctcctgtttcacttgtgtgcaagggcctgtcgatttgtcgccctgataccgatcgaatcatagattatccagagctcatctcgcttaatcgaggggtcttatacggcgtgtcgggcgcaaacggaagcgggaaaagcacgcttctcgatggcatagctggtctatatcccgatgattgcgttgggactattgcttatgacgaggttgatttgagtcagattgattctataaatctacgctcgtatgtcgttggtattgccgagcaagaacctgatatcgttaacggaacactcagagagaatctgacgctactcgcgggcgataattgtccaattcttgaagtcgggcgacttgtagaccagtttggtctgaccaaactggtctcaacacttcccaatggtcttgatggggtgctggacgagcaaaaccataatatatcgggtggtgagaagcagaagattgcgattattcgtgttttgcttaaggactcacccgtcatgttattcgatgaaccgacgtcggctcttgacggagcgagtaggtcagcgttcattgatattctgcaacagaagaaagaggatcatatagtggttgttgtctcgcatgatcccgagttgcttgaggcttgcgacgaagtgattgagctgtagacgccggaaggttagcccatttgagtcttaatttctgccatggtggaaagctgttcgaggttggtgcttaccggaaaatgtaagccactacacctcccggtaaggcattgctgcgctcttatggatgctatactaagtccaggatgatgtatagcaacctgaaggatgaggcatggaagccgaattgctcgataaaaaatctattcagatgaacgtgcgcatagatcgccagctcaaagaagccggagatgccgttctggcgcatattggcatgacgccgtcaaaagccgttcggacactttgggagtatctggtcgttaacggacgcatgccctcgaagggagacgcggcggctccggtttctgacggagtggagccccggcgcatggaatcaagggccgcgcaaggcagccatatcgttcgcgattcgtgcctcaaatacggcatccccatccctgagttctcgggagactatgacgacctctatgaggaggccatggcggagcgctatcccgagtgggtggaactatgagcacagaaggcgtcctcaagctgttaatcgataccaacgtatggatggattacttttctggcaggtccgaccgtacggcaaatgtcgtccatctgatcgagattgccgacgcctcggagcggattgccctgtttgcctcgtcgctttcggtcaaagacgtttcatatcttgtctcggcggcaatcaagcaggagtgccgaagaaagactggctcactgagtgataacgccattgcggcggcagatgaaacggcctgggcatgcgttcgacagatgcgcgagctagccctcatcgccccggtcggtgcagacgaggtcttcgactcctttgtgttcaagtatcatcacaacgatttcgaggacgacctgatgctgggcgtcgccaatcgtatcgatgccgattacgtggtgaccgaggataaaaatctcattaaacataccaatggtgtatgcattaacgtcgaaaaggcgttgaggttggttggagaggtcaacagctcatccgccctgtccatctagcctgctccatcttgataaagtgacgtttcctcaccgttagccgatgatgcgagggcgctcggcgttttcgactggtttatgcacgctaagtctgggaatatacaagtcgcatgtcttactgtctaaccagttgcgccaaggaggcaccatggattacaagatcaccggctacgagcccgcccagctgttccatttctttgaggaggtcagcgcgatcccccgtgggtctggcaacgagaagggcatcagcgatttcctggttgcgtttgccaaggagcgcggcctcgatgtgtaccaggacgaggtctacaacgtcatcattcgcaagcctgcatctgccggtgccgagaatgccccgaccgtgatgctgcagggccacatcgatatggtgtgcgacaagttgggttccgtcgagcacgactttacgaccgatggtatcgacctggtcgtcaaggacggtgtccttaccgccaacggcaccacgctgggtgccgacaacggtatcgccgtcgctctgatgctcactgttctcgatgacgattcgatcgttcaccccgccctcgagtgcgtattcaccaccgacgaggagactggcctggtcggcgccgagacgctcgacaagtcccagattagcgcccgcaccatgatcaacctcgactccgaggaagagggcgttgccaccgtcagctgcgccggcggcgtcgtcgttacctacacctgcccgatcgcgcgcgagcgcaagaccggcagcgctctcacgctcgacatctccggcctgctgggtggtcactccggctccgacatcaacctggagcgcggcaacggcaacctcatcatggcccgtatcatcgaccgcctgatggtcgccggcgagcccgccatcgtcagctttaacggcggcactaaggacaacgccatcaaccgtgagtgcaaggccgagctggtttacgccgaccacgctgccgccgaggccgcggcccagattgcaaagggcatcatcgccgacgtcactgccgagctcgaggtcttcgaccccggctttacctgcaccgtcgagattgccgacgacgccgaggtcgaggccatggaccagaagtccgcgcttgccctcatccgcgccctgcgtcttgcccctaacggcgtgattcgccgcaacgtcgccaccgacggctccgtcgaggtttcctccaacatcggtgtggttgccacctctgacgaccaggtcaagatcatgctgtccccgcgctcctcgatcacctcgctgcagaacgagttcaaggaccgcctgcagacgctggccgatgtcttgggcttcgacgctaagtttgagttcgagtatcccggctggagctatgccgagcattcgccggtccgcgacgtctttgtcgagagctatcgcgagctctttggctccgagctgcgcatcgagtccattcacgccggccttgagtgcggcctgtttgccgaggccctgcacggcctggacgccatcgccgtgggcccgacgctctccgatgtccacaccccggacgagagcatggagctcgcttctgccgagcgcttctacgagctgctcatcgacgtcctcaagcgcctcgctgcgtaaagattgcgttagcagcagtccgagccacgtgctagcggattgcaaatgacattacgagaggggacacccggtcttttgcgacaggtgccccctctcttcttttgggaaatgggaaattgattggcgtctagcccatatccgccttgatgaggtcgagggtgcgctggcagttttcgcggacggggccgagcatatgctcgcgcaggtccgccatgccgggcaggtcggcgtattcgtccatgacctcttccatgcaaacgggtacctcgtaggcgaggtccatcatggtcgcaaagcaaaacttctcggatagaccggcatcggtgagcgccgcctccagcgcggggtcgcccataccgtggtatcggcggatagcgcctggaccgatgcgccccacacgattttcgccgccaacgctcatggcaaggcgcgcccggcggcgcatgcgctcatacgccaaacccgacgcgacatcgtacattcgagccatcatggctgcgccgtcgtttccaaggagcagggaatagtttttcgcatgcgcatcaggtgcaccgataacggcgttgaagaacagtatctgcgtaaacagatacaggttaagttgatggtggctcgtatttacgaggagctcttgaatgtcgcgggtggtcgggccgccgtctgccgtgtacttttgggcgggcatcaccccaagtgcctgacagaggtcttcttgatgtaggcgcctgatcgttccgtcttcgactttcacgcggtcatagcgttcaacaatgagggcaggttcgtcctcaaacatacgatattcgacgttttccgttgcgatgccggcgcgctgggcgcttttcatgcagacaaactcattcagagcctcgagtttaaatccgataacgccatttttgaaaatatgcgtcgtgggcgaggagcccatgcattcgcaccagcggccgtttatgaacgcgagcgcgaatttgccctggttgcctccaagcgaccaactttcatctagacccatccacgatgcatcgcggtcatctctgatcgacttgagacggagagcaatttcgtggtcgtctatagggcggtattcgccagcgcgatgcaggacggcatcggcatcttcttcggcacaaaactgcactccgcccggacagtcgagtccgatatggctgagcaacgcaacgggattgttgggcctaacgtcgaattcggcggcaatcgcttttcgctggtcctcgctgtcgggtagaaggccaaacaggtacggattcatgacctgttgtccgtatgtgcgattcgatacgggtatgttggtcgatagcgctggtccgtcatagtcatgatcgtaggtaaaactgataagaccgttctcatcttgcgtgagcgttcccgcaggtacgtcgcaaataatggtccgaagtgatgttctggccattggctatttcccttcgggcttggtttggttagatacgtttgcggcaatcgagactccgagattggacatggcgaaatcggcgaagacctcgtcgtagagtgcggatgtaaagggagcatctgcaagagccggaatgggggtactacgacggttgcgatgatgaggacgttgagtgtgatggcgcctggggatgctgcgaggcagcggattggcatgcggggcgtcgactggccgctcgtttttcgcttcgccgatatccccttgagcggcgagtgccagtccaagagcattgaaaatcgtcagcaacttgtcgagtcgaatgccggtggcgtctcctagctcgagcgatgcgagcaggcgctccgaaacactggccgttttagcgagggcggcacgggtgagaccctgagcctcgcgtgcctggcgcacgtagatgccagcttggcgcggtgtggtgatgggaagggtgtccacggcgatctcctaacgtgcagacttttgcatattagtatgacatgcaaaagtctgcacgaaaaggcctcatgcaaaactctgcataaggccttgtgctggcgttgagttttgagcgattgtgcttggcgttatagcgccaaaatccccagatgctcaagcaagatcttaagcccgatgaggatgagcacgacgccacccacgatggtggcgggtttttcgtagcgcgcgccaaaggtgtggccgatcgctacgccggcgacggagaagataaacgttgtgacgccgataagcgatacggcgggaacgatgtcaaccgagagcgccgcaaacgagatgcctacggctagggcgtcgattgaggtggcgatggcgaggatcaggtattctaccaggtcaatcttttcggcatccttgtcgtcgccttcgttctcatcttcgtcttcggaaaaggcttcccacagcattttgccgccgataaaggccaaaaggataaaggcgatccaatggtcgatgggtccgatgatgcccatgaattgactgccgagcgcccatccgattacgggcatgccggcctgaaagccgccaaagaacaggccgagcactacggcgactttaaggttgattttcttcatgccaaggcccttgcagatggaaacggcaaaggcgtccatcgaaaggccaacggcgagcaacacgagctctgcgagtcccatagtctggcttcctctctgcgggcgagcccgattacgcgactactccctcattaatatgagacccgatgctaccacatgagcagtcaagagagcctcgtcccaaatgagctacctaagctgtgttcgctcattctgtaagcatcggatttcgcaagcaacgcagggacaaaccgtgagaaactatttagcgtttatggagcgtatacgatgggagcgatgccttggataagaacgagctgcaaaagcgtatggaacaggccatccgcctgacggcacctggtcagccgatccgcaccgccctcgacatgatcatcgccggtcacctgggcgcccttatctgcgtcggcgacaccgaaaacgtgctcgctgccggtaacgacggcttcccgctcaacatttcgttcacctcgaaccgtctgttcgagctctccaagatggacggtgccatcgtcatcgacggcgacctcacccagatcctgcgcgccaacttccacctcaatcccgatccctcgcttgccacgagcgagacgggcatgcgtcaccgcaccgccgctcgcatgtcggtgctcaccgatgccatcgtgatctcggtctcggcccgtcgtgccgtcgttaacgtgtacgttcacggcaagagctacgagattcagcctgtcaccaccatcatgagctcggtcaaccagctcgtcgctacgctccagactacccgtcagtcgctcgatcgctccttgctgcgcctgacggcccttgagctcgacgactacgttacgctcgccgacattaccggtattttctcgagcttcgagatcatgcagcaggcaaagaccgagcttaaggattgcattgtcaagctgggcaaccagggcaagctcgtgcagatgcagctcgagcagctcgcgggctccagcatggataccgaatacgacctgatgatccgcgactacgcgagcgattcctccgaggcaaacgccgagaagattcgcgccgagctcgctcgcatgacgcccaaggacctgtccgacccgcagcacgtggcggcggttctgggttatgacgacctggacgaggattccgtcatgacgccgctgggcctgcgcacgctttcgcgcgtgtccgtcgtgcgcgacggcgtggccgagaagatcgtcgacgagtacggctcgttgcaggagctcatggacgacatcagcgaggatccggagcgcctgggcgactttggcgtcaacaaccctgccattcttgcggactcgctgtaccgcatgaagggcaccaaacaggggaacgcataatggcgcccgtatgcgccgtggtcgttgccggcggcagcggccagcgctttggaaatcccggcggcaagcagctcgttaacgtggcgggccgtccgctcatgagctggtctatccgcgcgttcgatcgtagcgacaaggtcggccacatcgtggtggtgtgtcctgccgagcgccgtgccgagatgcgccgcctggccatcgatccgtttgactatgacacgcccatcagctttgccgatgccggcgatgcccgtcaggattccacccgtgccggcgtgcatgcggttccggcgggtttcgaatatgtcgccatccacgacggcgcccgtccgcttatcacgaccgaggccatcgatcatgcgatcgacgtgcttgtgggcgaccgctcgctcgacggtgtcgtgtgcggtcagcccgcgatcgacacgctcaaaatcgtcgacggcgataatatcgtcgagacgccgccgcgcgagctctattgggctgcgcagacgccgcagatctttagcgttgacgccatgaagcgcgcccacaccgcagctatcgccgagggctttatcggtaccgacgattcatcgctggtcgagcgcatgggcgggcgcgtccgctgtgtccagagcccgcgcgacaaccttaaggtgacggtgcccgaggacctgcgtcctgtaaccgcgattctgctcggtcgcatggccgagggagaggaccttccccatgttcagtaacctgcgcattggccacggctacgacgtccaccgtttggtggaggggcgtcgatgtatcatcggcggggtcgacattccctacgagcgcggcctgctgggccactcggatgccgatgtgctcgcgcacgccttggccgacgccattctgggcgcctgccgcgggggagacatcggcaagctattccccgacaccgatcccgcctacgagggtgctgattcgatggtgctgctcgctcgcgtgatggactatgcgcgcgagctgggctttgagtttgtcgatgccgattgcaccattgcctgtcagcaacccaagatcactccgcaccgcgatgccatgcgcgccaaccttgcccatgccctgggcgtcgacgtggaaaacgtgggcgtcgccgccaccacgaccgaaaagctcggttgggaaggccaaggcgagggaattggcgcctgggccgtctgcctgctacagaaaaccgttaaggagtaacgaatgcgtatctacaacagcgctacccataaaaaggaagagttccagcccatcgagtccggcaaggttcgcatgtacgtgtgcggccccacggtctacgacaacatccatatcggcaacgcccgcacgttcatcagctttgacgtgattcgccgctggctcatcgcgagcggttacgaggtcacgttcgcccagaacctcaccgatgtcgacgacaagatcatcaagcgtgccaacgagcagggccgtacggccgccgaggtcgcgacggagttctccgacaagttcatcggcgtcatgcgcgccgccaacgtgctcgatcccgatgtgcgcccccgcgccaccaaggagatcggccccatgatcgctatgatcaagacgcttatcgagcagggccacgcttacgcagccgataacggcgatgtgtactttgccgtgcgcagcgatcccaactatggtcaggtctcgggccgcaacatcgacgaccttatggttggcgcgcgcatcgaggagaacgaggacaagaacgacccgctcgactttgccctgtggaaggccgctaagcccggcgaacccagctggccgagcccctggggcgaaggccgtcccggttggcacaccgagtgcgccgccatggtgcatcgctacctgggcaccccgatcgacatccacggcggcggctccgaccttgccttcccgcatcacgagaacgagtgcgcccaggccacctgcgcctggcaccagggtttctccaacacctggatgcacacgggcatgctgctggtcgacggcgagaagatgtccaagtcgctcggaaacttctttacgctggccgaggtgctcgaacagcactctgccgcggccctgcgcctgctgatgctgcagacgagctatcgctcgccgcttgacttctcctgggagcgtctggatggtgccgagaactcgctcacacgcattgccggtacggtcgagaacctgcgctgggccgcgaaccatgcgacggccgatgccgatgaggcagcatccgaggcgtttgccgctaaggtcgccgaggcccgtgccgcctttaaggagtgcatggacgacgactttaacaccgccggtgccatgggtgctgtctttggctttgtgaccgagtgcaaccagtacctggagcaggcgggcgatgctgccgacaaggccgctgcgcttgctgccgccgatacgctggtcgagctgctcgatacgtttggcgttgagctccccgagcccaaggtcgagctgccgctgggcctgctgggcgttgccgccggcctggtcgcctacacgggcgacgacgtggacgaggccgctgccaagattctcgaggcccgcgccgaggcccgcgccgccaagaactgggatctggccgacgccatccgcgaccagctcaaggacctcgggctgacgatcgaggatactgccgcgggcacccgtattaagactctctaatccctgcgggtttcccaagcacccgaccgcccgagtcacggcaccttgcctttcaatcgtcggtcatgacctcaaggtctatgccctcctctttcaaggtaatctgccgcacctcgggcggtcggtctatttgtttcgtttgatagtcgtatttaggaggtcgctttatggccgacaatcgcaagcgtgcaccgcgtggaggcaagcaggctgcttctggctcgcgcccgattcgccgcaatgaccgcgctgccgcttccaagggccagcgcgagcgctcccaagcccaggctgcgcgtccgcagcgcgatcgcaaccgcgacgctgtccaggctcccaagggcgagtttatcgaaggtcgtcgtgctgccgccgaggccctgcgcaccggctttcccgtcaagtgcgcgctcatcgccgagggcggggagcgcgatgctgctttgtctcgtctggtcgatgacctcaacgccgcgggtgtccgcattaagtatgtgccgcgcgcgcagctcgatgcgctgtcgagccatggcgctcaccagggcattgcgctcgaggtgggtaatttcccctatgctgatgtcgccgatatcctcaatcgcgcgggtgacggaccggcgctcgtcgtcgtgctcgaccatgtgaccgacgatggcaactttggtgcgatcgtgcgctccgccgaggtcgtgggcgcggcgggcgtcatcattgcaaacaagcgcgccgccggtgtgaccgtgggcagctacaaaacctctgctggtgccgtcatgcacctgcccatcgcgcaggttcccaatatcgcccgagcgcttgacgacctcaaggccgccggcttttgggtgggcggtgcttccgagcacgccgagggcagctgctgggatgctccctttgagggccgcgttgcgctcgtcatgggctccgagggcgacggcatctcgcgcctggtgctcgagaaatgcgactttttgaccaagcttccccagcgcggcatgaccgagagtctcaatgtggcccaggcgaccaccgcgctgtgctttgagtggctgcgccgcaatgccggcgagctcatgggggaggagtagcgcatgtccaagaagaaccgcgccaagtccaaggccaagcgctttggcgagggctcggccaagccaattgtttcggccgcgacctatggcgtgggcggcaatgcgtttgcgcaggctatcgccgatccggtctcgacggtgcactccaataagcccgagctgctggtggtcgacggctacaacgtgattcactgcacgccgcgctacgaaaagctcgtgtacgaccattccgacgatccgtattccagcgacgtccacgatatggctcgtactgcgctcatcaacgacgtcgccgcctttgcccagggccgctacgaggccgtgatcgtgttcgacggcgcgggcaatatctccagcgagcgccccaacctgccggcccgtggcgtgcgtatcgagttttcgccgacgggtgtctccgccgataccgtggtgcagaagctctgcatcgaggcgcgcgaggaaggccgcgcgtgctccgtggtgtcgagcgacggcacgatccaggccgttgtcatgggtaagggcgttacgcgcatctcgagccgcatgctggtggacgagatcaagcagatcgataacgacgttcacgaggcagaggaagctccgcagatcaagatgactctgggcagccgcctgagtcccgatgccctggccaagcttaaggccctgcgcggacggtaggggattatccatagagacccgttccccaattggccggcccgttgatttgtaatcaatggactgtgggttgccgtcgccaaaacgaatagtttttggttttggcgaacagataaaactattcgttctgacgaatagttttgagatgtggtcggtcgaaaggtctgttgcgccccgtccgtaattcctttattcttaactggcttcgcgcgaaagcgccaagtgtgccagtgtggcgcaacggtagcgcaactgatttgtaatcagtgggttgcaggttcgattcctgtcactggctccatgagagtttcgggctctgtctctatatgggactgggcccgtttctatttatgttgacatgtcagcgggtttgacttccaccaggcttcaggtttgtcttgatctgtaacaggggcgggctgaaaaccctccttatagttacagatcgagacaatgccaagggatggtcgataacatctcgatctataacacgaagaggctgaaagccgttcttgctgttatagatttagataaacagacaagccgccagggaaacatctcgatctgtaacagatagaggaggaataaccctcttactgttacagatcgagacagaagccagggcgaggttggtcatcgtcatcgagcgaggattttcggacacacgagcgaggattttcggacacacgagagtggaaaatctcccgcctggagaatgagcgtggataatctgccactttgggcccagtggcacgtcaaaagtgggagattatccacgctcgatttcaaacgggagaaaatccacgctcggtcgagccagggaagcccgatctcgacctatatgataggtgcaaatgggtcgttatcgaagtaatattctgcaggcttactccactacgccaaagtgttccctcgggaaatgtcaccagtgcagcaaaatccaccatccttcatatccaaactcaacaaaaccgcaggtcaaaggtatatagatacgcccggtaccgtgtatctagaggttttcgttgacaggccccaaggttgcatcgtattatctttttcgttcgcgggggcggcggtccaaaagaccaaagaaactgcggatacttgaacgattgggagtttgcccgagtggttaatggggacgggctgtaaacccgttggctctgcctacataggttcgaatcctatagctcccacccgtcaagtgcctgtatagctcagtcggtagagcacttcgttggtaacgaagaggtcaccagttcaagtctggttgcaggctccatccggcggtgtagctcagttggttagagcacacggttcatacccgtggcgtcactggttcgaatccagtcaccgctaccataggtaacacggtggcttctcaatagtatgttgagaggccactatggtataaaggcaaagtcccgtccggggacgacctgttaagaggagggctttatggccaaagagaagtttgagcgcactaagccgcatgttaacatcggcaccattggtcacgtcgaccacggcaagaccacgctgaccgctgccatcaccaaggttctctccgagaccgagggctgcaaggctgacttcactgcgttcgagaacatcgacaaggctcccgaggagcgcgagcgcggcattacgatctccgtctcccacgttgagtacgagaccgctgcccgtcactacgctcacgttgactgcccgggccacgctgactacgtcaagaacatgatctccggtgctgctcagatggacggcgctatcctggtcatcgccgctaccgacggccccatggctcagacccgcgagcacatcctgctcgcccgtcaggtcggcgttccctacatcgtcgtcttcctgaacaagtgcgatatggttgacgatgacgagctcatcgacctcgtcgagatggagacccgtgagctcctctccgagtacgatttccccggcgacgacatccccgtcatccgtggctccgctctgggcgctctcgagggcgacgccaagtggatggacgctatccgcgagctcatgaaggccgtcgacgagtacatcccgacgcctgctcgtaacaacgacctcccgttcctgatggccgttgaggacgttatgaccatctccggccgtggtaccgttgctaccggtcgtgtcgagcgcggtgagctcaagctcaacgagcccgtcgagatcgtcggcatcaaggatacccagaacaccgtcgttaccggtatcgagatgttccgtaagtccatggacttctgcgaggctggcgacaacgtcggtctgctgctccgcggcatcaagcgcgaggacatcgagcgcggccaggttctctgcaagcccggttcggttaccccgcacaccaagttcaccggcgagatctacgttctgaccaaggaggagggcggccgtcacaccccgttcttcgatggttatcgtcctcagttctacttccgtaccaccgacgttaccggtacggtcaagcttcccgagggcaccgagatggctatgcctggtgaccacatcaccatcgagggcgacctcatccacccgatcgccatggaggagggcctgcgcttcgctatccgcgagggtggccacaccgtcggttcgggcatcgtctccacgatcattgagtaaattagctctctgatatagctgacttagagaacccggcacttatatgggtgccgggttcttttctgcaatggatatcgagccattgctagtgccgagaggatcagttcggtccaggtcgcaccgtcgattagctctcgctggcttcattgatgtgttccaaatatgaatggatccaccgagaaccaattgactcgaggttttcgttgacagcacttacgtagagctgataaagtaacaactcgtgcccgtacggggcggaaatgaaaggttcaggatacatgcgtactctagttactcttgcgtgcactgagtgcaagcgccgcaactatacgaccaccaagaacaaggcgaacatgcctgatcgtatggagatcaagaagtattgcccctggtgccgtcaccacacgctgcacaaagagactcgctagtctctagtcacatacgccagtagttcaattggtagagcatcggtctccaaaaccgagtgttgagggttcgagtccttcctggcgtgccagtcattattccgtaagctcccaattgggggcttacggtttactcatgtataagcgcattgcgcggaggtaacccaaatggccaacaagaagaacaagaagaaggctcagcagaaggcgcctgccaacaacgctgccgccaactccaaggttgaggccaagaaggccgttgccaagaagaacgagaaggctgcgaagtccaagaagaatgagaagcctggtttcttcgcccgcaccaagaagtatttcgcttcggtcaagtccgagatgaagcgtgtcacgtggcccgacaagaaggagctcgtgaactactcggttgtcgtttgcgcttctctgatcgtcgtcggcgtcgtcatcgctctgctcgatgctggctttggcgaggctcttgctctgttctctggattgaggggctaaaccatgtctaagcgttggtacgtcgttcacacttactccggatacgagaaccgcgttaagtccgatctcgagcatcgtatcgagaccatgggcatgcaggaccgtatctttgatatcgagattcctatggagcgcgtcaccgagattaaagagggtggcaagcgcgagaccaaggattccaagatcttcccgggctatgtcctggtccgcatggagatggatgacgatgcctggacgtgcgttcgcaacacgcccggcgtcaccggtttcctgggcggcaacggcaagcccgctccgctttcccgtgacgagtacaacaagatgactcgtcgtcccggtaagggcgattcgcccaagcgcacctcggttgatatccaggtcggcacgtccgtccgcgtcaccgatggcccgcttaccgactttgatggcaaggtctccgaggttaacaccgaggctggcaagctcaaggtcacgctgatgatctttggccgcgagacgccggtcgagctcgactttaaccaggtcgctgtcatcgcttaagttttcgtccgttcgcgcgagcgtgcttcttctgtgactgctcatctcaggagtgcttctaacacgtgcgtgcttacgatatagcaagtacttcacactcgtgattcgaaaggaatgaccatggctgagaagaaggttgccaacgtcattaagctccagattcctgctggtgccgctaaccccgctcctcccgtcggccccgccctgggcgctgctggcgtgaacatcatgcagttctgccaggcctttaacgccgagacgcaggacaagaagggcgacatcatccccgttgagatttctgtctacgaggataagtccttctccttcatcaccaagaccccgccggcggctcacctcatcaagaaggagctgaacctcaagtctggttctgctaagccccaggccgacaaggttggtcagctctcccaggagcagctcaccaagattgccgagatcaagatgccggacctcaatgccaacgacattgacgccgccaagaagatcatcgccggtaccgcccgttccatgggcgtcaccatcgctgagtagcgatttctttaggtaatgacgggtgccccgaccgaggcgcccgttatatgtgtgcaatagggcacacgaaacgatgtgggagggcataagcccgtttaaccacaggaggtaatgcacatggctaagcatggtaagagctataacgccgctgccgagaagatcgaccgcgccacgctctacaccccccttcaggctgccaagctcatcaaggagctcgacaccgccaagttcgacgagaccgtcgaggcccacttccgtctgggcatcgatactcgtaaggctgaccagaacatccgtggttctatctccctgccccacggcaccggcaagaccgttcgtgttgccgtcttcgccgagggcgagaaggcccgcgaggccgaggctgccggcgccgacatcatcggttccgacgagctcgtcgcccagattcagaagggcgagatcaacttcgacgccgctatcgctacgccgaacatgatggccaaggttggccgcatcggtaagatccttggtccccgtggcctcatgccgaaccccaagctcggcaccgtgaccatggacgtcgccaagatggtctccgagctcaaggccggccgcgttgagtaccgcgccgaccgctacggcatctgccacgtgcccctgggcaagaagtccttctctgagcagcagctcgttgagaactacgctgccctgtacaccgagatcctgcgcgtcaagccctcttctgctaagggcaagtacgtcaagtccatctccgtgtcttccaccatgggccctggcgtcaaggtcgatcccgctgtccagcgtgacttcctggctgagtaactgttagttactgactgagcaaagcaagcattgctaaagaagcccggttctgcctcgtgcagggccgggtttcttgctatcgcgccaccaaaaccaacacgaaggggacaggcacctttgtggtggttttggcactttggcgtcaatgttatggcatcgcagcgagccggttccaagtgccccaggtcgccccgaaagaggagcgacgcgtactttggtacgcgagcgacggcttgagtggcgagatggggtgcttggggccggcgcagcgtcaagccttaaaggtggttaccagggtgttctggcggtagaggactcgatggcctcgtggcgcttgagctcgcggcgcatggtttgcgaattgagccaggctgcctgccagccacggatagggtagtacgcttcgtcaagttcaaactgcgtatagccgcaggcgttgatgattgttgccccgcatgcatgtcgacgctcacgctgaaaatcgtggccatagcattggtgcacatgcccgtgcaccatatagtcggccccccaggactcgagcgccgtgttaaagcattcgaatcctcgatgtggcagatcatccagatcgcccacgccggcggcgggtgcatgggtgagcaagatgtcgcagccgccgaccatcctcactttgcgggacagcttgcgcatgcgcttggccatttcgtgctcggtgtacatgttggcaccgtctcggtagcgcatggagccgccaagccccgcgatgcggacgccgcggtacacgtagacggcatcttcgacacagatgcagccgcccggtgcatgacgtacgtagcggtcatcgtggttgcctcgcacgtagatgagcggtttgttgatgacggtgaccaaaaactcaagatagtccgggtccagatcgccagcggacaaaatcaagtcaacaccctcaaagcgttccttgcgaaagcattcccaaaggcatcgctcttcggtatcggctacggcaaggatcttcatagggcgtggactttcggctcatcgttgggctgcggaatggcacctaccacgttgtcggccagccagtccatctcgacgatttgcgtgctcggcagcgggggaaagccctcgatctgcaccacgccgtcttggctatggagctcgccgccaaatggattgatggagccctcgacgatgccattgcggaggagctgaacaagcttgcgcgtctgatagggcaggcccggagcgtagcgaatgtcgattacgcccgagctcataccataccagtagttgacggcgcgaacctggctatcgtcactggtctcatcccaggtgccatgcagcaggcttcgcacgataagctcgtagtatcggccccagttccataccggcatggcaatgccgacgaccttgccatcgaccaggcggtggagtccgtaggccgtggggtcttcgagtgactttgacatgtcggcgccggtcatgacgctcacgccttcgcggcacatggcctcggcaagaccgccggcgggcacatcgccccaggtgaggattacctgcgcgcgagggtcgagcagcgaggcgccaatcgcaaaggcgttgatctcgctgagtgcgcctgaggcgaagaccgacgcgtggtaaccgatgcggtggttgtccgccatgctggcggcaagggcgcccagcagaaattttgcctcgtacatctttccaaaatacgagcgcacgctttggtggggaaggccgatagagcagttgaggaaccgaacccggggatactcaacggcagccctgagcgtgtattccatcaggcggtgcgaggtcgagaagatgacgtttgctccatgtttgacagccgtttccgcggcggcgtagaacgcgtccggattgtggcagtcctcgaacgcctcggtgcgcacgataccgccaaagtgctcatcgagatactgacgcccttggtcgtgcaggctgtcccagctcgacgtcgcacaggggaactcatggataaaggcgatgcgcagggggttggccgccgaatagacggtcttgcccataaagaagttgagcacaccggaagtggacttggcgggcgtctcctcctcatcgacgctcggcgcttcgacaagatcgaccttgtcctcattacttttgccggcaatgaccagctcgcgccagatcttgcacaggcggtttacgacgatgtccgtcggcgtgtccagcaggcggtcctggttgtacacgttgagatagacgagcatggcgtcggcgggcgtaatgtccaggtggtcgccgccggcgcgtaagtaggcgcgcttaaagagcaggaaggtgtggcgcaggtagtcgacctttttctgtggccacttttcgacaaggtcctggccgagcatcttggcgagcgttctatagcttccctcgcgcgagaactcaatctcgtatagggggcagacgcgccaaaacgcgcagaactcgccgtacaggcgactttcgacggaatcccatgtgccggggtagaggcgggtgaccttggccgaaaccgtcggggcgtccaggaatttgaggacgctgacgcgcttgttgccctcctggacgtagaaccgatgcatgaactcggtgacgatgatggggtcgcgatagccctcggtcacctggatgtcatagaggttggaccacttgcgggcgaactcggtgctaaatggcaacaggggcataaagttgcacgaaaaggctgactgacggcccttggtaaccgtgccgacgaccatttcgagcggaatgtcccttaggccgacgctctctcgctgacctaaggggagctgggcaacgaggctatcgaggtccgtaaggtacgggtgctcgctttggctgatggcgcgacggcgtccctgctcgccgcgcttgcgtgcttgacgataggcctcttccatggtgtctactcccttagtcgtttaaacaacgatataaaccatggtaccacgatgcgaaaccaccacaaaggtgcctgtccccattgtggtagttcacctttatggaggtgttaggcgatgatgggggcgatggcgcggatgcaggcgtcggctgccgtgaaagtggtgctgtcgtcgctgacgataaagatgatcttgcccttgatgccaaagtcgccgatttcgctaaagagcacgtagggctccttgtcaaagcccgagatgggaagcacggcggccttggtggcgtcggtgagctcatctgccaacgcgtccagtgaagcccacttggacgtgtccttgaccgcgacggggacggctacgcgcccaaagggcatcaaatgcacgagcgtgttcttggagatgttggagttggggacgatgatggtctgcccgcaggcgtcctcgatggtcgtatggcgccaggtgatgtcttggaccacgcccgacacgccgccgacctcgatattgtcgccgggcttgatgatgcccataaaggtcacctgcatgccgccgataaggtttgacagcgtgtcctgaaagccgagcgagatggcgatgccgccgacgccaagagcggcaacgagggcgtttgcgttaatgccaaagcagttgtcgaggataaaactaccgccgatcatccagatgacggcgcgcgcgatgttgatgaagatgcttgatgaagggagtgggttatcgtcgcggttgagcaggtggtacagggtcttggacgcgaccttggcggcaacggcggtgccgatggccaagatacctgcccagatgatgttgtggacccatcgttgtgcaaagaaatgaagaattggctcaaacaattccatgtagggaaacctcctcatgatcgttcaaccatgatacccaacaagaagcccgtccgatcacatcggacgagccgataacttgagaaggggtggccgcagcggcgtaggctggggcaccggtgagcgcaccggcgagaagtgcggcggtcaaagcgagacgtggaagagatcttctcatggcagtttccttagttcttaaccagtggtccctgctgacgctggattatcgacataatatgcgaaaaccgccgcaagggcgcctgtccctttgcggcggttttgacgtttgcgcagataaaacctgccaaaataaacctttccctctttggcaggttttagctcagcagcatgcggtcgttggcgagctcgccgcccgagacctcctcgaacttctgcaacaggtcggcgacggtgagcgacttcttctcgtcgcctgccacgtcgtagattacgtggccttcgtgcatcatgatcagacggttgcccagacgaatggcgtcgttcatgttgtgcgtgaccatgagcgtggtcaggtggttctcgtcgacgatctcctcggtcaggttgagcaccttcgaagccgtcttggggtcgagggccgcggtgtgctcgtcgagcagcagcaggcgcggcttggtgagtgtggccatcagcagggtgagtgcctggcgctggccgcccgagagcaggccgaccttggcgttgaggcgcgtgtccagaccgaggtccaagcgcttgagcagctcaacgtactcgtccttttcggccttggtgacgccccacgaaagaccgcgacgctggccgcggcgcttggcgagggccaggttctcggcaatttgcatgtccgctgcggtgccgcgcatgggatcctggaacactcggcccaggtacttggcgcgctgcgactcgctcagacgcgagatatcgttgccgtcgagctcaataacgcccgaatcgagcggatacacgccggcaatcatgttgagcagcgtggacttgccggcgccgttgccgccgatcacggtcacaaagtcgccgtcgttaagggtgaggtcgacgccggtgagtgcgcgcttctcggtgacggtgcccttgttaaaggtctttttgacgtgcgagagcttaagcatctgcctcatcccccttcgtgtaggagctgcggagcttatagcgctcccaaaccacgggcacgcacagggccacggcaacaatcacggcggagagcagcttcatgtcgttggcatccatgcccagctgcagcacgatggcgcgaatgaggaagtacaccacggagccaaagacggcagaggcaagacggacgctaaactgcgtcagaccgccgggcagcaggcggccgagcacctcgccgataacaatggcggcaagaccgataacgatggcgccggtgcccataccgatatcggcatacttctggctctggcagatgagcgcacccgaaaggccgataagggcgttggagagcacgagggcgatcatcttggtggagttggtgttgacgcccagggcgcggatcatgtactcgttgttgccggtggcgcgcagcgccgaaccgatctcggtgccaaagaaccagtacaggatggcgacgatggccacggccagcacaatgcccaggatgatggcaacggtggactgcggcaggcccgtcatgtggctgacagacgagaagatggtgcccttggcaaggatgggcgtgttggacttacccatgatgcgcaggttgatggaccacaggctgatctgcgtaaggattccggcgaggattgcgggaatctcaaagacggtggtcaagatgcccgtgacggcgccggcgatggcgccggcgcacatgccagccagtacggcgagcaaggggtcgacgttattgttgacgatgagcacggcgcaaacgcagccgccgagggcaaagctgccgtcgcaggtcatatcggggatgtcgagcaggcggaacgtgataaacacgccgagcaccataatgccccagaggacgccctgcgaaatggcgccctgcaatgcaatgagcatgcttcatacctcctaggatagggtggacacgtgattttccataatagcggtaacactgcataaaagagctgcggacggatgttttgtctcatccgaaacaagcagggcgaacgccggtctatagcgttcgcccctgtggctcagatattgaataacgcggctatggcacgagcgcgggctctagatgcattgccacgcatgacgctacgcgtccagagcggaaaggtcgatacccagagcctcggccatctcgtcgttcttgacgacgaccaggtccttgctcgagagatgcttgatcggcatatcctcgggcttggcctcgcccttcaggatcttgacggccatctcgcctgcggcgtagcccaggtcctcgtagttgatggagagggtgaacacgccgccggccttgcacatgccctcctcgccggtcacgaaggggagcttgttctccttgcaaatctggccgacctgcgaagcacccgcggcgatggtgttgtcggtgggggagtacagcgcgtcgaccttgcccacggcagactcgacgacggactggatctcgttggagctcgagacggtaaagtcggtgtagtcgaggcccagcttgtcgagttccttcttggcggccttgatctggacgtcggagttggactcggcggtgcagtagagcaggccgaccttcttaacgtcgggcaggaccttctgcatcatctcgagctgctcggcgaccggggtgaggtcggaagcgcccgtgacgttggtgccgggcttgtcgttgtcctggaccaggccggaagcggcgtagtcggtgatggcgcagccaacgatggggatatcggcggtggcgccggcggcagcctgcgcggcgggcgtagcgatggcatagatcaggttgacgccgtcgcctacgaacttgtcggcaatggacttacacgtggactggtcgttctgggcgttcttctggtcgatcttgaccttgagaccgctcttcttgatggccttgacgaagccgtcgttggcggcatcgagcgcggagtgctcggtgagctgcagaacgccgatggtgtagtcggaaccggcggcagcggagccggaaccagagttgccgccgcatccggcgagcggagcgagcgcgagcaggccagcggagacaagaaggctcctgcggctgatggtgatgtccttcatatcattacccccagtataaaaatggctggaaacactgcactaggaaaaagtgcaagtgggactatagtaacgccgatgcccatttttacaacatcctggcgcgttttttaatactgaaccggatgggcggtgctgaggaacgacggacggtaacggggcttacgctgcgggcgcggggctgtcttcttcgtctagcgcggcaaagagtttcttgccgtcgagcaaacgcgtgctgacgtttctcatgcggctgacctcaacggtgcgcagggtgtcgtcggcgcctcgggcgtcgtagaccgttcccagcagatacgagacgccatcgcgctgcctgatggcaaagggccggaccgtcatccgcaccacctcgatttcgccccgggtcaggacatttgtgatatcaaagctgacagttgttccatggtcgatggcctgttcgacgagctcgcacgtgtcgatacgcttggcgtgcggatgcgttgccttgacgggcgcgtcgttggcggccggtgccggttcgggcatatcgagataatcgcgaacatcggcgctcgccatggcgaccaggtgctgtgccatgctctttcgaatggctatgggcgtcgatcggttgcgcatgaccatgccgtggagccgtatgatctcttcgtcagcaagcgggcgggtgaggagccgatagcccacgccgcgtttatagtcgatttcgtatccggcgtgacgaagtgcggatatcgaggtatagatgctgcggcgtgctgccgagatgggcatgcgggcggggtcgtcgggatgggcgaggagctcgaccagctcgtcggaaagcagcgccttgtcctcgccggtgttctcgctcaagagctgcaggatgcgtacggcgcgataggctgccatcgaggcggagcccctggtcgtggtctcgtagttttcaacaacggcttcggtcatagcgcccacgtcctttccttttttggtgatggcagatcagagcctagggcgcggagcctggccaaggacgcgtgacgccttggacggtcgatggttgccggcaaacggcgggtcgagttttcaacaaccctgcctaactgaccaaaaccttgccaaaagcttgacggatgctgttgaaaaagcgcccctcggcttgccgagaggcgctggcgtgatgcactggaacgcgtttgttggcgctatggcgattagaagtcggcgttacccacggtacgagggtgcggcaggacgtcgcggatattgcccacgccggtgaggtacatcaccaagcgctcgaagcccagaccgtagccggcgtgcttgcaggaaccgtagcggcgcaggtcaaggtagtacttgtactgctcgggattcatacccaggtctttgatgcgggcctcgagcagatccaggcgctcctcgcgctgggagccgccgataatctcgccgataccgggaaccaggcagtcggcggcggcgacggtcttgccgtcctcgttcaggcgcatgtagaaggccttgatctcggccgggtagtcggttacgaaggtcgggcgcttaaagtgctcctcggtcaggaaacgctcgtgctcggtctgcaggtcgatgccccagctgacggggtagtcgaacttgtggcccgcagcaactgcctgctccaggatctcgacggcctcggtataggtgacgcgggcaaagtcggagttagcgacatggtccaggcgctcgagcaggcccttgtccacaaacttgttgagcatattgagctcgtcggggcaggtggccataacgtccttaaggacgtacttgagcatagcctcggcgttatccatgtagtcgttgaggtcggcgaaggccatctcgggctcaatcatccaaaactcggcggcgtggcgcgtggtgttggagttctcggcgcggaaggtgggaccaaaggtgtacacatctccaaaggccgtggcgaagttctcggcgttgagctgaccggacacggtaaggctcgcgtgcttgccaaagaagtcctgactccagtcgacctcgccggcttcggtcaggggcgggtttttggggtcgagcgtggtcacgcggaacatctcgccggcgccctcgcagtcactcgtggtgatgatgggggtgttgacgtagacaaagccctgctcctggaagaagcggtggatagcggcagctgcgacagagcggatgcggaacacggcgcggaacaggttggtgcgcggacgcaggtgctgctgggtgcgcaggaactcgacggttgcgcgcttcttctgcagcgggtaatccggggcgctgacgccctcgacctcgatggaggtggcagaaagctcgaagggctggggcgcatcgggggtcagtttgacggtgccggtgcagatgagggcggccgagacgttttgatgggcgatctcgtcgtagttgtcgagcgcctcgcggttcatgacgacctgcaggtcgcggaagcagctgccgtcgttgagtgtaacgaagccaaagttcttcatgtcgcggacggacttgacccagccggcaacggtgacggtctggccaccgagcgactcggcatcggcatagagctgcgcgattttggtgcggttcacgtatcctcccataacggttgtacggattatttccaaacagttaaccattctaacccgcgagcggggcgtagcaaaacgtcaggtgtgatgtatgggcgtgacgtgggcaccgcgcaagcgtcgattttgcggtgcctagtgcccgcagatggcttggcgcatgagggcagcgtaggtgtcgattcccgcctgggtgaggtgtgtgccgtcgtcgacgaggtattcgctgtggccctctgaggcgccgttccagtcgatgacgccggcgttgtcgttttgggcacagacgtcacgaatcgtctggttattgcggtcctgtagctcgagcggtacgcgcacggtcacaaagtagatgggcttgccgcccacggcattaatcacgtcctgtacctgctgggggtcgcggatgaggccgttggtgccaagcgcgcagatgaccacgcttggatcgtagttggcactgtcctgtgcatagacgtcctggaaggtgtagaactggcggctcaccacgccgtcgatgtaggcgttgggaagcgctgcctgaatgccagattgggcacctgcggtgaccgagtcgccgatcatgagcacgcgggcgtcgcaggtcccggtcgcctcgtcgtaggtaaagctcttccagtcaaggttcttggggaccttttcggcgataggtccctctttgggtttttgcttggttgcgtcatcggatgcggtgtcgctgggctgggaatctttaccggatgcaggctcggcgcccttgtcgttggctccgttgtcctgggacgaggtcgcgttctgggcaagctcgggacggagctgctcggcgcgggcggtggcgatgcctgcccagtcaagcggcgcgaaggcaagtgcggcgacgcatgcggcgccaagcgcggggagcaccatggcgggcgcgaggacgtgttttcttgccgtgctgtcctgttgggtcggcttgtgggaccaagggcgttcgacgaggcgatagaaaacctcggctaccgcaagaatcagtacaagctgtaatacctgctcccaccaggcgatgcgggtagtgcgggttgcggggttcataagaagcagtaggggatagtgcaccagataaaccgagaacgagcgctggcccagccagacgagcggcttgaccgacaacagacgacgcacgatgcactccgtattctgcacgcagatgatgaggagtccggtggcgagggcaaacagcaaaaagccgccgcggtagagccaggcgctctctccggtcagcatgagtgcgccggctataacggcaacgagccacgcgatagaaatcgcgttgacctttgagatgcccttgttggcgccgggggtatggatgtcaccgctcagcatctcgcgcagacgcggcgcggcgatggcggctaaggctccgcatagaagctcggcggcacgggcgtcggttccgtagtagacgcgcgatgtgtcggcggtgggattaaacatgaggaccatggctgccgtcgacgcaagcgcgaatgcgatcgtgatgccgatggcggtgttgcgcgacctggttttgctgcacagtgccataaggatgaccggccataccagatagaactgcatagtgacagcgcagaaccacaggtgcgtgagcggcgaggggagtcccgcggcggcgaaatacgagacgttgcggaagatgtagaaccagttgctcaaaaagagtgccgatggcagggcgtcctgctgcaccttagggagtaggctcggggccgcgatgtaggtggcgacggcggtaagcgcgatggtcacgacgatcggcggcatcatgcgcgcaatgcggcggcagatatagcgcgggtacgagactccgtcgcgtgccgtggctcgcataatgcttttggtggcgagatagccactcagcgtaaagaagagtgtaacgcccaaaaaaccgccggtcaggcggctggggcgaaggtgatataggacgacgccggcgatggcgagggcgcggagcccgtcgagcgcgacgatgcgttggttgcgttgaggcgcggcatgtgcggcgcccgtgggtgtgttttgcatcgatcttcctccaatgtcgacctagcagtctagcgctctgcgcggacaaaggaagggggttcgtgcggttgaacaacatgccgcggggcgatgcctcgctacgcaaaagccgcacctgcgttgatgctcagctgcctatatagaaacgtttcagaacctctacataggcaaaaacaacagcacagatgcggcaaagatgcgcgggtggttgagcctttatgcgatgatgctcggctacttggtcttggccaccagcagcgggtcgccgagcttgacgagcggattgccgccgataagcgtgccagactcgccgacgtggtcgatgctcttgaggcggtcgagctcagagacgatgacggtcacgatgtcctcgtgaccagcggccttaatggcctcgcggtcgaagctgatgagcggctggccggccttgaccgtgtcacccatctcgacaaagcgggcaaaacccttgccgttcatttccacggtgcccaggccaacatggatgaacacacgaagaccgtcctcggtgatcatgccgatggagtggttggtgacggtggtggcgccgatacggccgttggcaggggcgtaaatggtgccggtaatgggctcgatgccatagccctggccgagcatgcccgaggcgatggtctcgtcgggaacctcactcagattgacgagcacgccgttgacgggagcgtagatgacgccttcgcgggtggcgaagcttgctgcgggcggaacggacgcctcgcccgacgaagtgaacgtggacttgagcgaatcgagcagacccatagatgcctccaacgtatcaggcgcgcatgttgcacgcgtgtggtttgccggaaacgtttcgtacgtgtttcccagcacggtcagcgctcctattttacgctgcctaacgatacctctgaacagcgattttgtgatatatcagttgaaggccaacttattgcgggggtgtttctgcgccgcgggctcaagtggggtacgctagggtgcgaaaaacgagtgcgcacgaatcgcacggagggagcacctatgattattgagaaccatgcgctgtggggcgaggagccgaccgaggattatccggcgacgtttacgtatctgggtgccgagccgctgcccgacaagcccaatggccgccgccccgcggtgatcatctgcggcggaggtgggtttacgcatatcgctccgcacgagcaggacccggtggcgtttgcatttttggaccgcggctaccaggcctttgtgctcaactatgtgacgagcgccacgggcgacgtgagctttccgcacccgcaggcggacctcgccaagatggtcgctaccgtgcgcgccaacgccgacgagtggcatgtcgatcccaagcgcgtgtgcatcgtgggcttctcggcgggcggcatgatctgcgcctcgttggcaacgcagtggaagaccggacccttcgcgggtcttgccggggctcgtccggaggatattcgtcccgacgccgtggtgctgggctatccgttgctcgaccttgcctatgtgcgcgatatgcagacgcgcgacccgcgcatcgacctgcgcgtgcccaagacgggtggcaagacggggcgcgatttgctcaacgactatctgtcgatggtgacgggcggcgaggcgaccgatgagcacctgaccgacatttgccctaccacgcatgtttcgcgccagatgccgccgacctttgtgtggggcgtgtccgacgacaagacagcgccgatcgcacaggtctatccgtttgcgcagcgcatggccgaggagggcgtcgcttgcgagatgcacgtctttgaccagggcggtcacggcctttcgctcggcaacgccaacaccgcggtcgacaacgaggacaagcaggtggcagtccgtccttggatccgcctggccttccgtttcctggagcgccatatgtaaaagtagactacttgcccgtttcaaaaagtctgcttagaggaggagccatgcttgagggtacgtatgtggttttggcccagacgccggtggggagcaagcgcggcgaggtgacgttttcacatggggtgaacggcgcgctcagggcagtactaaacgtcaggggtctcaatatcgctctctcgggtgcccgcgctgagtgcgatttctttgagctctcgggtactatctcccacgtcctgatgggcaaggcgccctttacatgcacggggtcggttgagggtgatcgactcactgctaccgcgcggtcgggttccatttcgatctcgctgagcggtatgcgcaaagagctttcggggcgcaccgcataaagtttgcgcaggtaaacatcggtatttgactttataaaatagttcagagcgctatcatttgtcgttacgagttggttagccccggtaaacggttaaccgcgtctaacgaaaggatgagcgcgtgaagctcgatacactcgagattggaaaggacgccgttgtcgcatcggtggcatcggacgatcaggcactccgacagcatattttggacatgggcctaacgccgggcaccgaagtcaccatgatgaagtacgcccccatgggcgacccgctcgagatccgcctgcgtggctacgagttgacactgcgcaaggacgatgccgctcgcatcgagcttgtgggtattcacgacaccgatacgggtccgcgcgctaacgccgcaatcggcacgacggagcatccggccctgggcgaggggacgtattcgccccgtgcggcaaagacggccgtgcccgagggcgcgccgctgcactttgccctcgccggcaaccaaaactgcggcaagaccacgttattcaaccagctgacgggctccaaccagcatgtcggtaactttcccggcgtgacggtcgaccgcaaggacggcactatccgtaaccaccccgaggcgagcgttaccgacttgcccggtatttactcgttgtcgccgtacacgggcgaagaaatcgtcagccgccaattcatcttggacgaagaccccgacgccatcatcgacatcatcgacgccaccaacatcgagcgtaacctgtacctgacgctgcagcttatggagctcgatcgtcccatggtcatcgcgctcaacatgatggacgaggtgacggccaacggcggcgccgtggacgtcaacctgctcgagagcctgttgggagtgccggtcgtccccattagcgctgcccgcaacgagggtatcggcgagctggtggaccatgccttgcatgtggcgcgtttccgcgagcgtcccggccgcctggacttctgcgcacctgatggcccagacggcggcgcactgcatcgctgcatccacggcatcgccaaccttatcgaggaccatgccgcgacggcgcacattcccgtgcgttttgcggcgaccaagctggttgagggcgacgagctggtgaccgaggcgcttcacctggatcgcaacgagctcgatgccatcgagcacatcattacccagatggagggcgaggccggcaccgaccgcctgtccgcgctggccgatatgcgctttagctttatcggcgacgtgtgtgggcgttgcgtcgtcaagccgcacgagagccgcgagcatgtgcgctccgtcaagatcgaccgcatcctgacaggtcgttacacagccattccggcgttcctggtgatcatgggcctcgtcttttggctgacgtttggcgtgatcggcgcggcgttgcagggactcatggaggacggcatcgctgccgtcatcgcctcggccgatgcgggcctcaaggcgttcggcaccaacgacgtggtgcgctcgctggctgtcgacggcgtgcttacgggtgtgggcagcgtgctgaccttcctaccgattatcgtcgtgctcttcttgttcctctccattctggaagactcgggctacatggcgcgcgtcgcctttgtcatggacaaagtcctgcgtcgctttggcctgtcgggccgcagcttcgtgcctatgctcgtcggttttggctgcaccgtgccggctatcatgtcgacccgtacgctcccatccgagcacgaccgcaagatgacggttatgctcacgccgttcatgagctgttcggccaagttgccggtctacggtctgctgtgcggggcgtttttcccgcaggcgacagttcccgccatggtctcgctctatctgattggcattgcggtcggttgcatcgcggctttggtactcaaccgtacggcatttaagggcgacccggtgccgtttatcatggagcttcccaattaccgcctgccgagcgtcaagacgacggtgatgctggcatgggataaggccaaggactttattaccaaagcctttaccattatctttgccgcgaccgtggtcatctggttccttcagacgttcgatatccgctttaatgtggtcgccgatcagtcgcaaagcctgcttgcgggcctcggcagcatcatcgcgccggcgctgacgccgcttgggtttggcgactggcgtgcatccacggcgctcgtcaccggacttatcgccaaggagagcgtcatctcgaccctcacggtacttttgggcgcgacctcgcccgcggcgctgtcgaccatgttttcgccgtttactgcctatgtgttcctggtctttacgttgctgtacccgccgtgcgtggctgcgatcggcgccgtcaagagcgagctgggcgcgcgctacgccgttgccgtgttcgcgtttcaagtgacggtcgcctggatcgtggcgtttgtcgtgcattcggcgggcatattgctggggttggcttagttatttattgacggcgcaacctctgtgtatcgaattgttttcggccccgcatctgttgctgacggatgcggggccgttgctatataatcgcctccgctcaaaatgattggagacgttatatatgagtcaggcaaggcaagacggcatcacgctcaggcagtggctcccgctcgtcgggctcacctgctgtgcgttcgtgttcaacacgtcggagtttatgcccatcggccttttgactgatatcgccgcgtcgttctcgctcaccgaggcccaggcgggcatcatgatctcggtctatgcctggggcgtcatgctgctgtcgttgccgctcatggtgttcgcttcgcgcttcgagttcaagcggatgctgctgggcgtgctcgccgtgttctcgctcggccagtttctgtccgctgtggcgccgacttatcccatcctggtctgcgcgcgcctggtggtcgcttgcgcacatgccgtgttctggtcggtcgcctcgattatggcgtcgcgcctggttgacacacgccacggggcgctcgccatcagcatgatcgccacgggctcttccatcgcacagatcttcggcctgccgctcggccgcgccattggcctggccgtgggctggcgtatgacgtttgccgtggtcggagcgctgtctgctgtcgcggtcgtctaccaggccacggtgttccccaccatgccagcgggcgagcgttttacgctcaagcagctgcccgacctgctcaagaacccgttcctcatcgcgctctatgtggtcacggtctttatggcgaccggctattacgcgggctatagctatatcgagcctttcctggctcaggtcgcgcatgtcgacgcaagcgccatcaccatgacgctgacggcgtttggctgctctggtctgctcggaagctggctgttcggtcggctgttcgatgggcaccggttcccgtttctcgcgattacgctctccggcgtgccggtggccctgctgctcatgggcccggccgcgtcgtcgctcgtggcagtgcttgccgtctgcgcgctatggggctgctgcgccacggcctttaatgtggcgtttcaggccgagctcatcaagcacacgccggcggactcgtcggccgtcgccatgtcgatcttctcgggcctgttcaatctgggcattggcacgggtaccgcgatcggcggagccgtggtttcgggccccggtatcgccttgatcggctacgcgggcggtgcgatcgctgccgtgggcgtcatcctcgctatcacggtgatgttcccggccattcgtcgcgcaaagcctgtcgcctaaccacgtcccctcatcagttgcggtgaaatacggactgctgggcccaataaacccggcaaacagtccgcatttcaccgcaacttagaaagggactggggtagctaatttgggacggggcttttttagctacctcgctgagcatacgtaaaagaggccgaggccgctccggtgtgtgctggagtggcctcggttttgtgtctgcgtatgatcgacctagagctcgtcttgggggacgacagccgtaagttgctcgttctcaaataccgcagcaagtccgtgttcggggtcaaagcgatagttgcacatgagcgctgctttgcgagcatcatcgctccgaagtaccacgatactggtcggaataacgtatctaaagatgtttgtaatggggccctcgatctgatcgccgtctctttcgagacaataatcttcgatcgcttccttgctgtcctcaacggtatcccagcttgcaagcagggcgccctttgcttccttttgaatgtcgaggacgccttggtccgagtcacactcgtaatagacggggagcgagaaatccctgccccacagattcatgccgttagtcatcgaagccgccaatctgattcagtatgtttttgatttcgcttacgccgccgagatggctgcacaccttgtgaacttcggtcggaacaagagagcacgtcttcatatcattgtgttcgtgccaggtgtactcatttgcctcgcgccatttcttgacatcctggtgcgtccaatcatctttgccatcgcgttgctcaaggttccaagcttttgcgcattcagtgtctgccttttcatagttgccgacaatgcgttcgccgttctcgcccatctgcgaaagcctatgctggctcatgccttgtatggttactttcgcttcagagatagggttgaagtcaggaattccatccttgtaattgatgccctcaagacctttgtttcgaagaatctcgcggaccctatcggctgtgggaataaacatcgattcccctcggtcacccgaccattttccgtttggattctcgatgctcggtgtacggtccagcctctccttatagctcgaaggataatcgcacgattccaccgagggtctaatcaatttgtcgggatcgatggattcgttacggccggcatttttaacctctgccttggtttcctttgattcggggccaatgagtttatcaggattgaacccaagtttatcgcctagcttggccacgccgcctttcatttgcttgaactccattagctcacctcgctattctcgttccagttgtgccaatcggaatatgcttgggtatcttgcatttgcagacacaagacatcggtcatgatgccctggatgatgacctgcctggtgcggctgtcgatatcgcggtcgattgaggacctgagtgccgcgtccgccgccattgtccattgttcggcttcatcgctgcactcgcgttcgtcctcgaccgctttggcaacgttgggaaacagtgtgctcattatgggtcccagcttggtcatgcgcggttcggcgggtgggttttgaacggtgcgcaggatcttgacctttgtagacgcgtcgatatggaggcgatcgagccgttcgcgaatgctgtgcagctccgtcttggttccgatgctgattccgtaggccagcatgcgcgctacggcaagggcatcatcgctctggttgcttgcgacatcgtcgatggggcggctgtatgcaaagtgctcgccatcctctgctttggcgatcttgcagagcaccggctcaacccaatcgttttggtaaatggccgcaacgcctttaggcaggcgtgccagttcgacgatctgttggtcgttgaggttggcggcgcgaccggcgagctcgcggtccgaaagatcgggcaggcgatggatgatcttggtatttgtgttgcgaatggctgccatatcgagaagtccgggcgcctggtcggcgatgatgaagccttcgccgtatgtacgcatctcggcgatggcatttgagatcatctcgacgctcttgcctgtcaggtcgccgctttccgagccttggctgctcgacgatcgcttaagcaggttgtgcgcctcttcaagcacggtcagatggcgaagtggctggttcatgccctttttctcggccatgcgatgttcttgaagtttgagtacaagaagacccatgagtagggattttgtttcggcggagccaatgcgcgataggtcgatgactgtgttggcgtcaaaaagcacggtggcgtcgacttcgttcgacgaaagcatcatgccgttgagcccgttggtgagtgaattgagacgtgtgagcagcgaacccttgtaggcgcccttattttcggcgtcgtactcgctggaatcgagaatctcgcggacgttgcgggcaacatctgcaaagcaaggaaagagatcggctccatatgggttatcagaagcggcaaggtcccatccacagtcttcgtatgacctggcgacggcgtctttaaggacggcgggcatggcggcgtacatgggccagcagacattaaagatctcaacgagtcggtcgaggtgttccagcacatggatgccggacgggaagctaaaaggattgatacgcaggagcggcgtgaattctggattggttccaaagacgtttacgtcttcgcgggctccatacacgtccttgtattcgcccttggcaggttcaatgacaaggaagttgactcgctgatcgagcgcttggtcgaggatgcgacagacggtattggtctttcctgcgccggtgctgcccgtaacaaaggtgtgcgaggcaagtgagtcctttgacaggaacgtttcgatgcgttcctcgcgatgcatatggaaaaccttgcctatgcaaaggccctgctgaggctgcgtaccatcgaacgtagagacgttgcgcccaaaagaagcgcattcgataacgggcaaccctgggacggacttcttgggaaagttgagcgaataggccagctccttgcccgaaagggcagtcgttgcatcgaccgttgccggatagaccgaaaagctcggatgttgatcgagcagggcgggggagagggcaaaagcaggatggcgcaaatcgcgaaggtaggagcagattgccgtggcgtcggcgctttgctctccaaggtctccgcgccagaggtttactgcagcctgagacatataggattctttgccctgggtgagggcgagataggtgtgggcaacgttattcgcgacgttgtggtcttctgctagcacgtaggcgcaaaagtcccacatgccgagtgccgaggcaaggtcgtagcgcttcatttgcaactcaagtatttcgagcgcgtgttggatggagtaattcttgaacgtctgcgtgatgccttcgtcggcgccgatggtagcggtgaccgtgcttgagcgtgcgaacgatccgccaaagttggcacctagatttactgcctgcgaaacaccggaagtcacggaagctcccttagagacagccttgccaacaccgctggtgacggctttgccgagcgtgttggatatggccttgccggtagatgagcttgtacctgttgccgtggacgtggagtgcgacgaaccctccgtgtgacttgcggatacgcctaagtcaacgcctccgctcgaggactcattcctgccgtcggtgaccgtatccgtgatgctttcggtcgatgtggacgagtcggttacgctctcgttgctcgattccgaggtcgactcgtttgtcgagtccgtttcgttgtagttttgagcaacagcctgattatttcccacctgtctgccggcgctcacacctgcattgatgccaatcgtcgcggacgatccgatggagtcgttctggtgatgggtgtagttggtcgtccatgaggcataaggcgttagcagtgagtggagttcggcgaggcggagtttgcgcgattcgatatcatggatcggggttgcgagcagcacgatagtgtagtcttcgctcggcctaccgggcacaatgccgtcgagaaccttctcaatagtttgcgtgacgaacttctcgttcttttcggctggaatattcgaaacggcggcaaccgaagacgggcgtcgattgtctagacacggaatgggaccgcggttggcgggccccacttcggaaccggggaagttgcccctcaaggcatccgacatgcgccgggaaaaattatcggcgtcgatgttgtcgcgagcattgtcgctattgacgactgcgagaaatacctcggtgcttgcgctggttcgattaaagatcagcgcaatgttgcattcttcgtcagaaagaacgtcgtatacatttacaagcttctcgagactgtcctcgttgggatcgacgatccacttcgtgatattcatgaagcggatgttgttgtcggcgttaaagcccatggggtattcaatggaggggtcaatcggcgcgtaaacatttcgcagctgcggcagataggcgttgtgaagctcaacggcggcagttgccaagagccgattggtgagctcgacagcttgctcgtctgccggattcggcttttctgacaagtatgctgttcgcttttggtcgacctcatcgagctgggagctgctgagtaccgagacggttgcgaccgcgttgccggctttatcggcagcgcgcataatcgcgtttttgatgcccatacgatcagcctattccttccaattaatgacgcgcgcaatgtattcttttcgattgttgagtgtctcgagttttgcctcgagagcgttgatctccgcggtttgcctgttgatgtcttcgacatggtcatggagcaccgggttgtagtcggtgatattgctcgtaatttggccaagcagctcgttgagccattcggtaaagccgtaggtatgctcgcgctctatttcggcgcgtgcttcgcagaaacaccgtgagatttcgcggttgaatttatcttcgactttcctaagcaaaagcttgtcggatttaaagatgacacggtccatgagcttcagttcggtaaagtctgccttgctgaaaatggggccctttgtcttatcgagcgcgaggccacgatatttaagaatgatatcgccgacctcttggcgcttttcttcggaaagaggattgtcactgctggtagcgatgcgatagagggcatcgcggctatgctccgcacaatccttccaatagctttgcgacagctcatcgatggtctgagctatttgctcggtacattcgtcatagtgattgatgacctcgttaaagagttggtcagcggcatctttgtcggctgttctttcggcagcctttgcatcggatcttttgtgaaatgcatcggttatgtcatcgcaaagacccttgccaacgtccgcaaggccacccgttggacaaggttcactatccttttgcgcattgacctggcttccctttatggagtcgccgagcctattgaagaagttgggtgcaatcgaatcaaatgctttcgctgccgcgattgagcgttttgagtactcgagcccctctcgcttttcctcggtaatggcgttttggcgtgcctggagcgcatcaagactggtctcccattgtttggccgaaaccctcttgtcgattgtttccctatagcttgccgaagcatcttcctttgcatgctccttgcaggcttcgagctgatcgataagagcgcgcttatcctcttcgagttcggcttctcgctgcgctttcttttgttcaaggtcggttttcttgtcggcaatctcttcttcggttatgccgacaatttcttgcagaagtgattccgacctgctgcatttgttatatgcggagtaccgttcggcaaacaggcgtatttcgttctcgatgcaaaagagtccgctattggcaagaaggaggtccttgcaagcctcggattcgcgattggttctgcgcgagatctgtcccggaaggatatcgtaacggtagagcgttttgtagaagcggcttgtcgggtcggtgtatttacgctgctggtcttcgaatctttcggcatagttgtcgcttataaactcgccggagttctttgagcctaggccgaggatggaagaaacaaagtagataccttgaccatagagcctggacggaatgaactggcgcatgatgtccgagactcgttcgtcgtcaaacccgcctttgggaaggtcggcggaatccgccttgttgactacgatcatggcaaagcgttcatcgattgcggggatctcctttatttcgttggagaggttctcgttgtctttcgtgtcgagtgtggtgtactcggcaacgaaaatgggaagaccgttcgagaggccttccatggcttgtttgagcactcgggcgtgatcgacgttggaggcagagtttgaccccggggtgtcaaagatgacaaactccctgtcgtgaggccatggatcggtatcgctaaagggcacttcgattctgatcagatcggagatggtccggtcgtcttcatcggcatggtatgagttaagaaccttgagggcgctgttcatatgagaggccatgccgggcatggagtcggcgactttggccgcgatcttgtcgtataggggctcccccacaagctctttgttttccatgaggccatcaagatcaaagcgcagcaagaaccgcctgctgccacaggagaattgaaccattgcgcgatctcggtcttttgaacgtttgatttgaaatatgcgggccgttacaggctcgtcgccgctgggaaggatctccatgccaatgagggcgttgatgagcgtcgatttgcctgcactatagttgccgagcacacacagcgggatgatgtcgctcgagacatcggtgaacttcctaatttgctcagagacttttgttcgctcggagactgcttcgtctacaagcccctggatttctctgaagacttcgacaatttccggcaagacgtcacgggcgtttgatagatagcgctcgtctcgtatgacctcgtatgtattggcacgtggcccttcggtgcagatggcgagcaactcctgccattcgtcgtctgctccttcaaaatgcaattcaattctgtcgccaccaccaaactctttggcgaggatgtcgatgatctcttcggccttaaaggggaagaaaccattaacgatcttcgtgctatggagcgcgctattgggatttgtagatgtcgttatttcttgccagccgttatcccatcggaagaaccggacaatttcttgatatggattgctgacgatcttgattttaatgtctgccatcgttcaactacctttagtagatcaggtgcgggaatatgccgcctttatcatagggtagccgcccgtgcggacacccctctattcgctcggcggcatctcggcagtaccatttatttggcaagatcctcgccatcgccgtaatgttcccagccatacgccgcgcaaagcccgtcgcctaatcacgtccccttatcagttgcggtggaatagttcctgtttaaggcctctgaaggcccaggcaggaactattccaccgcaacttattttgggggagaggatacaagccgggcatacaatggatgtcgttgtgttgagcttatcgggaggttgctatgtgggcatacgagacgacgttctatcagatctatccgctgggcttttgcggggctccgcgcgaaaacgccgcgcccgttgtcgaggatgagctcgcccaggctgtcaacgtcgcgcccaaccccgatgctcctatcatgaaaatcgcccaatgggccgactacctgcaggaactcggtattggcgccgtgctgatcaatcctccactcgagtctgatagccacggttacgacacgcgcagcctgcgccatatcgaccgtcgcctgggcggggatgccgattttgccgccgtgtgcgagacgctgcatgcccatggcattcgcgtggtgctcgatgccgtcttcaaccacgtcggtcgcggcttttgggccttccgcgatgtgcaggagcgcaagtgggactcgccgtacaaggattggttccacatcagctttgacggtgactcgtgctacggcgacggcttttggtacgagggctgggagggccattttgagcttgtgaagctcaacctgcaaaatcccgccgtggtcgactacctgcttgagtccgtgcgtcgctgggccgaggtctttggcatcgacggcctgcgtctggacgtcgcctatatgctcaaccgcgacttcatgcgtcgcctgcatacttttacccgtgagctcaagcccgactttgtgctgattggtgagacgctccacggcgactacaaccagatcgtcaacgacgagatgctcgactcctgcaccaactacgagtgctacaagggcctgtactccagctttaactcggtcaacatgttcgagattgcccactcgctgcatcgccagtttggcggtgacccgtggtgcatttatcgcggcaagcatctgctgtcgtttgtcgacaaccacgatgtgccgcgcctggcgagcatccttaccgacaagtcctgcctacgccccgcctacggcatgatcttcggtatgccgggcattccgtgcgtctactacggcagcgagtgggggattgccggcgaaaagggcggccccgatggcgattgggcgctacgtcctgcgcttgacgagcctgcgcccaatgagctgacggcatttgtcacgcagctggcgcacctgcgctcggcaaacgacgcggcggcccgcgccctcaactacggcgcctatcgcaacgtggtgatccagaacaagcagctgctgttcgagcgcgcctgcgacgacgcgacggtgctcgtggcggtcaatgccgtgaacgagccctatacctttggagccggcgaactcaacgggtcctttgtcgacctgcttgccgacgatgcgcccacggtcgagctgtcgagctcacttgaacttgcgccctatgaggtgcgttatctgctgagggcctaattcatgactgcgccggacgagggctatcagcatattgagcatgggcttgagcccgtgtttgacgagcgctcgcgcgttttggtgctggggtcgtttccctcggtgctctcgcgtgccaatgccttttactatggcaatccgcagaaccgcttttggcgcgtgatggccgcgtgccttggtgcgcccgtgccgcccaacgagggagactctttggcgagcggcgagcccgcgacgctcgatgcctcgattgccgccaagcgggctatgctgctgaacggcggcgtggccctgtgggacgtgatcgagagctgcgacattaagggttcgagtgacgccagcatcaaaaacgtcgttccggcgcatgtcgagcgcattaccggcgcagctcccattgagcaggtgatatgcaacggtggtacagctggtcggctctacaagcgctatctacaagaacgcaccgggctgccggccatcgttctgccgtcgacaagtcccgccaatgcggcatggcgcctagagcgccttgttgggcgctggcgcgaggccgttgactggggcgctctgtaatttagatatctgattgggcgcgggtgccgaggcgtttcatgatggcatgccagatcggtgcgggcagcgcgggcttgacgcgcaccatgccgtcggcatcgacgctaccggcattgccgccgccaagcagctgcgcatgctcaatggagcagcccatgcgcacagcgcccacaagcttatccatcgcttccgaaaatggccgacgcaagaggcccatacgcggggagtggcgaagcgccgcaatgccgctgccggcacagatgacaacgccgtcgcaccatggcaggtcacgtagaagacatgcccgatacaggcggtcgagaacttcgtccgcctgcttgttgtttttggacgcggcctggacgacgacatagatgcgtgtctctgtatttccaaggcgatcgagtatctgctcgacagcgatcatagcctcatcgtcaaatgcatcatcaacagcgagcaccatgccatcgactgcaccggcatcatccgccttcaagtcaaccgggtggggaagtacggtgtcggaaagccgggcataggccgcgatggcatcttgcaggtcccagagcaaaaactcaagatcggagctattgggaatgctgatatacgcaatggtttgcagcgtttttggtacatcgccgcgcgcgatcgtctccatgccgcctcctttccagttggtttccgtttaggttacaccgtctggcggcgcctagccgcgctatcctagtgcaacccttacgaaaggaacgccatgcgcctgcccatgaatacttcgcttgccacgctcaagccctccggcatccgccgaatcaacgcgctcgccgcccagcatccgggatgcattgcgcttgcgctcggcgagcctgattttcccacgcccgacgtgattagcgccgaggtgactgcttcgctggaccgcggcgatacgcactatccgcccaacaacggccgtcccgccctgcgcgaggcgctgtctgcctacatgggggacgcgggccttacgtttgcggccgacgaggtcatcctgaccgacggcgcgaccgaggccctgtcggcaacattcatggctatgctcaaccccggcgacgaggtcatcatccccacgccggcctttggcctgtacgagagcaccgtcgtggccaatcacgccaaagcggtctttttggatacggagcccgcgcaatttcagattgacgaggaagcgcttcgcgcctgcgtgaccccggcgaccaaggccatcgttatctgctcgcccaacaatcccacgggctgcattctcaacgcggcatcgctcgacgccgtggcgcgcgtagcggagcaggcgggcatctacgtagtctgcgacgacgtatacaaccgcctcgtctatgtggacggctacgagcgcttcgcccagcgacacccggagctgcgcgagcagacggtggtcatcgagagcttctccaagccctgggccatgaccggctggcgcttgggttggctcgcagccgcagcccccgtcatcgccgagatcgcaaaggctcaccaatacttagtatcgagcgccgtctcctttgagatggatgccgcagcccgagccctcaccgtcgacccaacccccatgctcgaagtctaccgagcccgccgcaaacgagtcctcgcagccttagacaccatgggcctcgacgtggtggagcccgcaggagccttctacactttcccgagcatcaaaaaattcggcctaacaagcgaagatttctgcatcaaagccatcaaagaagccaacgtagccctagtccccggcaactgcttcggcaccgaaaaccacatccgcctaagctactgcgtaagcgacgaaaacctagacgaaggcctccgccgcctgtccaccttcgtctcaaccctatagcccaacgggacccaacccatcagcccaccgacttaaggcttatgagtgggggcgtcagccaacggaaaaccggcctgccccatagttgacgcaggccgcgccgccgaaggccaggcgcaaggttttcgtagattccgcacgagccggaaagcacttaatgtgctttccgagcgagcccaggacctgaccgagcgaaaaccttgcgcctggccttcggcggtgtggccggatggtggaattgtgtgcagcccagtttcccgttgaccgacgccggggtccccgccataatactttcggttcacgcacgaatccgctgccagagacagccggtgcaaacgggcatcgcccgcgagcttaatgggatatcccgccagccgaggtggtcgagttgatatgtcttctcgcccccgtcgctcatgcagcgcgggggctttctttttggacatgcccccgtcacgtccttgtggcggaccgtgcccggaaagaattcgaggaggtgtaattcatgccccagcagtacaaaatcgacaaggttgcagagatcgagtctcgtatcgccgagaacgccggtctgttcgtcgtcaactacaacggtctgacggttaagcaggctcaggagctgcgtcatcagcttcgcgagtgcggcgccgagatgaaggtctacaagaacaacctggtcaagatcgctctcaagaaccaggagcagcccgagctcgacgagatcctcgccggccccgtcgcttatgtgttctacgagaccgagccggtcgaggccgctaagacccttaaggacttctccgctaagtccaagggtgtccttgagatcaagggcggtatctccgacggcaagcccgtttccgctgatgatgttaaggctatcgccgagctgcccaccaaggatcagcttctcggccagatcgccggtctcatctccggtttcgctcgcgacatcgctgtctgcgtcaacggcgtttcctctggtctcgctcgttcgatccagcaggtctccgagcagaaggcagcctagtcgctgttttcacccgcggcggcaacgtcgcacccctggcgcattcgcgccgtgttttaactgatctccgtgcatccgcacggaaaccgaaaggacttagaaatggctaagcttaccaccgatgagatcatcgatgctcttaaggaaatgacccttctcgaggcttccgagctcgtcaaggctatcgaggacaccttcggcgtttccgccgctgctcctgccgctgttgtcgccgctcccgctgctggcgctgctgaggccgaggagaagaccgagtttgacgtcgtgctcgagggcttcggcgacaacaagatccaggtcatcaaggccgtccgtgagctcaccaaccttggcctgaaggaggccaaggaggtcgtcgagggcgctcccaaggctgttctcgagggtgccaagaaggaggacgccgaggctgccaaggagaagctcgaggctgctggcgctgctgtcaccctcaagtaatcaggctctctcgccagatttctttgcagacggggttcgcattgcgagccccgtcttttttgtttttgtcccctcattcccattgctcggcatgcagaacaccgctgtctttgccgtgccaatcccgttaccgctggggcgtaaaattgcaccattcgagcaataatttgcgttgacctgctgaagaattgcgtttgccttacggcgacgtatgtctccggcggtaagatacttcggtatcgcaatttggtctgcggccgctgtgccgcacgcacagggcgcattctgcgcctgcgaaaggatccttgaataacatgaaggcaatcatccccgccgccggtcttggcacgcgttttctgcctggcactaagtgcacgcccaaagagatgctgccggtgctcgacaagccggtcatccagtacgtcgttgaggaggcactcgaccccgaggaggtcgacgacgccatcatcgttacctctcccggtaagcccgagctgctgagctacttccagcccgaccgttcgcttgagaatctgctgcgcgagcgcggcaagaacgcctatgccgatgccgtcgcccacgctggcggtatgccggtcgacttccgctatcagtacgagcccaagggtctcggccatgctatccgctctgctgccgacgccgtggcaggggagaacttcctggttcttctgggcgactacgttgtgcctaaccgcgacatctgcgacaagatgctcgccgtttccaaggagcacggtggcgcttcggttatcgccgtcgctgcttgctcgcccgaggaagtcagccgctacggcgttatcgccggcgagcgcgtcggttcgctcgagggcgccgagggcgttgccgatgccgagccgggcgctgtctggcgcatcggcggtctggtcgagaagcctgctcccgaggcggctccgtccaacctctacatcgtcggccgttacctgctgagcccgctggtcatggacctgctcgccgatcagcaggccggcaagggcggcgagatccagcttaccgacgccatggcccgctcgctcgaccgcgaggccatgtacgctgtcgttatcgacccgctctcgggctacgacaccggtaccccgtctggctggatggccaccaacgctctcatggccgcaagcgatcctcgcttcgccagcgccttctgggacgccatcgacgagcgcggcggcttgatgcgcaagtaagccttcgggcatcaacatttacgggtgtggacttaggtctgcacccgtttttttcatccaatgtgacaaggggacagtccctttgtcacatcctgccgcttcacctgatttccttccaagcaaaagggccgtcccgtgaggggcggcccgatttggctgtgggttcgcttgtcaggtgctattcgaccggatggccgcacttggggcagaacttggcttctggtacgagtggggtgccgcagtggcggcagaatttcggggcagaagatgcgaccggctgctggggaatgactgtgaggggctcccctgacgattgccattgtgtatcaaatgccgaatcagcagaagattgttgagcgatctgctcctgctgagcatgcttctttcggcggctgcccttgcgcgtcttcgctttggatgcagtgccggcgatgcttgtttgagccgcgtcgcgctttttgcgacggatgcaaacgactgcgatgcctccgatgattatcaggacagccgcaatcccaccgccaataacgattggcatgttgtcctgggcaaagaagatgagtttttcgatcgggctatagtggatattcgacttgtagatgtcgacgtgcaacttctttgagtctttgggatcggtatagtccacggcgatctttcggtcgttgtcgaggaagcagggacggcatctgtggtttgacttaattttataatcacatctctggccgttccgtgtatcaacaaggcggatggcgttagttttttcgctcgaggctccggtcaatgcaatatcgccatttctcgagatatcactgatggataaccaggaatcttcgtcgtcattcctatttatatagctgatttgttttccagtctgcgagtcgatgacaattgtgtcgtcgttttcgcctatctgagccaggaggagagcccctctagcatcgtaaatccagattttgctgccgtctgcaacggtatcgatgttcccgtcatagtctgctttgaaaaaggtgtgatggtcttcaccatcactgttagcgcctctaataagtagggtatctgatctagataccctacttatagaatcgcatttagtgttgcctggtatctcttttattaacgtggaaccatcgggaatgtcgattaccttgagttgggactttttctttcgatacgaatagacatacaggcgttttccgtcttttgatgttgtggcgcttatttcgccttttttaaggctgtagctaaacgttatctcatctgacttcaaatcgaaaacgtccacttttgttgctttgccatcgttatccctatccctatagagggtgagggtgtttccgtcttcacttaacctaaaggtgaggaactcagatttctttatatgtagagagtgaacggtccgttgctggtctttgatggaaaagaagatgagcttgttgccgtctcgccaataaaggcgcttgccatctaaggtgatataaatgttgcaggacttcgattttggtagactgatcggagtgacttccccggttgtaaggtcaagccgcgaatagccgattgtgttggaattcgagtcctcatctccaataatggcatattttccatcattcatgaaccatgcggacgagtattcgctctcgacatcgatcgtaaatgacttctcaagctccggcgtcggtaggccgtcagctaatgctgcggggggggtggccagcggggtcagcgccgctacgatgccgattgtgaccgcggcgatcctcccgccttttcggatgctcttgaacatggcaatcctttcgttgggttatacgtaactatctagtatcttcatgccggattcgaagaatctgttgcgcaacattgtcaaatggacgtgataaagcggcggccgctttgtcgcgtgctgccggaaagcgtgtcccactcttcggtcgaattccgggatgcgctttccggttggggcctctagcggaaactacgacccggaatatcggctcagaacgggacacgctttcccgaacagggctcaaccggaaactgcgacccagtttgaggcctcaaaacgggacgcagtttccgattgaccaatcctcgccgtcattccgccgttcagcggcccgcaccagcagtctcgttcacataaaatatatgaacaggtgttcgatacatacctatctacctgcatctcttctgttgaaaaactttgctactccaaaaactcaatcgcgtcaaggcttttcttgcccaacggtcggtacctgataaactattaggttgcgataactggcgaagctatgcctcgccaacccaccgagcatttccgtgaaggaggaaaaacctggtgacctacgcatacactgccactgagcgcaagcgcgtcagcttcgggaaaatcccggaggccatggagctccccaaccttatctctgttcaaagggaatcctttgagcgttttaaggatgagggccttcgtgaggcgttcaaggaatccagccccatccagagccagaaccatgttctcgaggttaccttcggcgagcatcagttcggcgatcccgcgcacaccgtcgaggagtgccgcgagaaggacatgacctatcaggctccgcttctgaccgacgtccgtctcaccaacaaggagaccggcgagatcaaggagcagctcgtcttcatgggcgacttccccatgatgaccgatcagggcaccttcatcatcaacggtactgagcgtatcgtcgtctcgcagctcgtccgctccccgggcgtgtactacagctccgagatggattcgggcaagcagatctacaaggcccagatcatcccgtcccgcggtgcatggcttgagtttgaggtcgacaagcgcgaccagctcatggtctccatcgaccgtaagcgcaagcagagcgccacgatgttcctgcgcgcccttggcatcgccgtcaccaacgacgacatcatcgagctgctcggcaactccgatgtgatcaagcgcaccctggagcgcgacaccgccctcactcgcgaggacgccctcatcgagatctaccgtcgcctgcgcccgggcgagcctcccaccgtggacgcttcccgcagcctgctcgagggtctgctctttaacccgcagcgctacgacctggcccgcgtcggtcgttacaaggtcaacaagaagctcaacctcaccaccgaggaagaggtcacggtgctcaccgacgaggatatcgtcgcgacgctgcgctacctcctgtccctcgctgccggcgagcagggcttcaaggtcgacgacatcgaccacttcggcaaccgccgcatccgtaccgtcggcgagctcgtcgccaaccagttccgtatcggcatgagccgtatggagcgcgtcgtccgtgagcgcatgagctcccaggacatcgacgagatcaccccgcagtcgcttatcaacatccgtccgatcgtggcttccatcaaggagttcttcggttcctcgcagctctcgcagttcatggaccaggcgaaccccctgaccggtctgacccacaagcgccgtctgtccgcactcggccctggtggtcttgccggccacaagtccggctccagccgccgcaccaacgtgccgacggccgtccgcgacgttcacaattcgcactacagccgcatgtgcccgatcgagacccccgaaggccccaacatcggcctgatcggctcgctcgccctctacgcccgcgtcaacgagtatggcttcatcgaggctccgttccgtcgcgtcgagaacggcgttgccaccgaccagatcgactggatgaccgctgacgaggaagagaagcacgtcatcgcgccggccaacacgccgctcgatcccaagaccaacgagttcatcacgaccgatgccgagggcaagcttgtccgcccgcacaccgtgatcgcccgtacccgcgacttcgacggctccttcggcgctcccgccgacgtgcccgtcgaggacgtcgactacatggacgtctcgccgcgccagatgctctccgtcgcagccacgctgatcccgttcctcgagcacgacgacgccaagcgtacgctgatgggcgctaacatgcagcgtcaggccgtgccgctggttcaccccgccgctccctatgtcggtaccggcatggagcgtcgcgccgctctggactccggcgaggtcaccctggccaagaacgccggcgaggtcatctttgccgacgccgccaagatcatcgtcaagcatgccggcggtatggacgagtatcacctggccaagtaccagcgctccaaccagtccacctgcatcaaccaccgtccgctcgtgcgcgtcggtgacaccgttgagcagggcgagcctctggccgatggtccttcgaccgatcacggcgagctcgcactgggccagaacctcaccgtggcctacatgccgtgggaaggctttaactacgaggacggtatcgtcgtgtccgagcgcctggtggccgaggacctgctgacgaccatcaacatcacccgtcacgagatcgacgcccgcgacaccaagctcggccccgaggagatcacccgcgagatcccgaacctctccgaggacatgcttgccaacctcgacgaggacggcatcatccgtatcggcgccgaggtcggccctggcgacatcctggtcggcaaggtcacgcctaagggcgagagcgctctgaccgccgaggagcgcctgctgcgcgccatcttcggtgccaaggcccacgacgttcgcgacacttcccttaagatgcctcacggcgcttacggccgcgttatcgacgtcgtccgctttagccgcgagaacggcgacgacctggcccccggcgtcaacgagcaggtgcgcgtctacgtcgcccagcgtcgtaagattcagcagggcgataagatcgccggccgccacggcaacaagggtgttatttgtaacgttctgccggtcgaggacatgccctacatggctgacggtaccccgatcgacgttatcctcaacccgctgggcgttccttcgcgtatgaacgtcggccagctgctcgagtgccaccttggctgggctgctgcgtgcggttgggataccgagcaggccgactccgacaagtacgtccccggtccgttcttcaccgccacgcccgtcttcgacggcgccaaggaggacgagatcgccgaggtcatccgtcgtgccaacaagaacatgctcaacaaggccaccgctgcctttggcgatcacatgcgccccgagttcgtcacccagcttgacgagcgcggcaagacccgtctgttcgacggccgcaccggcgaggagttccgcgagcccattaccgtgggtacgtcctacatcctcaagctcggccacatggtcgacgacaagatccacgcccgttcgaccggcccttacagcctggttacccagcagcctctgggcggcaaggctcagttcggcggccagcgcttcggcgagatggaagtttgggcactgtacgcttacggtgcttccaacgtcctgcaggagatcctgaccgtcaagtccgacgataccgtgggccgcgtcaagacctacgagtccatcgtcaagggcgagaacgttcctgtcccgggtatccccgagtccttcaaggttctcgtcaaggagatccgctccctcgcactggacatcgagcccatgcacgatgccgacgaggacgcctccgcccctgtgaccgccgaggagacctccgctctcgacgacctggctgcgctcgccggcgttgacgccgacgtcgaggccgaggatgccgagaccgccgaggcacccgaggctgtcgccgccacgaccactgataaggagtagttgactgtggcagatttcgaagctactgattttgactcggtaaagatctcccttgcctccgccgaccagatccgttcctggtcgcacggtgaggtcaagaagccggagaccatcaattaccgtaccctcaagcccgagaaggacggcctgttctgcgagaagatcttcggtcccgccaaggactgggagtgctcctgcggcaagtacaagggcatccgcttcaagggcatcgtctgcgagcgctgcggcgtcgaggtcacctcggccaaggtgcgtcgcgaccgcatgggccacatcgagctcgccgctcccgtgtcccacatctggtacttcaagagccccacgagcttcccgatgagccgtatgctcgacatcaagtccaaggacctcgagaaggttctgtactttgccagctacatcatcaccgaggttgactatgaggcccgcgaggccgacgccgacgacctgcgcgaggagctcgccgccgatctggaagagatcgatgccgagtgcgcccgccagatcgagtccctcaaggagcagggcgaccccgagaactttgacgagttctccgacgaggagccgctgacccccgaggagatcgcctccggcatcgtcgatatcgaggaagagtgcaaggacgagaagcagctccgtacggacgccttcaacgccttcatgaagctcaccgagcgcgacctcatctccgatgagccgctgttccgcgagatgacccgctattactccatgtacttcaagggtggcatgggtgccgaggccgtccgcgacctgctcgccgccatcgaccttccttccgaggccgagaagctcaaggccatcatcgccgacgaggactcccagaagcagaagcgcgagaaggccgtcaagcgcctcgaggtcgttgacgccttcctgaagggcggcaacagccccgcgaacatgatcctggacgttatcccggtcattccgcccgatctgcgcccgatggtccagctcgacggcggccgcttcgccgcgtccgacctcaacgacctgtaccgtcgcgtgatcaaccgtaacaaccgactcaagcgcctgctcgacctggacgcccccgcgatcatcgtgaacaacgagaagcgcatgctccaggagtccgtggacgccctgttcgacaacggccgccgtggtcgcccggtctctggccgtggcggtcgcccgctcaagtcgctcgccgaggccctcaagggcaagcagggtcgtttccgtcagaacctgctgggtaagcgtgtcgactactccggccgttcggttatcgttaccgaccccaagctgctgctgcaccagtgcggtctgcccaagaccatggcgctggagctcttcaagcccttcgttatgaagcgcctggtcgagctcggcaaggtcgagaacatcaagggcgccaagcgcgctatcgaccgcggtgccacctttgtgtgggacatcctcgaagaggtcatcgacggccgcgtcgtgctgctcaaccgtgcaccgaccctgcaccgtctgtccatccaggcctttgagccggtgctggtcgagggcaaggctatccacctgcacccgctggtctgctcgcccttcaacgccgacttcgacggcgaccagatgtctgtccacgtgccgctgtccagccaggctcaggccgaggcccgcgtgctcatgctctctgcgaacaacctgcgctcgccggcatccggcaagccggtcaacatcccctcgcaggacatgatcatcggtgtgtactacctcacccaggtccgcgacggtctgccgggcgagaaccacgtgttcgccagcttcgacgacgcgctgcacgcctatgactgccgttccgaggtcgacatgcaggccaagatccaggtccgcgtgtccgctgccgacgccaacgtcatcaacgaggacggcacccgtatcttccgcgtcaagaacggcaagaacgagtttgtcgactatgacgtcaccggcaacaagaccgcgcgcttcgagacctctatcggccgcatcatcttcaaccgccagtgcctgcccgaagactatgagttcatgaactacaagatggtcaagggcgacgtggccaagctggttgcggactgctgcgatcgttaccccgaggccaaggtcggcccgatcctcgacgccatcaagtactctggcttccactacgctacccgcgccggcctcaccatctcggtgtgggacgctcttatccctgccgagaagcaggagctgctcgaccgcgcccaggccaacgtcgaccagatcaacgagtacttcgaggagggcttcatcaacgagacggagcgccacatcgaagtcgttaacgagtggaccgcttgtaccgacaaggtcgcagcgctcatgctcgacatgttcgacgaggagaacccgctgtacatgatggccgactccggcgcccgtggttctaagacccagctgcgtcagctcggcggcatgcgtggcctgatggcagacatgtccggcgagacgatcgaccttcccattaaggcgaacttccgcgagggcctgctgccgctcgagtacttcatttcgacctacggcgcccgtaagggcctggtcgataccgcatcccacacctcggactctggttacctgacccgtcgtctggtcgacgtggcccaggacgtcatcgtccgcgaggaggactgcggtacgcacgagggcgtcacctacaacctcatcatccccggcaccaccgacctcaacaccgacctcgttggccgttgcttcatcgaggacgtcgtggctcccgatggcaccgtgctctttgagcaggacggctacatcgagaaggtcgccgacatccagaagatggtcgatgccggcctcaagaaggtcaagcttcgcgcgctgctcacctgccgctccaagtacggcgtgtgccagaagtgctacggctgggatctttccacccgtcgtccggtcgctatcggtactgccgtcggcattattgccgcccagtccatcggcgagcccggtacgcagcttacgatgcgtaccattcactccggcggcgtcgctggcgtcgacgatattacgcagggtctgcctacggtcagccgtatgttcgatatcgtcggcaacgtcaacgagaagatcctgggtcgcgaggccgagctggctccgtactccggtcacctctcgatcaagcccgagaagtccgagtacgtgctgacgctcaccgactccgaggatcacacccgtgtcctcgacgagcgtcgcgtccccgcttcggtgcgcttcatgcccgagatcgaggacggctgcgaggttcgcgccggcgaccagatcaccaagggcttcgtcaacttccgcaacctgcgcaagctgaccgacatcgagtcgacgatgcacaccttcgtcgagagcgttaaggacgtctacaccagccagggcgtcgacctgaacgacaagcacatcgaggtgctcgcacgtcagatgctgcgtcgcgttcagatcaccaaccccggcgactccaagtacctgcttggtcagtacgtcgaccgctacgagtttgccgacgaggtcgagcgcgttgcccgtctgggcggtcaggctcccgtggccgagcccgtcatcctgggtacgctcaaggtcgcgtccaacatcgactcctggctgtcgagcgcttcgttcatccgtaccgccggcgtccttaccgaggctgccatcgagggcaaggtcgaccacctgctcgaccttaagtccaacgtcatcgtcggtaagaagatcccggccggtaccggcctcaagccgtacgccaacgccaagctgacgtatcgtacggccgacggctacgtggacatcgatggcccggcttcgcccaacgccaagtcgctgcccgagtgggctccggttgagctcaaggacctggacgagcagctcccgcagcagctcgactgggccggctacgacgagttcggtggtgctgacggttcgttcacccgcaacggccacaccatctccgccgagaaggctcgcctgtacctgttcgacgacctgggcgtgtcgcagcgctggaccaacaagttcagcgaggtcggcatcgagacggtcggcgacctggtcggcaagtccgaggaggatctgctgcgcatcgatggcatcggtgccaaggcgatcgaggagctccgtgacggcctcgaggcccacgacctgctctacatcctcgagaacaacgacgacgttgccgacgaggaagacctctcgcagctgctgcagatggtctttagccccgacggtccggacgacatcctgctgggcacctccgctgctccgacgcatcacgctgacgaggacgaggagctcctgggcgccccgatcgacgacaagaaggctcccgccaacggtgccatcaacgaggacatggcttccctcgacgagctgctcaaccagctcgtagacaccgacgacgccgaagaggccaaggacaacgacgaggaataatttcctagtacgttaaccgcccttccaaagacccgcttcccaacagggaagcgggtcttttttgttgaagaaaacctgccaaaaagggacaggtttattttggtaggtttttcctgcttgaatttgaaacaattcgtccggccagagcgtatctatggtgagggcctcatcgataatcattaacgtcaccgggaggtgattatggaagaacaagcatttagacaggcggtcgaagatcaccgggatgtcgtgtttcggatcgcattgacgtacctgcgcgattgcgccgatgccgacgatattgcccaagacgtctttcttaagttgcttaaaagcgatggacactttgaaagtcgggagcatcttcgccgctggcttatccgggtcacgatcaatgaatgcaaatcgctctttcgaaagccatggaggcgtgtggaggatattgagaacctggccgattcgctttcgacggcgcaggaggagaccaaggcggtcctgtcagacgttatgcgacttccggagcgattccgtgttcccatcgtgctctattactatctgggcttttcgaccgcagagattgccgagttactgcatgtgccagccgcgaccgttcgaacgcgtttagctcgtggtcgatcgaagctcaaattcatcctagaggagggcgaccgtgaaatccaatcaaatcaagcaggccttcgagtccatccaagccgatagcgatcttgccgaccgtgttattgatgctgcggctggaaagccgcttcgtcgaaagggtcacgcgaaacctctgtatgttgccgtaatcggatgtcttgccggagtgttggcgaccggaggggtcgcctacgccgttgtcaattccagctattttgcctcagcctggggaaaccatggcaacggagagtccattacctggactcaaggtggctcgtcggggactaaatatacctacaccagagagtttggtgatggcatcgcgccccaaagcctggagggtgcagtccaggaggttaatctgtccgtcgagggtaacggctatacgcttgatatccatgagatggctattgaccaaaacggctgcggagccgtgacgtttacgttgtccaatccaaatggcgttaactactacaagccggcagcagagacaggcgaacttgttctctatggtgaagaagaacaaggcatcggcacgcccagcatgaacttcggcgaggaatgggctgatacacgctgcacaattgataaggacacatcaagcgacacggtcattaatggcacgatgtactttgcctcgtggaatcgcgagcgagatttgggacatgcggtcacctggaatatctgctggactgagggcgaaggcgaggacgcgaagctgttcgaggcatcgacgcccgagtttaacgttggagcgtacgtcgatacaaaggaactccgctccgatgactcgcctctcgagatcagcccgttttccatccagacgcacatcgacgatctgggcattgacgcagtcacgaaaaagttgaccgttacctacaaggatggatcggagcagattatcgaagacgatgctgcgggcgcgtacaatttctatgtctcgatgacgcgcaatagtggagagaacatctcagtgccgacaaaactgatcaatgtcgatcaagtggtctcggtaacccttgagggcacgaggtacacatcaacaggagagaccgaaacagaagtaccctttaccatcgtctattcgtaagatttggggccgcttcctactaggggaaacggcccattttgcgttaaataggcggttattacgagtgatattcgactgaatttcggaagtatgcggcaaaatcttgatgggtcgaccacaccgcatatgctcaagcgctctacctgctggtttgttatcgcaaaaccccggtgtgctcggcaggtccagaatttgccgcatacttccgaaaacaccgccaatctacatgtgttagtgaggtcggatcgccgctggagcgtggcatttccccaggttaaacctaccaaaataaacctgtccctttttggcaggtagcgttgttccgacgagcacgtcggattcccggcccggtagcgcgcagagatgtggtgtaagaggcggggcatgccccgcctcttctctttcttgaaagggaggggacaccgcctagaattcgtcgttggagtaatgaaggtgacgaatggaaggaaaggcgatgccccaagaagagagtgtactgcgcctcggccgcgacgaggccctcgaggcggcgaggctttggcaggagtgcggcgacgcgcgcgagttcgcgtgcagggtgctgggcggcgtgatgaacgcgctgatggactccgaggcccagcagatgtgcggcgcgagccgcaacgagcgcagcgacggcagggagaacagccgcaacggctaccgccccaggtcgctcaagaccgccgtgggcgacgtggagctcgagatacccaagctcaggcacggcacctactaccccgagggcatgctcgcgcgatggtcgcgcgtcgacacctcggtggcctccatcgtgcaggagatgtacgtgtgcggcgtgtccacccgcaaggtcgagcgcgtggcgtccaagctgggcatatcctcgctgtcgagctcggaggtctcgagcctctgctccgacctcgacgccgaggtggaggagttccgccgccgcgacctttcgggcacgccgtgctgctacctgtggctcgacgccacctacatgagctgcagggtcggctcgtcggtcgtctcgcagggcgtcgtgaccgcgatcgggctgggcgccgacgggcgcaagcacttcctgggctgcgacgtggtcgacaccgagagcgaggactcctgggcggcattcctcggcgggctgcgcgagcgcgggctggccggcgttcgcctcgtggtctccgacagccacgccgggctcgtggccgccgtctcgcgcctgttccagggctgcgcctggcagcgctgcgtgacgcacctgcagcgcaacctccagagcgcctgctcgggcaggcccgaggactccaaggcggccgtcagggacctcgtgcacgccgcggtctaccaggacgaccccgacctcgcgcgctgcgtgtgggccgaggcggcgccctgggtggcgtcggtgtccgccagggccggcgaggtcttcgagcaggccgaggactccgcgctggcgttcacggccttccccagggcgcactgggccaagctccgcaccaacaacgtccaggagcgcgccaaccgcgagatcaagcgccgctacagggtcgtgcagtccttcccctcgagggagtcgatgctgcgcctgacgtgcgcgagcctcatggagaccgaggggcagtggtcccagcagcgcgtgttctccgaggcctcggccgccgagggcttcgccgagcccgcggacaggccggcctcgacagaggggaggcgccgcgcgctcgggcggcgcgccagggagatagtggacgagatagtcgagaagcgcggtctcaagaaggagtaacatcgggacttgcagcgacggacctcaggacactcttacaccacgtctgcgcgcgcgacccattcaaaaggcaaggcatgaccagaaggtctatgccttgcctttttcatgccaacttgttcgctctggacgtcgctcgctgacattgccaaaacattggcgtttccttggttgtcaaatgatccgtagggagtcattggtgacattgccttgatattttattcagtcggctgtgatgtcatttgagctgcttacctgcttaaggtaattgacggcatatatctgctatcgaaaatattgctcgaaaaattgtccaagaagtcgcggggcgatttttgatgggtcgcgcgtcaagtgatttggcaagttcttggttagatattggtcagttttggggcaaccttgccaaaagcttgacgaatgcaaatttagacgtcagcgaatgaacactttgagcgagctcggtgcaaaattctgggctgattctcgataatcgccttcaatcgccccttgccaagcgctggcctcgcttacaatctgctccgacattcgcgcgccgtccggcgcttaagaggggagggccccatggcaaacgagatttggaccatcaagcgttgtctcgagtggaccaaggagtacctggccgagcgcggcgaggagcacccccgtctttctgccgagtggctgctgtgcgccgccacgggcctggcgcgcattgacctatatatgcgtatggacgagacgcttaacgcggcccagctcgagaccatgcatgcggccgttgtccgccgcgctaagggcgagccgctgcaatacatcacgggcagcacgcagtttcgcatgatcgacgtcgcgtgcgcccccggtgtgctcattccgcgccccgagaccgagatgctcgtcgaggaagtcctcaattatctggatgccgaggtactgagccccgaggccgctgcccgtcagcgtgttgagctgccttggaacgatgaggtcgagcaggcacgcaaggccgaggccgcattggccgacgagcgagcgacggccgagcgccgtgccgccaacctcacagctgccgacgaggcggcgctaggcggcgatgtgctgggcagtcgcgcttatgccgaggaactggccgatcgcgaggccgaggaagccgccgcgcaggcggcagaagccgaagcggcagaagcagaggccatggaaacccccgagcccgagctcgacgaatacggcatcgccattgaggacaacgaccaacaggcgactcccgcgcaagatgccgccgaggccaacgtatctgccccagccgagccccgcactgcccgcgttctcgaggtcggctgcggcacgggctgcatttcgctctcccttgcctgggagcgccgcggccacgttacctgcactgctaccgatatcgagccgcgcgccatcgatctggccaccaaaaaccgtgatgcgcttggcctcacgtccgacgaggtcgccttcagcctcacaaacctggtgagttccattccccgcgaagagtggggcacctttgatgtgctcgtctccaacccaccttacatcccgaccgacgtcatgcgctcgctgccgcatgaggtcaaggactttgagcccgatctggcgctcgagggcggtgccgacggtctcgatatcttccgccgcctgctcaacgcggcgccctacatgctgcgtgccggcggcctgtttgcctgcgagctctacgagggcgcgctcgacgccgcggccgagctctgtcgtcaagcaggcctttcggacgtgcgtatcgtccacgacctcaccgatcgcccccgcattgtccgagccatcgtcatcgagcccaagcaacgccagtaatatttattaactggttagcaaaaattataaagtagtttataattaggacggctgaaagaggtcggcccatgcaacctcctacctttcgggaaatcattgccctactcaagcacgatggattcgtgaaggtcgcgcaagtcggtagtcatgctaagtatgtttctggtgaccgcgttgtcaccgtgaacggctctggtggtgatcgaccaaagaagggcacgtgggcaagtattcgtcgccaagctggatggtagttggaggcaaaatgaggcagcgatttacctatgactgcgttctcataaaagaagacgatggttactgcgctagcttcccgcagattcccggcgcctttgccgatggcgatacgcgcgaagaagcgattgcccatgccaccgaggcactgatggcgtttttggccgacgacctcaacaacggtttgactccggcagggtacgaacgctcggccgaggtcgtggccctttcagtcgaaatcgaccacgaggacgctcgggaagcggcgtgccgaacatttaaagacgcagcgctggacctcaaagtctccgctccgcggattaccgcgctggtcaaagccggaaagctcgatgttgaactcgtcgacggccgtcggatgataacgatagacagcatcgagcgttacgccgcccaagaacgtcacgccggcaggccaaagaagttcgtcgcagtccaataaccccctcactttcaccgactactagagccgctcaccaaaccaacatgcgctctgggcaaataggttgaacgtttcgtgcgagaatgccccacagtaaacaaacttgcaccagagcgtaaggggctggcatacacatgcagacggtctatcgggtatacgagggaacgcgcgagccgcatcggcttgccgtcgagcgcacggccgaggtgctcggccgcggcggcctggctttgatcccgaccgagaccgtctacggtgtcgccgtggcagtcaacgccttctcggacgccgtgccccaagatacaagcgaattcccatcgtggccgcgcgatccgcaggctgccgtcaatggcgccgcagttcctgcgctcggcaccggctatcgccgtatcttcactctcaagcaacgtgaactcacgcaaaccgtcgcttggctggtcgatggcgtcgaagcactcgaccgctatggcgtagatatcccggaagatgcccgcatactcgcgcgacgatgctggccgggagccctgactatcgtggtcaaggcagccccctgcgtgccgacctttatgcgcgctgccgacgacacggtggcacttcgcgcttcggcctcgcccgtggtgcaggcgctcattcgcgcctgtggcagcccccttgcctgcaccagcgccaacacgcatggcgcgcccgcgccggcaagttttatcacggtggagggtcgcatcctggagggggtcgatgttgccgtcgacgccggtgagaccccgtgtcgcgacgcctcgaccatcgtgtcgtttcagcacggcgagctccagatcctgcgccaaggcgcacttcccgcatcagagatcgaacgggtcctgtccgacccgatgcaatagaaaggtttaagcgatgtcgttgaatctgggcagcctgggcatggaagatgcctcgtttgactttggcggttcctacatcatggcgctcgactgcggcaccacctcggtacttgcgaccatcgtcgacgagtacggctgcatcgtcgcgcaggcacgtcgcagcgtcaaaaccagcttcccgcgtcccggttgggtagagcaagaccccatggcggtccttgctagccagatcgccgtcatgatggaagtccagtttaagagcggtatccactccgaccgcattgccgccatcggcatctccaaccagcgcgagaccacggtggtctgggatcgcgtgagcggtcagccgatctataacgctatcgtatggcagtgccgccgtaccgcacctctgatcgacgagcttgtcgagcagggcgcagaagggctggtgcgctcccgcacgggactcacgctcgacccgtatttctcggcctccaaggtgcagtggattctcgacaacgtcgacggcgcacgcgaaagcgcggcggcgggcgacctcatgtttggcaccatcgacacctggctcatctacaacctcaccggcggccaggtctttgccaccgactacaccaatgccagccgcacggcactctttaatatccatacgctcgattgggacgacgacctgctggcactctttgacgttccacgttccatgatgcccgaggttcgctggagctcgggcgactacggccgcgtcgcgagcgacatcatgaccaacatgccgcccatcatgggcgtggcgggtgaccaacaggcgtcgctgttcggccactgctgtttccgtcccggccagaccaaaaacacctatggcacgggttgctttatgctcatgaacaccggcgacgagatcgtcgaatccaagaatggcctggtctccaccatcggtatcgctgcggacggcaaagtcagctatgcgctcgagggctctatttttgccgccggctcaacgatgaactggcttcgcaacaacatgggcatcatctcgagcgtgagcgagtcggcacaactcgccgcttcgattagcgacaacgagggctgctacttcgttcccgcctttgcggggttgggtgctccctggtgggacccgcatgctcgcggtatcgtgtgcggtctgaccggcgcctcgagccgtgcgaccatcgtacgtgccgcctgcgaatccatggcatatcagagctacgacgtgctgcgcgccatggagcaggacgtggggctttcgattgagcgcctgtctgtcgatggcggtgcctcgcgcaacgagttcatcatgcaattccaggccgacctgctggatatccccgtgctgcaatgcgagacggtggagaccacggcaatcggtgccgcgtacttggcgggtcttgccgtcggctattgggaagacctggaagagctggagcaaaatgcccagatcgttaggaccttccttccccacatgtccgccgagcgccgcgagcaaaaccttgcgggctggcgtgatgcagtcaggcgctcgctcagcacctcacagtagggctgcgatgggctgctcgatacaacaaaccgctaaactaatgcatggcgtgcggcggcaacattgctgcacaccttgtcagcaaggccgttttgcggccgcaacgaaaggggcaatcaatccatgaccgtcacctacgatgcgtcccgtgtgacgcttgtcgatcacccgctcgtccagcacaagctgtcgatcctgcgcgacaaaaacaccggcaccaaccagttccgtcagcttgtgcgcgaactcgcgctttttgacggctacgaggccatgcgcgacctgcctatggaagacgtcgaggtcgagacccccatcactaccgccacgttcaaacagcttgccggcaagaaactcgccatcgtgcccatcctgcgtgcgggccttggcatggtcgacggcatcctcgacctggtgccctccgctcgcgtgggccacatcggcatggagcgcgacgaggtcacccacgagccgcacgagtattactgcaagatgcccaaggatatcgaccagcgcatctgcctggtcgtcgaccccatgcttgccacgggcggttcggccgagatggccatcagctacctgcgcgagcgcggtgtcaaggacatccgcatgctgtgcatcgtcgcggcccccgagggcctcaagtcgctgaccgagaaggacccagatgtgcatatctatacctgcgccatcgacgaccatctcaacgaggctgcctacatcgttcccggcctcggcgacgccggcgaccgcatctacggcacgctctagtcgctgggctaaacggccgcggctgcaaatacgaagaaacggtgcgcgcggacgaacaaaaggcgaccgcgcgcactcctgttaacggacgttttgccctgcagggttcgagaaaaacgtattaccgtacctgcggcataaagaaggtcttaagaaaacgaacaggtgcgtattaaccgatgctttttcggttgtactttagcgattggctcgtacaatagtcaccaatgtttggcgggaactgttctgtgaagcgttaaaaaggaaagtgaggacgccagtgtttcagatagccgatctgctcgctatcgttgcaggcgccatcgcgggcgcaattgccttccttccctttgtctttacgctcaagccggttcttgacgataaacagaatgcggacatgctcaagggtatggtgagtctggcggtctcggcaatcgccctgctcgtctttaccttggttgtgtttgtgttgttcggagaggcatttcgcatgttcctcctgggcgaggcgatcggcttcgtggcctttatggccgcctgcgcggttcgtgtcgccaaggcgctgcgagatcctcatgaggtcgaaaggtaagtcgtggaaatttttgaaaagctgcctgatgagattaatcatctggtcagcgagttcagctccacccctgtcgtgggcgatctgagctgcggcatcacgcagtactcgttttggctgatcgtctccacgatcgtgctcctgatcgtcctggccgtgttcaagaagaagcagaccctggttcccaagggcttcttcgtcaacggtttcgagtacatcatcgagtacgtcgagaacgatatcggcaagggtgtcgtgggtgagaactggaagaagcacttcccgttcctgtgctcgcttttcctgttcatcctgatcaataacatgatcggcctgatcccgggaatgaagcccggcaccggcgcaatcggctccaccgccgcgctcgccattttcgccttcgtgtacttcatctactacggatgcaaggctcacggcgtgatcggctacatcaagagcctcgccccgcagggcgtgagcttcccgatgaacgtgctcgtgtgggtcgtcgagcttttctcgaccttcctgcgcctcatcacgctcgccgtccgtctgttctgcaacatgttcgcaggacacgtggtcatgggctcgttcgccatcatggcgagcatgttcatgcagccgctgcttcagcaggtttccgcggcccacgccgtcggcgccctgccttcgcttgcctggcttgccatcctcatcctgatctatgcgatcgagcttgtggtcggcgccatccaggcttacgtcttcacggtccttaccgccgtgtatgtctccgaggcagaggaggtcgcagaggaggagtagtcttccgttcgcgccttaaaggtaaggcaattcgttaaaccgccggtgcccgtacccatggagcccggcagttataaaaaggttatcctgcgtgaaataagacacgcacgacaaaggaggaatcgtgggagttatcggttacggtctcggtgttatcggcgctggtcttgctatcggcctgtctgctctgggtgctacgggtgctatggcccgtcagcctgaggtccagggccgcgtgttcaccgtcttcatcatgggctccgccttcggcgaggctctggctctgatcggcttcgttgtcgcgctgatcgttaaatagcacggagcgtcaagtatgaatctttcatcccagaagagcgcgatcgcactctccgcgtccgcggccgcgctgctcatgccggtttccgcgttcgccgaggacggcgctgccggtgcggacatcctcatccctaagatggcggagttcatcccggcgcttatcgccttcctgattatctggatcgtgctggccaaggtcgccctgccgggcatcatgaaaaccatggaggagcgcggcaagaagatcgaggagagcctcgacgaggccgagaagaccaagcaggaggctatcgccaagcgcgctgagtccgactcgatcgtcaccgacgcccgtcgtcaggctgccgacatcgttctcgaggcccgtaaggacgccgagtccgagcgcgcccgtatcatcgaggctgctcacaaggaggccgaggagatcatcgccaaggcccatacgaccgtcgaggacgagcgcaagtccatttacgccggtgccgcgagctccatcgccgacctgtccgttgccgtcgccaccaagatcgtgggcgaggcactcgaggacgatgccgagcagaagaagctcatcgagcgctacatccaggaagcaggtagcctgaatgccgactagccgctatcaggacaaggtgctcgagacctacgcgcgctcccttctggaagccgctaaggccgagaaccatgtgttcgaggacctcgagatgatcgaacgcttggcttctgccagccccgagatcatcgccgtgctcgacaccatgtccaagcgcgaccagctcgaccttcttcccaaggtggcagctgcctttaagtatgttgccgaggaagacgaggatgtagtgggcgtgaccgtcaccacggcgatcccgctcgacgacgagctgcgtcaaaccatcactaagaaatgcgagcaggacttcggccgcaaggtattccttatcgagcgggtcgacccgtctatcgtgggcggcctggtgctcgaggcccgcggcgagcgtcgtgatatttccgtcaagacgcagctgcgcatcgcgcaggagaccctcgcaaactctgctaattcgtacggaggtgaagcctaatgtccgaaaccctcaatgcccaggatatcgccaagaaactgcaggagcagctcacgagcctctccgcgacggtcgatacgcatgaggtttcaacggtcgacgaggtaggcgacggcatcgcgcgcgtctccggcctcaagagcgccatggcaggcgagcttctggagttcaagagctccgataccggtgagaccgtcttcggccttgcccagaaccttgaccgtgacgaggtcggcgccgttctgttcggtgccgtcgactccatcaaggaaggcgacgagtgccgcaccactggccgcattatggatatccccgtgagccgtgccatgctcggccgcgtcgtcaatccgctcggccagcccatcgacggcctgggcgacatcgtcgccacgcaccgtcgccccatcgagttcaaggctcccggcgtcatcgatcgtaccccggtgtgcgagccggttcagaccggtctgctcgctatcgactccatggtgcctattggccgcggtcagcgtgagctcattatcggcgaccgtaagaccggtaagaccgccatcgccatcgacgctatcctcaaccagcgcggcaagggcatggtctgcatctatgtcgccatcggccagaaggcctccacggttgccaacatccgcgagaccctcgctcagcacggtgcgctcgactacaccatcatcgtttcggccaccgctgccgattccgcccctatgcagtacatcgcgcctatggccggtgccgctatcggcgagttcttcatgtacaacggcgaggacggcaagcccgccagcgagaccaaccccggcggccacgtgctcgtcatctacgacgacctgtccaagcaggctgtggcctaccgtcagatgtcgctgacgctgcatcgtccgcccggacgcgaggcctatcctggcgacatcttctacctgcactctcgtctgctcgagcgtgccgtcaagatgtccaagaagaacggttacggctccatgacggcactgccgatcatcgagacccaggacggcgacgtctcggcctacattccgaccaacgtcatttccattaccgatggtcagatctacctgcagtccgagctcttcttccagggccagcgcccggcagtcgacgtgggcatttccgtgtcccgcgtcggtggcgacgcgcagaccaaggctatgaagcaggtcgccggcaacctccgtctggacctcgcttcataccaggaactcgccggctttacgcagttcggctccgacctcgacgaggctactcagaagcagctgacccatggtgctcgcatgaccgagctcctgaagcagccgcgctacaagccgtttgaggttggcgagcagatcgtcacgctgttcgctggcaacgagggcttcctggatgacctggagatcgccgacgtgctgcctttccgtgccgagctcatcgagtacatggacaatggctttggctcgctgctcgacaaggttcgcgccaagaagatcgatgatgacaccaaggctgagctcttgcgcgtcatcggcgacttcaagcagcagttcatggccaagcaccattcggatgtttctggatcagaggagaactaagccccatggccaaccttcgcgacattaagaagcgaatctcctcggttaccacgaccaagcagatcacgcgcacgatggagatggtctctacggccaagatccgtcgtgccctcgatcgctccaagcaggccgagccctataaggaggcgctgaccgacgtcatgttgacggtcgccggcgacgcctcctgttcgggcaccgatcccatgctgcagaagcatgagagcgtcaagcatggcctgattgtcgttattgcctcggaccgcggccttgccggcggtttcaatacgacggtggagcgcacggccgaaaagctcgctgcttcttgggcgaacgacggcatcgagtgcgagatcatcgcgtgtgggcgcaaaccggccacgtatttccgtgaccgcgcaaacgtcgtcatgcactttgagggcaactcctctgagcccgatttcaatcaggcccgcatgatctcctctcatatctgcgatgcgtatcgtgccggtgagcttgaccgtgtcgagcttgtttaccaccacgccaagaaccgcgtggatcaggagcttcgcgtcgagcatctgttgccgctcgatcccgagatgatcgctatggcccacggtccgcgtaagaacgagaccgacgcccctaagcgcatctcgtccacgttcgagttcgtgccctctcccgagcatgttctcggcaagcttgtgccgtcttatatcctgacggtcatctaccaggccctgatcgattcggcggctgccgagcagggtgcacgccgcaaggccatgcactccgcgacggaaaacgccaccgcgatcatctcgacccttacccgcacgtatagtcgcgtgcgccaggcttcgatcacgaccgagattaacgagatcgtcggcggagcctcagcattggaggaacagtaatggctaataacaccgtaaagcttgcggtcgaggaagccaccaagaagacgactgccggtgatggtcgcatcgtgcgaatcatcggccctgtcgtcgacgtcaagtttgacggcgcggtgcccccgatctacaacgcgctcacggtcgaggccgagaccccgatcggtcatctgagcacgatcctcgaggtcgagagccagcttccgggcggcgtcgtccgcacggtcgccatgtcctcgaccgacggcctgcagcgcggcctcatcgccaccgataccggtgagcccatgaagatgcccgttggtcccaagacgctcggccgcatttggaacgtcatgggcaagcccgtcgacggcaagcccatgcccgaggtggaggagttctaccccatccaccatgcagcgccccgcttcgacgagctcaccaccaagaccgagatcttcgagaccggcatcaaggccgtcgacctgctcgagccctacatccgtggcggcaagacgggcctgttcggcggcgccggcgtcggcaagaccgttctgattcaggagctcatcaacaacctcgcccaggagcacggcggcacctcggtgttcaccggcgtcggcgagcgtacccgcgagggcaccgacctgttcctcgagatgagcgagtctggcgttatcgacaagacctgcttggtctatggtcagatgaacgagccgcccggagcgcgtctgcgcatcggtctggccggccttaccaccgctgagtacttccgcgatcgtggccaggacgttctgctgttcatcgacaacatcttccgcttttcccaggcaggttccgaggtttccgcactgctgggccgtatgccgtccgccgttggttaccagcccacgctggcaaccgagatgggcgacctccaggagcgcattacctcgaccaagacgggctccattacctccgtccaggctgtctacgtccccgcagacgacctgaccgacccggcgcctgccacgacgtttacgcacctcgacgccaccacggttctttcgcgtagcatttcgtcgctcggcctgttcccggctatcgacccgctcgcatcttcctccgacgctctcgatccctcgatcgtcggcgaggagcactaccgtgtcgccgtcaaggtccaggagctcctgcaggagtactccgaccttcaggacatcatcgccattctgggtatggacgagctgtccgaggagcagcgccttacggtcaaccgtgcccgtaagattcagcagttcctctcgcagtccttccacgtcgccgagaagttcaccggcaaccccggtgtctacgtccgcgtcgaggataccgtccgctctttcgccgagattgtcgacggcaaggccgatgacctgcccgagcaggctttccgctatgcttccacgattgaggacgtgcgcgagcgcgcccgcaagatgggggagaagtaggttatgcgtatccgcatcgtgtgccccgtgagctgcgcctatgagggcgacgctgcgtttgtgtcgattccgtccacggatggcgagtttggcgttctgcctgctcactccagcgagatctgcacgatcgaccgcggttacgttcgcgtttccgataaggccatgggcactgtcgaccacacgtttgccgtggccggcggctatgcccaggttgcggacgatgtcgtgaccgttctcgccgagcgcgcttgcgatttggcgaccgtcgatgccgacaagcttaaagctgatattcaaggttttgaagagaagctgggtaatttgtcggaggatgatgcacgccgcgcctacctctataatgaaatcgcatggtgtaagctcaagcttgcccaatagtcaaacgatttagcgttcgaccatttgcgaacacatcatgcccgggatggctcagccaccccgggcatgctttttgaaagggtagaccttggatattattcgcgttgagggtggccacgccatcggaggctccgtgcccgtctcgggtgccaagaactccgcgctcaaactcatggcggcaacgcttctggcgccgggcaagacgacgctgcagaacgtgcccgatatttccgatgtccacgtgatgggcaaggtgctcaagggcatgggcgctacgatcgatgttctcgacgagcacacgctcgagatcgatacctctcaggtcgattcttgggaggctccctacgagctcgttgccaagatgcgcgcttccacggccgtgatggggcccttgctgggccgtttccatcgcgccaagatcgccatgccgggcggctgcaacctgggtgctcgcaagatcgatatgcacattctgggtctcgaggccctgggcgttgagttcgataccgcccacggttacatcaacgctaatgcgccccaaggtctgcgcggtaccaccgtcacgctcgagttcgccagtgtcggtgcgaccgagaacctcattatggcatccgtgcgcgcgcagggtaccacggttatcgacaatgccgcccgcgagcccgagatcgtcgatctcgccaacatgctcaacgagatgggcgccaagattgttggcgccggcacgcccgtcgtgactatcgaaggcgtggaagagctccatcctgttacccatcgcgtagtaggcgaccgcatcgaggccggtacctttatcgttgccggtgcgttgatggccgacgatcgcggtgtcgatgtcacgggcttttgccccattcacttgggcatggtgctcaagaagatggagctcatgggtatcgactgcgagcgcgtcgaggatggcgtccatgtgaaccgtgccgagcgcatcaagccggtcgacatccagacgcttccgttccccggcttcccgacggacatgcaggcgcagattatggtactctccgcccttgccgacggtagctccgttatcaccgagaacatcttcgagaatcgctttatgtttgcctctgagctggtgcgcatgggtgccgacattcgtatcgagagccatcatgccatgattcatggcgtcaggggcttctcgggcgcacaggttacctcgcccgatctgcgtggcggagcggccctcgtcgtagcgggcttgatcgccgacgggacgaccgaggtttcggccatccatcacatcaagcgcggctacgagcagtttgtcgaaaagctgcaggcgctcggcgcgcatgtcgagcatgctaccgtccccgatcccgtcatctactaatacaggttgcctatgtttaataaaaagcccctcgcggataccaccgcccgaagaccctcaactggtgcgcaggccaagatctacagtcgcgataacgtggctcgctattccgagcgcgctcgccaacgtcgtcgtagccacacgattcgtcacgtcgcgctcattgtcgtgcttggcgtgctgctgagtgccactaccgctgccggcctgtggtttgccaccattatgggcaagctcggcgattctaatgtcattaccgacaatctgcgtcgggttctggttgacaccgatgaggcaaaggatccgttctacgtgctgcttcttggcaccgacggccgtccgggcgaggatacgtatcgtgccgactcgattatcctggcacgcatcgaccccacgcaaaagcaggcgacgctcatttccgttccgcgcgacaccaaggtcgagtacaagggcgagaccatgaagatcaacgcctgccataccgttggcggcgccgaggccatggtcgaggcggtcaacgaactgtgcggcgttcagatttcccattatgccgaggtcagcttcgacggtatgcaggcgctgattgattcggttggcggtatcgacattaacgcaaccgacgatgttgacgaccctgagcacctggatattaagatcaccgctggtcagcagcatatggatggcgccaccgcccttacctatgcccgttgccgctacacctatgccgacggcgattacacgcgcatgcgccaccagcgtcaggtgcttggcgcccttgccaaccagatcctcaataacttcgatgccacgaagatctttggcctggtcaattcgctgtccgatatgctcgtaaccgatatgagcgttcaggatatcgtgtctacggtcaacgccatgcgcggcatggatgtcgacggcatctactcggcaaacctgccttcttacgcagacgatacaaccatgattgacggccagagctacgtctttgtctacgaggacgagctcaaggagatgatggagcgcgtcgacgccggcaaggaccccaagggccccaacactatgggcctttccgacggttccagctccacgatcggcgacctgagcaataacacctccgatgactacgccaacggcaccgcaacctcgtcgggtggctcgggcgattctgacgactcgggcgactcgactgattcaggctactacgaggaaccttctggagaaggtaacggatacgaagccaattattagggttacgcgggcttaccagcccgcgtaacggctcgacgctgcgcgccgcccagagcgacaatttgtcattcaaaaggcagggcatgaccagaaggtcaatgccctgcctttttcatgccaacttgttcgctctggacgtcgctcgctgacgttgattcaaccagcgatgccgactacaccccttgcaccaaaaatcgccccgttctcggttgaggacggggcgattcgtcttttggggttgttcagccaggcttatgcgaagcgggcgacgagctcctgcaggacgtcagtcatcctgacgagcgaactgaccgggacgaactcgttgacgccgtggtagcagtagccgcccgtggaaaggttggggcagggcaggccgcggaacgacagctgcgcgccgtcggtgccgccacgaatcggcagcacttggggctcaacgccgcaggcaagataggcttccttggcaacgtcaatgagctccgggtagtcacatacgatctcggccatgttgcggtactgctgcttgatctcaaccgtcacgcgctcctcgcccaggcgctggttgagcagggcggcggcggaatcaatcagctcgagcttctgctggaacttggcggcatcgtggtcgcgaacgatatagcgcgccgtggcgtgatcgacagtcgcagacacgccctcaagatgatagaagccctcgtagccctccgtgtattccgggcgctgcgcataggggagcagtgcgttaaagtcgcagaatagattgcctgcgttgaccatgcggcccttggcgtcgccggggtgaatggactggccctcaaagcgaacggtcgcttcggcagcgttaaagcactcccactccagctcgccgacggggccgccgtcgaccgtgtaggcgtacttgcagccaaaggcctcaatatccagcaactcggcgccgtggccgatctcctcgtcggggcagaagcaaatgccgagcgcggggtggggcagcgagggatcctgagcgatgcgcgcgacgagcgccatgatttcggcgacgcccgccttgtcgtcggcgcccagcagcgtggtgccgtcgctgcagaccaggtcctcacccacgaggtcgttcagggcgggaagcttggcggtgctcatggctacgggcttgccgtcaaccgtgccgcagaccaggtcgccgccctcgtagtgcacaatgtgcggcttcacgccggcgcccggggcaacttcggtggtgtcaaggtgtgcgatcaggcctagggcaggcttgtcctcggcgccagcactcgcgggaatatgtgcgcagacgtaggcgtgctcggtcacgtgggtatcttccgcaccaagcccacgcagctcctctgccaacacgttggcaaggtcaaactgaacggtactcgagggcacctggtcgcagtttgcatcctccgactgcgtattgatctggacgtagcgcaaaaagcgctcaaggacgtcggggctcgtgttgttgttttccataaagaccgctccaatcttggtcgtcgtgtgcaacaagaactctagcacggtatgccacggcataccgcggcgcttggatggggtagaatcacccattgaatgcagaagggacggaaggtcatggaaacgacaaatagctcgcgcgagctgcacctgacggtggcgaacgaagactacttggagtgcatggttcgcatcgagagcgaagagggggagaccaacggtgtgcgatcggtcgatatcgcgcagcgcctcggtgtctccaaggcatcggtcaataaggcggtctcggcgcttaaaacgtccgagcttgtcgagcaatcgcactacggcaaggtcatcctgaccgagcgcggtcgtgaggtcggtacggctatctggtaccgccatcgcctcatccgcacgtttttggtccaagagctcggcgtcgattttgagcgcgccgattccgaggcgtgcatgatggagcatgcgctttccgaggacacgatgaaccgctggctcgcctatctcgaaaagcagggaattagcgtcgaggaatagcgggatatatatggatacgagttattacaaccgctttggtgccgaggaacttacgcgccgcttgtcgagcgagaccttgctggcgcagggtcccatgggcagcgtgctgatgagcgagtacgatgctgccgatatcccaccggcgttttggaatttggcagagccgcagacggtttctcgtatccatcgcctgtatgtcgctgccggcgcgcaagtgctcatcaccaatacctttcaggcatcaagctatgccctcaagcacgaccagatcacgccgtccgtggcggaggtcaatcgcggggccgtcgatgatgcccgccaggcgcaccctcagctgctgctgggctcgatgggcccgatcggtattgagtggtttgccgaggactctgccgagtatcgtgagatccgaggtattgcgcgcgagcaggcgcacgccttgctcaatgccggtgttgacggtctactgatcgagacggtgacgtctatccgcaatttgcagcccatacttgccggcgcccgagatgccgccgacggcatgcctgttctggtgagttttgtcgttgacgataaaggcgacctgttaggcgatggcctcaacatcgaggcagccgttttgtacgccgagaaacacggcgcaaactcggttggcgtcaactgctgttcgcttgcggccgcgagcgccgcagtgcccaggatggttgcatcggcgaccacgcccgtcacggtgcgccccaacgtgggcgacccagttcagacgccagacgggcccgtgtggcatgaagcgcccgaagcctttgcacgcgcgtgcgtcgagtggaagcagactggcgccgcaatggttggtagttgctgcggaaccacggcgatcactacggcggcgatggccgaggcgctcgatatataaaggttaaaccgctccatacggggcggtttttattgcctgtacgccctcggcagcatttgcccaaatggtgaatgccggtgccggcaggttgctgaacactcgttgcgggtatacctcatgcgtaccatgacctaaacactgtgaggtgtctgcgcgtgtgcgcgataattcattttggaactgacggttggcgcgctcgcgtcgacgaggactttaccgccgacaacgttgcccgcattgccgatgccgtcggcgagttgtggcaaaaaaccaatcccggcaaaacggtatatataggattcgacacccggccccaggcgcacgagttcgctgagcttgcggcgggcgtgcttgcggctcacggattggatgccgtgctcgcatctcggcctgtcccgacccctgcccttacgtgggcggcggcatatgacggcgaggcctgcggcgcactcatggtgacgggatcccatcatccacagggctatctgtgccttaagctgcgcatgggagacggctcgacggccaaccaggatgtcatcgaagagctcgaagataccatggctcctgagccgatggggatcgagggacactaccgcaccgcagatattatccctgactatatgcaggcggtggcatcgtttgtcgattcgtgcgccattcgagccgcccacctgcgtgtggtggttgaccccatgggcggtgcggcccagggctatcttgccgacctgctgcgcgagcttggcgtcgaggtccacgagatacatcccggacaggaatccggtcaagaggatatttgccccgacccggtcgagccgtgggtggatgcctgcgaacgaactgttgtcgaggacggagcgtgcgccgggttggtgaccgacggcgatgccgatcgcatcggagcggtcgatgagcgcggtagatatatacacccacatcagatcatggcgctcgtactgggcgatctcgtgcagttccgaaatcttgagggccgtatcgtcgtcaatctctcgtgttcgacgctcgtacgccgtattgccgaggcgctcggttgccgcgtgaccgtcaagccggtgggttttaaatatatagcggcagaaatgaaaaagggcggtgtcctcatgggcggtgaggaggccggtggtattggcatcgccgcccatatgcccgagcgcgatggaatccttgcctgtctgattctgtgtgagcttatggcaaaaacgggcgcgcctttgggcgttctggttgatcagctcgaggccagttttggcaagacgagctacgggcgccgcgatttgcgcctcgaagccgaggacgccgagtcgctgcgaacgctgcttccgggtataaatcccaagtcgatatgcggcaaggtcccacagagcgtgagccatatggatggtttgcgtttggcatttgaggatgacacgtggttgctggttcgtccgagtgggaccgagccggttgtgcgcgtatacgccgagggcttttcggtggaggagcgcgacgagctactcgatgccggctgtgccttggctaggggggcctatccgctctagccatgagaccgctctccataaagacgcgctcggtgaatggtagggaacggctggcaaacgtcagccgaatcccaagatgtgtaggaaatgtgtgcgcccagattcccgccccgcacgcccctccggtctggcaatatatctccttgccgacggctcggtgccgtccaccggtcagcggcgccctggcctcccacgggctgaccccgcagtactctcggcgcgatggggcttagcttccgggttcggaacgggaccgggcgtgccccccatgctctggccgctgaccggtgggcggcgcccaccgttacggtgtccggtgtctgtctcacgtgccctgggggccgcatggcgcataggagagtgtgactcgggggcatcctcgtgcccggaccgcgcgtgagcgctgggtcccgcgggccgcgaggtgcggttccggaagagctcgggcgattagtgcggctcggctgaggacgtcgccgcccttgcacctgccgtctatctaccaggtagtctacctgggcccttaccggaaggagaactaatccctggaacggcttcccgcttagatgccttcagcggttatccgcgccgcacgcggctacccggccgtgccgttggtcgacaaccggttcaccggaggtgcgtccaccccggtcctctcgtactgggggcagcctccatcgattctcctgcgcccacggaggatagggaccgaactgtctcacgacgttctgaacccagctcgcgtaccgctttaaacggcgaacagccgtacccttgggacctgctccagccccaggatgcgatgagccgacatcgaggtgccaaaccttgccgtcgatgtggactcttgggcaagatcagcctgttatccccggagtaccttttatccgttgagcgacggcccacccactcggggccgccggatcactagagcctgctttcgcacctgctcggcttgtgggcctcgcagtcaagcccgcttgtactcttgcattcaaaaggacggttgccgaccgtcccgagcggaccttcgcgcgcctccgttaccctttaggaggcgaccgccccagtcaaactgcccgcctggcacggtccccgagccggttgacggcctcgggttaggacgccggtcgcgcgagggcagtattccaagggcggctccccgggggctggcgcctccggatcttagcctcctgcctatcctctacacgcgggaccagcggccaatgccaagctgcagtgaaggttcacggggtctttccgtccttccgcgggtaagtcgcatcttcacgaccagtgcaatttcaccgggtccatggtcgagacagcgcccaagtcgttgcgcctttcgtgcaggtcggaacttacccgacaaggaatttcgctaccttaggaccgttatagttacggccgccgtttaccggggcttggcttcggggcttcgccttgcggctaactcctccgcgtgaccttccggcaccgggcaggcgtcagaccctatacgtcgccttgcggcttctgcagagtcctgtgtttttggtaaacagtcgcttgggcctctccactgcggcccgcctccgctccccgggcaagccggttcacgtacgcgcgggcaccccttctcccgaagttacggggccattgtgccgagttccttgaccatggttgacccgatcgcctcggtatgttctacccacccacctgtgtcggtttgcggtacgggcgcgcacgcgcctgcctaggggtttttctagggacctcgggctcactcgcttcgcttgatcgcttcgtccggagcctcgccctcgtgcggaccggatttccctggtccgcgggccgcgctccatcacggggacgtccagaaccccgccgagccacccccatccgtcgccccgtcggtcgtagcgccgcgtgcgcggtgcaggaatgtctgcctgctgcgcgtcggctacgccttccggcctcgccttagcccccgactgaccctgggaggattagccttgcccaggaaacctcgggttcacggcggacgagttactctctcgtctctcgctactcatgccagcattctcactcccatgcgctccaccgccggtcgcccggcggcttctccgcccatgggaagctcccctaccgattctacttaggtaaaatcccgccgcttcggtgtccagcttagccccgtgtattgtcggcgcatgtccactcgaccagtgagctgttacgcactctttgaatgcatggctgcttctaagccaacatcctggttgtctgggcggacgcacatcctttgccactcggctggaacttggggaccttagcgggcggtccgggctgtttccctctcgagcacacagcttagcccacatgctctgactgccgcgctctgggccgccggcattcggagttcggttggattcggtaggcggcgaagccccctcgtccatccggtgctctacctccggcggtgaacgcgcgacgctagccctaaagctatttcggggagaacgagatatctccgggtttgattggcctttcacccctatccgcaggtcatcgccgccgttttcaaccgacgtgcgttcggccctccacggggtcttacccccgcttcagcctgcccacggatagctcacccggcttcgcgtccgcggcgcgggactcaagtcgccctgttaaggctcgctttcgctccggctccctttcggttaacctcgccccgcgccagcgactcgctggctcattctacaaaaggcacgccgtcacaccacatgggtgctccgactgctcgtgggcgcacggtttcaggtactgtttcactcccctcccggggtgcttttcacctttccctcacggtactggtgcgctatcggtcacagggtagtactcaggcttggatggtggtccacccaggttcggaccgggtttcacgtgcccggccctactcagggaccgcgtcgcgccgtccggtctgggttcgcgtacggggctgtcacccgctgcggccggccctcccatgccgttccgctccccagccggacctgcgcccgggggcggcagcccccggatgcgcggccctgcaaccccgtcggcggaacccctgccgggtacgcccgctcgacggtttggccatcggtcccctttcgctcgccgctactcggggagtctcgagattgatttcctctcctccgggtacttagatgtttcagttccccgggttgtcctccccccgcctatgcgttcagcggggggatatgcacactgctgtgcatgggttcgcccattcggagacccccgggtcgaaggatgtgtgctcctcgccggggattatcgcagcttgccgcgtccttcatcggctccctgtgccaaggcatccgccgtgcgcccgtggtatcttgcgggaccgcatcgggcccgcgggatatccacgtgtcgctaattaatctaattaatcgatatcatgaatagcgctcgtatgtcgcaattcgggtatctcataccgcggcacagtcttgactgtgctcgcgatcagatgctcctcactcatgtataagtgaattcttcttgtttggatcggatgaatgattgctatcattcttacgtttaatcgcagaaaagaatcgagtctggaagaaacaagtcttccatctctctcctatcgctatgcggctctcaaggtacgcgggtgcgaccccggggaccgggtgctgcggggacttcatcgcgggcgacatccaccggacgggctcctgccctcattcgagttaaagtgtttctctctaagaactaatctccctagaaaggaggtgatccagccgcaccttccggtacggctaccttgttacgacttcacccccctcaccctccacaccttcggcgcctccccccattgctggttgggccggcgacttcgggtgcagacgactcgggtggtgtgacgggcggtgtgtacaaggcccgggaacgcattcaccgcggcatgctgatccgcgattactagcaactccgacttcatgggggcgggttgcagcccccaatccgaactggggccggctttccgggatccgctccccctcgcggggtggcatccctctgtaccggccattgtagcacgtgtgcagcccagggcataaggggcatgatgacttgacgtcgtccccgccctcctccgccttgacggcggcggtcccgcgtgggttcccggcatcacccgatggcaacacgcggcgggggttgcgctcgttgcgggacttaacccaacatctcacgacacgagctgacgacagccatgcaccacctgtatgggctcctctcggccacggggtctcccccgcttcacccatatgtcaagccctggtaaggttcttcgcgttgcttcgaattaagccacatgctccgctgcttgtgcgggcccccgtcaattcctttgagttttagccttgcggccgtactccccaggcgggacgcttaatgcgttggctgcggcacggggggatcgtccccccacacctagcgtccatcgtttacggctgggactaccagggtatctaatcctgttcgctcccccagctttcgcgcctcagcgtcggtctcggcccagagggccgccttcgccaccggtgttccacccgatatctgcgcattccaccgctacaccgggtgttccaccctcccctaccggacccaagccgcggaggttccgggggcttcggggggttgagccccccgcttcgacccccggcctgccgggccgcctacgcgcgctttacgcccaatgaatccggataacgctcgccccctacgtattaccgcggctgctggcacgtagttagccggggcttcttctgcaggtacagtcttgactcttccctgctgaaagcggtttacgacccgaaggcctccgtcccgcacgcggcgtcgctgcgtcagggttccccccattgcgcaagattccccactgctgcctcccgtaggagtctgggccgtgtctcagtcccaatctggccggtcggtctctcaacccggctacccgttgtcggcacggtgggccgtcaccccgccgtctacctgatgggccgcggagccatcccctcccgtcggggctttagccggggtgccatgcggcaccccggggtatccggtattacccgtcctttcgggcggctatcccgggggagggggcaggttctccacgtgttactcagccgttcgccactcgcttctgcccgaaggcaggtgccgttcgacttgcatgtgttaggcgcgccgccagcgttcatcctgagccaggatcgaactctccgtccaaaaatatgggcttcgagcccgtccggtcctctcagtccatcgctgatcggttccgttcgattcatatggttctgttagataggaaaaggaatttctcggggccgcctctcggcggccttgcgaaaaacaaatccaagttagaccatttcaaatggttcgatgtctgcccggatgcgacactctgcgggaacggcctatccgctcaatgtgttcggctgagatcggaaatcaacctttatctgttttaagaaaaaggacgatatgaaagaaataggagaatttgtaccctttggcttgctcttttgcaaacgtattcccaatacgttttaaacatgcggcactcgccttaaggtcgaaatataaacggggcgaggccggactacgtcacataccgcaggacgggggcacagatcagattcacctatcatgaattcatctgcgcgataaaactgcgcatgcaaatttaccgcactatgaactacatcgtgcgggacatgaaggtgtcgacgacccgctagcttcacccgcttgaaaacacccgcaagcgacggcagcgcgaaaagcaattggcctccggcgaaacctctgcggagttttcgatctccgtatttgtcgaactgccagttctgccacgccgccacttcctgcccgccgagatcgttcctcaagccgcacagcagcccgccttctaagacctcagagttcgccatcgaaggcgacctgcccagactcctcacaatcggcttgcatgaggccccgcgctccaacatcctctggaccgtgtccctctcgtacctggtgagcgagcccgccgttggccctcggatgaagctaccgatcgagacggggcgtatgatgggcggtcgctggaatcgcgccccacaccgcctcccccatcgtgcgataatcctctgcagaagtcaccaaaagcagagggagtttgtgatgaaggttcttttggtcaatggcagtcccaaggcaaacggcaacaccgcccgcgcactcgccgaggtcgccgagcaacttaatgcagaaggcattgataccgaggtgtttcagctgggcgccaagcccattcgcgattgcattggctgtggtcagtgcggcaagcttgattgccgctgcacctttgacgatgacgtggtgaacgagctgatcgctgccgccgagcaggctgatggctttgtctttggctcgcccgtctactatgcgcaccccagcggacgcatcctttcggccctcgatcgcgcattctatgcaggcgggcatgcctttgagcacaaacccggcgccgcggtcgccgtcgcccgtcgcggcggcacgtcgaccaccttcgatgtgctcaacaagtacttcaccattaagcaaatgcccgtggttgcttccacctactggaacaacgtgtttggccgcgtgcccggcgacgccgatggggacgccgagggccttgccaccatgcgaaatatcggcaaaaacatggcgtggctcctgcgctgcatcgaggcaggacaggccgccggtatcaacgcacccgaggcagatcgagcaacgaccaacttcattcgataagtccagcggcggtcacctcgacgctcgttagaacggcggaacaatatatgaatattcaaatcttcggcaccaaaaaatccttcgataccaagaaggcacagcgttattttaaggagcgccgcattaaggtgcagtttattgaccttaaggaaaaggagatgagcaagggcgagctcacgagcgtgatgcaggcggtcggcggtatcgacaagctgctcaatcccaaggccaaggacgaggagacgctcgcgctcatccagcacctcacccctagccagcgcttcgacaagctgctcgaaaaccagcaggttctggccgagcccatcgtacgcaacggtaaaaaggccaccgtcggttattgccccgatgtatggggagcctgggagtagcctgtgttatttgccggcgcgtgggtataagagcaggcgtttggcataagattcaactgtaagccatgtctaacaaaggagggcacatgcccaacaaacccgtgaagatcatcatgcttaccggatacctcggtgccggcaagaccacgctgctcaaccacatcctcgctaacgacggcggcatccgcgctgccgtcatcgtcaacgatatcggcgagatcaacgtcgatgccagcctcatcgccgacggcggcctttccgagaccgacgacctcatcccgctcaccaacggctgcatctgctgcacgctttcggacgacctggccaaccagctgcagggcatcgccgattcgggcaacttcgactacatcatcatcgaggcatcgggcatttgcgagcctatccccatcgcctacaccatctcgagcttctgcgacgaggccaaggtgggcggcgagcccaagctcgcgctcgacaacatcgtggccgtggtcgactgcgcccgcatgtacgacgagttcaacggcggtcgcgacctgctggccgaggatatcgacgaggacgacatcgagagcctgcttatccagcagatcgagttctgctccacgctgatcctcaacaagaccgataccgtgagccctgagcagatcgccgagctcaaggccatcgtgcgcagcctgcagaaggacgccgtgatcgtcgaggcccaaaacggcgaggtccccatggaggagctgctcgacaccgaccgcttcgactttatgcgcgcctacaactccgccgcctggatcgaggccatggagcatcccgaggagcacgacgaccccgaggtgctggagtacgacatcgagacctttgtgtactcgcatcgcaagccgtttgacctgcagaagttcaccgactttgtcgagcaggagtggcccgacgaggtcatccgcgtcaagggcccactgtggcagaccggcgacccggacatgtgctacatgtttgagcaggccggccaccagatgcgcctgatggagaacggcctgttcgtcgattccgcgcccgagggcgagaagcagaagattatcgacgagaaccccgagatcatgcagatttgggatgacgagacgggcgaccgcatgacgagcctgtgcattatcggccgtcacatggacaaggacgcgctcatcgccgccctcgatgcctgcctgaccgactggcaccgcgcctaggtttatcgaggcggatttgtccgcccgctacgtaaccgccacaaaccaccacgaaggtgcctgtccccttcgtggtggtttttcgttctgagccaaggagattcatgttcaatatcgtgctgtacgcgcccgagatccccgccaatacgggcaacatcggccgcacctgcgtggtcacgggaacccgtctacacctggttgagcccctgggcttttcgctcgacgacaagacggtacgtcgcgccggtctgggttattggcaaaacttgaacgtgacgacctatgccaactgggaggacttccttgcccgcaacggcctctcccccgccgatgagcgcctgcacctgctgaccaaaaaggctcgtcgcacctatgcgcaaagcacctatcgcgacggcgacttcttggtctttggcagcgagggctcgggcattcccgagccactgcttgccgcggcgcccgagcgctgcgagcgcatcccgatgctgcgcgattgcgactcactcgataacgctgaggtttgggaagctcacgaggaatcgctggggcataccgaggacagtcacgaggccatccttcggcaggatatctgcggcaacttcgtcaatcccgacgactaccgcatcagcgcactcaacctctccaacagcgccgccatcgtcctctacgaagccctgcgccaaacaggctttccgggaatgtgacaaaggaactgtccctctgtcacattccagtgccgcgccgatggcgtacgcgcctaattgatgctctagataaagagccctcacttttaatcagaattaactaaagtaaaatgaagttaaacggcggtgtgaaaggagagccttgtgaaatatctcgagaacccgtttacccccagttttggtgaggttcctgcccatctcgctggcagacagcagattattcgggatttggaccgtgccttcttgagccagcgcaggcgcccggaactgacatccatcttctccggagcgcgcggaaccggcaaaacagccctcatgtcgtcgctcgcgacgagggccgaatctcatggctggattgccgtgaagacaaccgcgcttccagggatgcttgatgaaatcgagctcggagcaaagcgcgctgcggcacacctcatcgacgcaccgagcgactttgaaatcaccggccttggaatcgcacccatcggcagtatcgaggtgagccacgcccatgaggcctcgacctggagataccgcatgggcgatattatcgaccagctcaacaaagccgacgctgggctgctcatcacggttgatgaggtagacccgacgctcgacgagatgattcagctcgcagctacgtatcagcactttgtgactgacggaaagcgtgtcgccctgcttatggcgggacttcccaacaacgtatcgacgctactaaaccacaagacggtctcgtttcttcgccgtgcccaacaatatcatctgggtcgcattgccgactatgacgtacgcgaagccttgattcgcacaattcaggaaaacgatcgcctggcagatgctgagggaatcgatagagccgttcgctcgatctctggttttcccttcctattgcaactcgtaggctaccgtgcctgggacctcacaagcgattcgaaggaaatctcgtcacgcgactttgacctgggaatcaaaatcgcgcgcgacgagatggacgaccgaatcctcgcggcaacctatcgggaactcactgcagaggacaagcgattcctcatcgccatgctcgatgacgaggaagagtccaccaccgccaaccttatcgagcgccttaagcgttcgccgcagcaggtctcccgctaccgacgccgcatgatagatgccggcatcattggagaacgcgggcgcggaatcgtcgcttttgaattgccattcttccgcgactatctcgccgctcaatgcgtgaaatagaagtcaatgtgacaaaggaactgttcctttgtcacattcggttataggtagcggccggtgatgcttgcggggcaggctgcgatgtcgcccggcgtaccggcgcagacgatttgcccgccggcgtcgccaccgcccgggcccatgtcgatcacgtaatcggcgttacggataaggtcgaggtcgtgttcgatcacgataaccgtggcgcccttggcaacaaggccgtcgaacacactcagcaacacctgaacatcgagcggatgtagaccgatcgtaggctcgtcgaacacgaatacggcatcgtcctgcacgcgtcccatctcgctcgcaagcttaagacgctgcgcctcgccgcccgaaagcgccggcgtgggctcaccgagcgtaagatagcccaagccaaggtcgtgcaaggtctgcaagcgcgtctgaactttcttgagccccaccgtggcgtcgatggcctcgtccacactcatgtccatgagctgcggcaacgtaagcagactcccgtccttgccctcgcgatggatatgcgaagccgcgtctgcataacgtgagccgcgacatgccgggcagacgatttcgacatcgggcaaaaactgcacgtcgagcgatatcgagcccgtgccatcacacgtagggcagcgcaaggcgccggtattgtagctaaaggcgcccgccttgtagccggctgccttggcctcgggcgtacgggcgaaggcgcggcgcagctcatcatggatgtcggcataggttgccaccgtcgagcgcacgttggcaccgatgggcgtggcgtcaatcaggttggcacgcgcaataccctcggcatcgatccagcgcacgtggcgtggcaagcgctcgccggctgtctgcgccttaagcgccgggatgagcgtctcgagcaccaacgtcgtcttgcccgaacccgaaacacccgtaaccgcgaccaagcgaccgcgcggaatatcgacttcgagcggcttgacggtatggatggtatcggtcgccatgcggatatggccctggtcgaacatttcgtcgtcagttacctgcggacgcaagcgcttgggcttggcgcgcaaaaacggcgcgatacggctgtcctgcgattgctcgacctcgtctaccgtaccagcggcgattacgttgccgccgcctgctccggcaacggggcccatctcgaccagataatcagcctccgccagcacacgtgtatcgtggtcgacaacaaccacggtattgccgtcatccaccaggtcgcgcattacgcccaccaagccgtcgacattgtcaggatgcaagccaattgagggctcgtccagcacatagagcacgcctgtcgatcggttgcgcaccacgcgggcgagttgcacgcgctggcgctcacccgtggagagcgtggcaccggcgcgatcgagcgaaaggtaatcgagacccaggtcgaccagacgacgagccgtgctcaaaaacgaatcgcagatatccgtcgccatgggctgcatctcggccggcaaggatgcgggcaccccgcgcacccactcgatcgcatcaccaagcgtcatggccgcggcctgagccagattgataccgcgcacctggggctggcgcgcagcctcggagagacgcgtgccggcgcagtcacggcatggtccctcgcgcaaaaagcgagccacacgcttaagccccttatcgtccttaaccttggcgagcgcattctcaacggtatagacggcgttgtaataggtaaagtcgagcggcgtggcgccctcgccgtttttgggaacgtagagaatgtgcttcttaaccgccgggccgtgaaacacgatgtcgcgctcttgaggcgtgagctggttaaacggcacgtcggtgcgcacgcccatctcgccggccacctgcttcatcaggtcccacatgagcgtgccccagggaagcaccgcaccctcgttgatggtctttgactcgtcgggcaccaggctcgcctcgtctacctcgcgcatgacaccggtgccgccgcaggtagggcacgcaccgccgctattgaaagccaaatcctcggcactcggcgcgtagaactcgcggccgcatgtcggacacgtgagcgacaggcccgcagccacgttaaggctcggctccacgcgcgctccgcagtgcggacacacgtgatgggcgcaacggctaaagagcaggcgcaggctgttgttgagctcggtcatggtgccaaaggtggagcgtacgcccggcacgctcggacgctgatgcaacgcgagcgccgctggcacgtgcagcacctcgtccacctgggcgtgctcggcctgcgtcagacgacggcgggtataggtgctgagcgcctccagatagcggcgcgagccctcggcataaagaaccccgagtgccagcgaactcttgcccgaacccgacacgccggcaatgcccacgagctttcccagcggaatatcgatatcgatgtctttgaggttatggacgcgcgcgccacgcacctcgatagcctgcgggttcatcttctgttccgtcacctttatcaccctactcatgccatataactcgatcgcgaatgtacgcgcccagcatgggcacggtaaaccggacgaggccgtatccggcagcctcgatgacgcgctcgcgaatcaggcttgcgcgatatttactcgcccagctctgagtgcgatcacagcgctcaatgatgtccgccatgcgcgtcggcttgcctccgtcaactgccatggcctcgataaataggcgctgtggactgcgcagcccgtaatacaggggcgcgtcaaccgcttcgtagaactcggagacggcatccgcatggccatcctcggcatcgcgctcttcaatgacctgcgagccacgccgggcagcagcccgccacatgtaatatcccaccagctggaccatatagggatgccccatgctcctgcgcgccgctaggtccgccgtctcctcatcaacgcaaagaccagcgtctttgaccgtctggatgtacgaatcgcgcactttgggcaaagaaatcgcccccagcgtacgctgctgggcgcggcgcaaaaacgtcacactcggctcttcaagcagatcgtcaaccatactgggcaagccggcaaaaaccagcccaagaccgcgctggtcgctattgggcaagcccgtggcatcctgatctccgagcacttgctgatagagaacggcaagagccgccagttcctcgatagacgcagattgcgcctcgtcaatcgcaaacagtatgcccttgcctggaccgagcttcttgaggcgctcgttgaccagccctcgcaatgtttcgccctttgctcgcgccgcctcgaccgacatccggccaaacgacggaccgagctccattgacgtcacaacgggtttattcgagcgaagcgcgtcggccaagcggtcgcataagccaagcgaagcgaaatcggagacaaccgcccatccgcgcgcgctggctagacgctgcagctcccgtaggagaaccgttttgccacagccgcggtttcccgtaatgagcatgaacctacccggcgctccggcgccgttatcgagcccttcctcgaaatcttcgatgaccgactcgcgaccgatgagtatcggaggccgcttgcctgccgttggcttaaagggattcgggttcatgtcggcctcctcggattggcaaaccctggtaatagttataccaacttataccgagttataccaacagcgggtgacaaaggggctgtccccttgtcacatgtggccgaaaaactcagcgtctgctgctcgccagggacggaaggtggcgggatcgacctttacgtgcgccgcggcgggtacgtcgtaccatttgaccgtgtaaccggcgccgtgagagcaaaagaccgagtcgggcgtgttgggcagatcggcctcgggctcataggcggccgtctcgattacgtgctcggcatcatggcaagccgcatagccggcgaactccaggtacagatgcccgcgaccgctcgtgtaggcagccacctccagcgcataatcctgcacctcggatgccggcacgcgacccacaagcttcgcccggtctcccgccatcgtcggcggctcgcactcggcacccatgcgcgtggcatccgagagcgcccggcccacgcactcccccggcacctcgagctcaaagtggtaccacggctccaacagcaccgccgcgccggcctcacgtgcccgcatgagcccctggcgaatcgcgcgatacgtggcctggcgaaaatcgccgccctcggtgtgtttggcatgcgcgcggccgcctgtgagcgtaatgcgcatatcggtgatgggcgaaccggtcagcacgcccagatgatcgcgctccatggcgttggtgagcgccagacgctgccagttaagatcaagctcgtcggtcgaggtcacggtgccaaactgcacgcccaaacccgccggcaacggctccaggcgcagatgcacctcggcatagtggcgcagtggctcaaagtggcccacgccctcgaccggctgcgaaatagtctccttatagagaatgccgccagactcaaactcgaccgcaaggccaaagcgatctgccaacacccgctgcacgacctcgagttgcacggctcccatcaactgcaaatgaatctgctcaagatgagtattccagcttacgccgagcatgggatcctcgtccgccaactcagtcaatgctttgaacaccgtatgggcatcatgttcgcccggaagcactgtataggtgagaaccggcgcaatgacaggcgcatcgcccgcgggctccgcacccagggcgtcccctgggcgaacgcgcgcaagacccgtcacggcacaaataccgccagcagcaacttcttgggcaagctcatacttctcgccgttatagatgcgcacctggtcgatcttctgctcccatgcctcggcgccggaacgtccgttaatcagctgtttggcatgcagcgtgccgccggtcactttaacccaagccaagcgctcgccgcgatccccgcggctgacacgatagacgcgcgcggcaaactccgggagccacgcctgttcacgcatcagcgcgcatatgccatccagcagctcgtccacgccttggtccttgagcgccgagccggcaaagcagggaaaaagcttgcgctcggcaaccatgcgcgacagcgttgcgacagaaagctcgcctgcctcaagaaactcctcgagcgccgcttcgtccaacgcagcagcgtcctcctgaacggcgccgcccgccagcagctcgttggcatccaggcagccctcggaaagacgctgcccgagttgtgccagcaaaacatcgcggccgggattctccaaatcgatcttgttgatgaagatgaacgtcgggatgtcatagcgtgcaagcaggcgccacagggtttcggtgtgcccctgcacgccatcgttggcgcccaccaccagaatcgcgtagtccagggcacgcagtgtgcgctccgcctcggcagaaaaatcgacatggccgggagcatccacgagcatgacgtgggtatcgccgtggtcgagcacggcctgcgacgagaaaatcgtgatgccgcgctcgcgctcgatcgtgttagtgtccagatgcgaatcgccatcgtccacgcggccacgcttgcgaatgcggcccgcgttgaacagcatggcctcggccaacgtggtcttgccggcatcgacatgcgccaagattccaacgaccgcttgcttcgacatggctctcctcttattgcaagcccatcgcacgcggcaacgggcgttcacgctccacactggatgatacaatttacgggccggtgggcgaagcgggccctatcccccgaccgagctcatcgccccgcgttgccgcgcggcgattttcgtaggttcgcgccttgcgaaagccggcacctcccctttttgtctgcccgggttcatctggggcggtaacaatgcgagtcccacaacgacgcgttttaccaaaaatggccccactcggggccattttttatttgagctgggtgatgatacgtgccttggctcctacgcctcgcgcagccaatcaaacgcgacacgcgccgtgccgtcggacacatagacgataccgacacgctcgaaccccgccttggcgatggcgccctgcatgggcaagttgtcctcgtgcgtgtcaatacgcagatggtcggcgcattccttggcaaaggcaaacatcgccgccgcgataccgtgcacggtgccgtcggatgccacgcgatgcagcacggcatacggagtgtcgctgcgccattgaccgtcctcaatcacgtcatagcactcgtccggacccggtaaaaaggcaaacgtcgccaccacgcggccgtcgacttcgcacacgtaactgccaccagcggcaatatcggcagccagctgctcggccgaaggcgtgccctcgggccactgcgtggcgttgccatgcgcgcgcataaaggcgcgggccgcgtcatagatagccatgacggcgggaatgtcggtatcgagggtttttctgatcatcacgcggcgacctcacgtttattggtatcactttgattgagcaatgataccaacgtttggagaggagcgcgaagcagatggggagcaaaaagcgagccgcctggtcaaaagccaaaagcgagtttttgggcgctgccaccggcggcgatatgagcgacctgtttgcacgcgaggacgagcgccgcgacgccctggacgccgagcgcgacgaggcttggcgctataagtcgtgcgagcgcaaaaaccgttacgacacacgcgccgaagccgaggccgttatggccgactgcgaaaaccgcggacggcgtggtttggcctgctacaaatgcgaatactgcggcggctggcacctgacgtcgcacccttggaaatagaccccgcatcggcacggcgctggcgaagcgccagccatcgtgcacaagctacgggcgcggcggcaccaaaacatcgtaacgaacggccttgcccgcaagctgatagctcggcttaacgccggcaagcagcggccccttcaccggtcgcttgataacgaccttgcgcgggtgcaccgcaagcgcagcttcgaccagcgtctcctcgtcggcgcacggctgctccagatggtgcaagagctgaaacttctttttcaccgccgcgctcttggtgcgctcgggaaacatggggttcagatacaccacgtcgggagccgcgagctcgccttgcttgatcagctcggccgtatggcgaaggccggcaatgctgtcctcgcccgcatgtaagcgcatgcgcgccacagcagccgcaagcgccggatcatctgccgcgcgatccaaggcgtccttgaggagtgccgcgatcacgcaatcctgttcatacagatcgacggtaaagcccgcggccgccagcagcagcgaatcctcaccaaagcccgccgtggcatcaatcgcccatgggcgctcgatgccttttgtgcgcgcagcctttaccagcagctcttgctgcaggcggccctgcttgagtcgtggcagcatgcggccaaaatcggcgcgcagttccatcgtgccgtcggtgagcgtgaggccctcggacttcccggtcagctcaagccccgcggcccgagcaacagaaaagggatcgacgacgcccatggacactccttagcaaacaaaacgaatacgtgagcgccacctcagttggcacccaaccgtccgttattgtcccacatgcgacatggtccacagcatcccaatgcaaagcaccgccatcaatcccgtgcacacggcagcgatcacagaatcacccatgcgccttcccaacgaccgcggttcacgcacttgctctggtccgtacatcatggctcctccttagactcacttcttatcacggcctcatcatcgcagcgccgcacatgagctgccatcgatttgacttacagctggctttcctttttgaaaggttggaccgcacaggctcaaagcgctttcaaacgcatgcatcgctccgttgaactacaatgtgcttcacgatatgtgccgcaacctgggtgcgacagattctccgcgcccgcatcgaaaggaccagctatgagcgccgctcgcaagacactcaaaatccttgccctgatttattttgttctgggcatcgccagtctcgtcattggaatcgccggcatcgcgaccggcaagttcgagtccacctacgggccgaacgccatgctcgccacggtcgtgcttgtcgccaagggcctcatcgatctcgccgcgggcgttgcgggcatcaagggcgccaacaagccttcgcaggtaggcggcgcgtttaagctcggcatcgtcgccgcaatcgccacgattgcgcaggctgtgctcacgctccccgcgtttggcggcgacgccatcaactatggcgcctttgtcatcgtggtgtacgacctgttctttattcagcaggcacacgacattaaggccgaaaacaaggaccgcctgtaggcacctgtctcccataacccctgctatcaagcaactaaaagggccgatcgcgcatccccgcggtcggccctttacgtttgcccagataaaacctgccaaaataaacctgtccctttttggtaggttagtggcggtactcggcgatgatgaagtcgatgtcggtttgaagggtgtccaggtttgccaggcgctctttatcggcagggcgcgtgcggtagtagtacggcgtcatttggaacaccgcctcgatgtcagcctgggtctggagcgtaatgttcgcagacacccgctgcgttccgaccaacttaagctccgtagtcttcggcagcttttcgtcgttgagatatggcgtgtcgtagagcacttccttaagcccaaagagatgacgggcacccggcaccacggtatagagcgagccctctggtgccagcacgcgggcaaactcgcgctcgttaaagggagcaaagagctcggtcaccatatcgaaggcgtcatcggccacgggaatgtccttcatgttggccacgaagaaggtcgcatcgccgcgcttggcggccaggcgcaccatctctttgcccaggtcaaagccgtaagcatccacgcccggcaccgcacccatggcgctggtgtagtagccctcgccacagcaaatgtcgagcaaggtcatggggccgttcgcagacgtagcgcgcccagacatctgtttgcgggccagctcgaccattgcatcgcgcaacggcgcgtagtatccgcggttcagaaagtcacgacggctgcgcgcctgcgacttgggatcacccatggagtcaccgctcttggacgaacgcagtaggtacagatagccctcgcgcgcacggtcaaaccggtgtccgcccgcgcatgcagcaccgcgctcgtcgtccaccaacggctcatggcaaacgggacacaacaacatggcaactccttagcgcgaacaacacaacgcccaccattgtcgcacgccttccccacctagtcatagaagagacaaggagtgtccccagctgccggcagagacgatatgagcaggacataaaaacattgagagcccctgctgcactgcgggaacggcctatccgctcaatgtgttcggctgagatcggaaatcaaccttcaaattaccgcatgtctatacgatcatgttcttgctgatcgttgtctttgcggtcctgacttggatcgttccctctggtcagtatcagcgcaagacgatttcgacagcggcgggcgagcgtgaagtcgccgttgctggaacctatgaacaggtcgataagaactacaccgattccgagaccggcgagaccatcaatctgggtcaggatatcttcgcggtcctgcaagcgcccactaagggcatccaagaggctgccgacgtcgttgcgttcgtcttattgattggcggatcgttcgcaatcatcaccaagaccaacgctttgaatgccggcatgagccgtgtgattaaaaagctcaagaacaaggacatcctcatcattcccatcacgatgacgttgctgtccatttgcggcactacgtttggtatgtctgaggaagccctgccgttctatgccatcttcattcccatcatgatgggtatcggttatgactcgatgacggcattcatcatctgcttccttggtcctaacctgggatattgtgcttcgaccatcgacccgtttaacgtcttgatcgcacagggcattatcggcatcgagggcaatccgcaactgtggctgcgcgccgtttcttgggtcatcttcactgccgtcggtatcgcatgggccatgcgctacgccatgcgcgtcaagaaaaaccccgagtcgtccattacgtacgaggacgataagctcaagcgtatcgagttttccgtgaccgatgcctccatcgaggaagagttcactatccgtcagaagctcgtgcttatcgattttgcttgcggtatgggcattatcgtctggggtcttgttacccagggttggtacatgaatgagatttccgccgtgttccttggcatgggcttgcttgccggtatcctgggcggtcttgaccagcagacgattgctgaggagttcgttaaaggtctcgccgactttgcgtacgccgccatcgttattggtatcgctcgcggtattctggtcatcgccgagggcggcatgatcatcgacaccattctccaggcgctcgctactgcgctcgccggtgcacccgccgccgtctacaccacgtttatgtatatcgtccttggcctgctctctttgctggttccctcgagttctggcctggcggcgctcaccatgcctgttatgggccccctgaccgagcttatgggcctcaatcccgaggcagccgttaccgcgctccagtttgctaatcagaccatcaacaccatcagtcccgtggcgggcatgacggtcgccggccttgccgtggcaaagatctcgtttggccaatggtggaagaccatttggaagttcttcattttcatggtcgtctttggcctgatcgtaacggcaatctctggcatgcttccggtgtaggtggttgtgatgtctgatcgtttgacggtcctgacgtctaagagcgtctttaccggtacgggggacctgccgtttgaaggtttcgtagcggtccgtggcaatcgaattgaggctgttggcaccaagtgtgaggtagcttcgtatttgacccaagcggacgaggtagttgacctgggcgaccgcaccgtcatgcctggcctgatcgatgtgcataccttctatacgggctgggcgctgcggacgttggggtctgatctgtccggcgtcgccgatgccaaagaggccgtgtcgctcttgcgtgcatggaaagaagatcatccggattgcgcggcggcttttggccacaacctacccgaaacgctggcatcggatgccgagaacgcaaatacggcggctgtgtttgacgattgttttggcgatatccctgtcgtctgctttacaccgggtgcggagacctgcgttctcaatgctgccgccagtgcgcgatacggctttacaccgcaggcgtgctatgccgagaagatctggcgcatgatgagcgatttcctcgcgctgcccgaggtacgtgcggggtattcggactacatgagcatgcttaacgagcgcggcgttaccgccatcaaggagatggcgtttgatgactactacggctttgccgacgaaatggctcgccgtgaggaatctggtgagctgacggttcgcgtctctatgatgtcgcagccggtgggcgctggtgcaaatctggcatatgcccgcgaggcacgagagcgcttccggggaccgttcgttcgtttttctggcttcaaccgtatgaccgatcgcggcgtatgggcggggcttgccgagatgattgacccctatgaggacacggccgatgcgggagccgccggcaagacggtcgtcgaggagcccgagtgggatctgattgagaacgagctacgtgcaattgatgctgacggcttccgatattccttgcattgccagggagatggcgccgttcgtcgcaccgtggcgctctatgcctcgctgcctcgagacgaacatggacggatgcttcgccgccatgcgattaccgatctcgagaactctgacccgaccgatcttatcgagtttggcaagttaggtggaatttgcgaggtctatccgcagattctgacgctggaccggcgcgaggattgcctatcgatgatgcgtcgacaaattggcgagacgcgacttttacacagctggaatcgccgcggcatggaagattccggatgcacggtgtgctgtggtacggatttgccgctgctgattccgagcctgggcgagtcaatctacagcgcgtgcggcggatacttcgacgatggactgcccgtgaatgaggccaacgtgctgacgcttgtcgagctcttgcgcgcttggactgccgggggcgcgtacgatctgatgcgcgaagacgagctgggtacgcttgaggttggcaagcttgccgatatctgcgtgctcgatcgggatgtgttcgacctcgattatcgcgacgcacgcgatcttgcggttgatatgacgatgtcggacggacaaatcgtgttcgatcgaaataaggaggcataaggtgtctgaatccaaaccgacgctgcgccgcgaacagattgcgggcatgaatatccactacatcatgtggtcgctcgattacttccttgacgcgcagcagcgtttgggctttgagtccattgagctgtggtgtgcggagccgcatgtgacgctcgaccacacgggctactttgaggctgaggtcctggcgaaaaaggctgcagaccgtgggcttaggtatcgtactctgtgccccgagaatgttgtctatccttggcaatactgcgcacgcaagccgctgcatgaacagcgcagcctggcgtactttaagcacggcattgagcttgctgaggtacttgggtgcgaccgtatgtccgtcaactcgggctggggcgactgggacgaggatcgcgaggaagcctggaagcgcagccgcgagcacttgtccattctggcggagtatgccggcgagcacggtctggtgcttacgatggaaagcctgcgtcccgaggagagcaaccttgtgacgacggtttccgatgcgaagcgcatgattgacgaggtcgcgagcccgtacttacagcccatggttgatacaaccgcgatgggcgttgcaggcgagacgctcgaggactggtttgccgcctttggtgatggggcaattcacgagatgcactttatcgacggtgacccgtatggccatctggtgtggggcgatggcaagcacgatatggacgccttcgtcgccacgctcaacgcccatggttttgacggcatgctgggccaggaaatcacggacggtcgttactacgatgacccggcggcggcagatgccaagaacatggccgcattcgagaaatatctgattgactaaaacaactatcggccacgcagccaatctcattgattgcggaccaaacaagaaaggaactggatatgaacgcacacgatctgatcaaagaggcaattgccgagaagggcaagttcgacagcgtctactggattgcttgcggtggctccatgatcgatttgatcccggctcatgagcttctgcagcgcgaggcaaccaccttcacttcgtatatctataccgcgcgtgaattcgacattatgcgtccgcgtcgtctgggcgagaagtccctggtcatcgcttgtagccacagtggcaacacccccgaggtcgtcgagggctgcgagattgcccttgctgccggcgctacggtgatcgcccagaccgacaatgctggatctaagatcgactccggcaagtggaccacgtgggtctacccgtggggcgagggtgtgccgcaggccgaggtccccgctggtatttcgctgtcgcttgcggcagagctgctcgatcagcaggagggctacgccgatcttgccgatatgtatgccggtatcgccgagatggataagattcttcccccggcacgcgagaaggtaaatgccgagctgggcgatcgctttgccaagctttgccaggagcacgagttcttctatattctgggcagcggtcccaactttagccagacctacggtttcgctatctgctctcttatggagatgcagtggcagcactgcagctacatccactctgccgagtacttccatggccccttcgaggctactcaggatggcgttttttacttcctgcagatgggctccagcgagtgccgtgctatggacgagcgcgccctggcgttccttaagacgcataccgatacgctgatggtgctcgatgccaaggagtacggtatggaagccgtgccggcgagcgtccgtgcctatctggacccggtgctgttctatgccatgaactgcgagctgcgtgctgcacgcggcaaggtgtttgatcacgatcccgatttccgtcgctatatgggtgttgtcgagtactagaagggacaaaggccatggcatttaacgttaacgcgctcggatttggcgacaacgtcgtcgatcgctacgagcatatccataccatgtatcctggcggcaatgcggtgaacttcgccgtttatgccaagaaatgcggtgccgcacgctccgcatacatgggcatttttggcaatgacgccgctgccgagcatgtcattgcaagcctcgaggatgagggtatcgagcttgacaagtgcgagcagatgattggcgagaacggagcggctcgcgtcaccgtcgttgacggtgaccgtgtcttccttggctccaacgagggcggtatccgtggcgatgcgcgctatgtcctcgatcgctttgacctttcgtacatgaagcagttcgatgtggttcattcgggcaactattgctttaccgagcgcgagctgcccaagctgaaggctgcgggcgtcacggtctcttttgacttttcggacgactccaccgacgagtactacgagcagattgcgccctacgtcgatttcgctttctttagtgcggcggatgccgcgagtgaggacgagattcgcgagcgtctggcatgggtgaagggcttgggtccgcgttttgtgtcggctacggcgggcgccgagggctgcattgcttacgacggcgagcgttattaccgccagctggctaaaccggtaacggacatgaaggacaccatgggggcgggcgactcgttcctcacctcgtttttgatgtgctatctcgattccgccaagcgtggtgaagatggcgccgaggccatcgagcgtgcgctcgactttgctgccgggtttgcctcgaccgtgtgcggcatggaaggttcttggggccacggagcaccaatcgtcgaatagcttaagaaagcgtacggcggtctggctatgaggctttggacggccgatgcaaaacaataagcgaaacgcgaaaagggggctcgccatgtggtgggtccccttttgaacattggagaagaccatgggtattaaagcgtgcgcggctggtttttgctgtgcggacgtctatcaaaacatcggcgtgttctatccgactggtaatggcattgactggggtatccatcttgcacgaatgggagtttcggtatccgccgtgtcggttgtcggcaaggacgagtacggagacaagatgagagaggcgctggccgctgaggggttcgatatctcacatctgcgggtggaggatggcgacacctcggtgatgctcatggcattgaaagacggcgtcgatcgcgtgcatctcgaggcaatcgatggtgttatggagacatatcgaccgaatgaagatgaccgggcgtttatcctagagcatgacatcattcataccgacctgtttggcaattgtttggacctcctgcccgaatggcatgatgcgggcaagacggtggttatggacttctcggtgttcagccaggatcccgaatatgcctgcgaggctcattttccttacgtagactatgcgtttatgtcgtttgaagaggacactccggagctgcgtgattgggtacgtcacgtacagaagttggggccgcgggtggcagttgccacgcttggcgagaagggaagcattgcctttgacggcgaacgcttctatgagtgcgggatcgtaccggcagagaaggtcgttaacaccgtgggcgccggtgactcgtatatcgccgggtttaccaagggcgtgattgatggccttgatattccggcgtgtatgaaggcgggcgccgagctttcgtcccgcgtcatcggctcttttgagccgtactagggtcaaatgcttggaaaggagtgcgaaatggttatcgacatgttggtccagcccatgctctacggcgagatctatacgccgggtgatgagcctgatggattcggtttttggtcacgagaatttggtatggggcatatgggccccatggattgggatgagcttcaagtcgagatggacgtctgcgatgtgcagaagagcgtgctcatgccgctcgatgtaaccacggcatgcggagggcattttggcaccaatgaccagattgccatgctggttgccgcgcatcccgatcgtctgtggggatttgcgagcgtagatccgcaggtgagcggtgccgcagacgaattggggcgcgcctttaccgagttgggggcaaaggggctttgcctgcatccggcaaagcagggttttgctcccgatgatgccgtggccgagccgctttacgagctgtgcgagcgctataacaagccggtggttttccatgccggtatgtcttgggagccgggcgcagagctctcgcgcagtaatccgcttgaatttgagcacacaatcgcaacgcatccaaatgtgcgttttagtttgacccactttggctggccctgggtgcgcgagaccgtggcgatgctgctcaagtatcccaactgctacacggacacctctatcacttacatcgattcgcccgaggagatgatgcagcgtcttttcacggtcgatatggggccgctgtggtatgagcgcgcgctatcgcatcaagtgatgttcgccagcaatacgccgcgcttccgtgcgttcaaactcaaacgggcgctcgataccgtgtccatgcgcgatgatgcgcgagaaaggctctactggggtaatgccctgcgttttcttgaaggggatgagtgaacatggtggcgctcgagacattgagctatctatcgactgctccggaccagttcatcgatattaccgaagacgtgcacgctgccattgaacgcagctcggtgacgaatggcttggcagcgattattttgtcgcatacgacctgtggaatcgtggtaaacgaggggctgccctgcgtggagacggatcttatggagacgcttgatcgcatcgccccgctagatgccccctatgcgcatgcacacttcctgccgagctatggagccaccggcaacaactcctgtgggcatatcaagagcatgatttgtggaaacagctgcttctttcccgtccaagatggccacatcgtgtgtggaggtgcccagaacatctatcttgcggagtttgacggtccgcagaagcgaaaagtgtacgtcgaggtgctgggggagtaacgtccccgcgataaccctatgaaggagcacttcatgtcgtttctaacttcgatgttcaagaccgaaaagccggttatcggaatgctgcacctgcgtcctctgccgggtgatccactgtattacccgggcggaagcgtgtcgcaggtcgtggaagccgccaagcgcgatctcgaagcgttgcaacggggcggtgtcgatggcattttgattaccaatgagctctcgatgccctatgagcagcacgtttctccctcaacccttgcatcgatgggctatgtaatcggggctctgtcccatgatttgtcgaccccttggggagctgaagctatttacgatggtgatgccacaatcgagctgtgcgctgccgtcgatgcgcagttcacgcgctgcaatttttgcggtgtctgggccggtgatctcgggctgattaaccgagatttcgctcacaccatgcgtcgcaagacggcgctgcgcctggacgacctcaagctttttcacttcatcacgagcgagggggaggtttatctcaacgaccgcacgactgcggacattgccgattcacttctctttaattgccttccagatgcgatggtcatcggcggttcggctgccggtcgtggtgcttcgggcgagcttgccgatgaggtccgcgagcgtgttggcgaagtgcctgtggtatgtggcaccggttgtcgcgaaaataccgtggctgacgtatttgctcactacgatggcgcgtttgtcggcacctgcttaaagcgcgacggaaagctggatgccccggttgatgttgagcgggtagttcgttttatggctgccgctcgtacggcgcgaggggagtaggcacctatggcgttctatctgggtattgatattgggacaagcgcctctaaaggcgttttaatcgataatcgatgcaacatcgtttgccaggcctcttgtggacacgagacggacaacccgcgtgatggatggtaccagcatgatgcggaggcagtttggtggggagatttttgccgcttgtcgcgcgagctggtggtgcgatcgggggttaatgcggcgcagattggatgcgtgggcctttccgcattgggttgcgactgcgtaccggtcgataccgagtgcaacgcgctggcgcccgcgatcttatatggagtcgatgcacgttcgaagccgcagattgatgagcttctttccgaatatgggccagatcgcgcacgcgagcttttcgggcacgatccctgttcgtcagatattgctccaaagatcttgtggtttaaggagaatatgcccgaggtgcacgaacgtgccgcgaagttcctgacggcatcatcgtttctgtgcgcgaagttgacggggcgttttacggtggaccgttatttggcggaggattttcttcccctatacgatcgctacacttggaaggttgatgctcgggaatgtgatcgtttctgccggcctgaccagatggcggaggtaatgtcggctaccgatattgccggggtgattacgcagcgtgcggctgaggcgacggggctcgtggcagggacacctgtcttggtgggaacgggcgactctggtgccgaggccatttcgacgggtgtattccgtcccggcgatatgatggttcagttggggagcacggcgtatttcatctacttagctgatcatatggtcgatgatgctcgcctgtggccagggacgtttatcattcccggaacttacgggatctgcgcggggaccaatacagcgggtgcactcacatcgtggctgcgccaagagctgtatcgcgacgccgtagaggccgagggccacggtggccccgatgcatattcggttatggcgcatgatgccgccgatgtggcgccgggtgccgatgggctcctgtgtctgccgtactttgcgggggagcgtactccgctcaacgattccgaggcgcgtggcgtcttctttggcctgaccggaaggcatacgcgagcccatatggttcgcgccgccttggaaggcgtcgcgtataccgttgcatcccatgtcgacattatcgagcgagagcatggactgccaattgggcgcattatgcttgtcggaggtggaaccaagaatccaatttggatgcaagctatcgccgacgtatgcgggcgcgaggtctcggttgccaaggttacggtgggcgcatgcttcggtgatgccattatggcagctctcgcaggtggcgcctatgcatcatgggatgaactcgcccgagtccttggcgttgcgcaaacaatcgtgcccgatatgactgcccacgagctatatgcgtcgcgccgtcatatctttgacgaattgtatacacgcaaccgtggtctcatgcacgaattggtgtaatgccgccgaactgtaccgccttccaatagggactgcgttgtgcgattcgcatgtcccttggcatttttgcccacaggggttagcgaaggtcaaaaacagagcgcgcatttgctaaaactgccgattcgatgcgctttatgtcacattttttgagcgaggcgatgcgttctgaggtccttgtgagcgatctgatgagcgattgcgcgcttgtttctgtgtttggctcggccggcgcatcggtctcgagcagtagacggtcgagtggaatctgtcgtgcgtattcgcgtcctcgtttagatgcgagcatccgctcgttcacggaaaaatagcagcctgcgtttcgcgcgcggacgaactcgttcgaggtaccgctaaaccagtggaagatgatggcgggggagtcggggcttggggcgagcaattcatgtgacccgaggacgtccagcacggttcctgtcgaacgaacgacgtgaattgatatcacgcgcccggcaagagggtgctgcacgagtgtatcgcagagccggtcaaatgcctgtacttgtagcggctcgcttccggcaaaacgagcggaaaagtcgagcccgacctcgccgatcaagcgttcttgtgcagcgacttcgcaaagcagattgatttcagcgttgtcacatcgtccgtcggcgagccaccagggatggaggccgatgccggcaaagatatttgaacggccgcaggcgcgcttcttggcgcgtgcaaagtcgtgcggatcgacgccgcagtcaaatagaatcaggcccagcgccattgcctcatcggcaacggcgtccgggtgagccattaaatcaagatggcagtgtgcatcaaataaccggggctccatctcggcgcgctccgctagtctaggcgctggccatcggagcgcacgtgctcggtgccgcgcccactgatctggcggataacctcgccggcgatcatctggcccatgatgggcggcataaagctggcggttcccagctcggtgcgctcgtggatgttggaagggtcgcggggctgcgtcttaaccgattcctcgcagctaaacagtacatgtaggctcttgattccgcgcttcttacattctttgcgcataatgcggctcatggggtcacgtaccgtatcgaagatgtcggcaaagcggaggcactcgggatggagcttgttggccccgcccatggagctaaccaaacgaatgccgtggtcctgagcatatttggcaatggtaagctttgccgaaatggtgtcgatggcgtcgacgacgtagtcgagcttgccgcccgtctgctcaaaaacgctcgtaaagaactcgtcgatattgtcgctcagcagatattcagttcgcttgatgacggtggtggcgggattgatgtcgtggatcatggcttccataacatcgaccttgcgcttgccgacggtgctgtgaaaggcgatggcctggcgattgatattgctgggcgcgatgatgtccttgtccagaattacaaaatgaccaatgccgccgcgggcgagtgcctcgcagcagttggagcccacacctccgcagccgagtaccagcaccgtggcatcggcgagcttgtcgagtgcctcgcggcccatgatgatctcgagcttggtatcgcgcgtctcgacgagtgcagcagtttcggccatagatatcctccgatggggaagcgattcatgttttaactatcgccattataggtattatcgcgattccatttgagccctcggcgtttgttgaaatgaggcagggattcgcataagatgaagcagatggcacccgttgcagcgggttggccaactcccaaacacgtttgtagcgtgagaagtggccgtcttcgcattacgcgggggcggctatttcattcgacctccaatgtggatgccgagctccacagccgcgattacaagcaacaacaacgtcaggacatcgttaatactcatagtccatctccttcttgggaagagggagctggcccatctgcttctggacccattgtatctaaaaacgaacgaatgttctatacataacattgctattagataattagacaaacatctaaatatcgagtatagtgtgcacgtcgcgagagatagcgagaggaggttctatgccgggagaaggttttaaggcgctggcggatccaacgcggcggcgcattttagaactgctgcgcgagggcaattgcacggcgggggagctcgccgagcatttcgacataagcaaaccgtcgctcagccatcatctggcaacgcttaaaaacgccgggctggtgaccgatgagcgccatggccaaaacatcgtttacagcttaaataccaccgtcatgcaggacttgattggctggtttatgggctttacaaacactgaaggtgataaggatgaataacgaaaacaagggcattcacgccacgggggtatcgtcgcgcgtgtggattgcactggtcgctctgtgcgttgccaatgtcgcggcgcatctgatagtgatgccgagcctgccggcgcagattcccacgcactggggcgcgaatggcgccgtcgacggttggggccctagctggatggcctccgcgctcggcgtgttgcctctggcacttctcgcgatgttctacgtcgtaccacgcattgaccccaagggcgaggcgtatcggacctcgggtaagttctatcagggcttcgtaatcgccttcacgctgctcatgtgtgccataagctggctgggggagctaacggtgtggggcatcgtgccggtggtaggaacggtcaatttgctggtatcaggcgctatcggcttgctctttattggtatgggcaactacttaccgcgcgtaaagcagaactacacgctcggtatcaagacgccctgggcgcttgccgatcccgagaactggcgccgtacgcagcgttttggcggtgcctgctttatggtgctgggcgttggcctgattgtgatgggcgtggcgggtagcgtgctttcgagtgaagtcgtcgccgcggtgattgcggttctggcgtttggttcagctggagctgcctacgtctattcgtatctgctgtggcgcaaatcgcagcgagccgctcgttaaggttgcggaaaactagcgtacgcagttcatagtatgttccgggggattattcccaggtagtattagggggtgtgggcaaccatgcccctttttcgtttagtttcagagctggtttcctcatttcgtttccactaaagcgaatcaagaatagggaaacagaaggtagaaaggataaaacaggcaaatggcggagtttatctaccagatgtatcaggctcgtaaggcccatggcgacaaggtaatccttgacgacgtgaccctgagcttctaccccggtgccaagatcggcgtcgtgggccccaacggcatgggtaagtcgaccctgctcaagatcatggccggtatcgaggaagtctccaacggcgatgccaggcttacccccggctacaccgtgggcatcctgcagcaggagccgccgctcgatgacgacaagaccgtcatcgagaacgtgcgcatggcgtttggcgatatgattgccaaggtcgatcgcttcaacaagatcggcgaggagatgtgcgacccggattgcgatatggacgccctcatggccgagatgggcaagctccaggacgagatcgacgccgccgacggctgggatatcgattccaagctcggtcaggccatggacgccctgcagctgcccgattccgacatgccggtcaacgtgctttccggcggcgagcgccgtcgcgtggccctgtgcaagctgctgctcgaggctcccgacctgctgctgctcgacgagcccacgaaccacctggacgccgaatcgatcctgtggctcgagcacttcctgcacaactatcagggcgcggtgcttgccgtcacgcatgatcgctacttcctggataacgttgccgagtggatctgcgaggtcgaccgcggccacctttatccctacaagggcaactactccacgtatctggagaccaaggccgcccgtatcgaggctcagggcaaccgcgacgccaagctcgccaagcgcatggaggccgagctcgagtgggtacgcagctcgcccaaggctcgccaggccaagaacaaggcccgtctggctcgctacgaggagatggaggccgaggcccgcgccagccagaaactcgactggaccgacatccgcatccctgtgggcccgcgtctgggcaacaaggtgctcgaggcccatcatctgcacaaggagttcgatggccgcgtgctcatcgatgacctttcgttcaccctgccgcgcaacggcatcgtgggcgttatcggccccaacggtgtcggtaagaccacgctgttcaagacgattgtgggcctggagccgctgacttcgggcgagctcgaggtgggcgagaccgtcaagatttcttacgtcgaccagaaccgttccggcatcgaccccgataagaacctgtgggaggtcgtctcggacggcctggaccacatgatggtcggcgagaccgaggttccgagccgcgcgtacgtggcgagctttggctttaagggccaggaccagcagaagcgcgctggcgtgctctccggtggcgagcgcaaccgtctgaacttggcgcttacgctcaagcagggcggcaacctgctgctcctcgacgagcccacgaacgacctcgacgtcgagacgctgtcctcgctcgaggcggcgctgctcgagttcccgggctgctcggtggtcattagccacgaccgtatgttcttggaccgcgtcgccacgcacatcctggcgtgggaaggcaccgacgagaacccgggcaactggtattggtttgagggcaactttgaggcctatcaggccaaccgtatcgagcgcctgggcgaggacgcagcccagccgcatcgtatccacaggaaacttaccagggactagtttgatgtggcaaagggacagcccctttgtcacacgaacttatgctcaacctgggaaaataaaaaaatgcggcgaacgtttttgtgacgttcgccgcattttgctattcgttggattcttcaaccttgtcgacggtccaggtggctccgaggcctccggtggtgttgcggcggatgcgcacggtgacttcgtggcgctcgccggcctgcgtgtagcgcagggggaagattgcgcggtttcgcgcggcctcgatggtgccgcgttcgcgggcgatccagtagtactcgccgacgatgccgagcgtgtcggcgccgtaggggagataggtcgacagctggtgtagcaacgggccggggcagaagacctcggttgcgaaatcgacggggaagtcctcggggatggtcggtgctgtgggtgcgggggccggtgctgctgcgggtaccgaagccggtaccggtgcgggaatttggtcatagacaggtgcggatgcggactcgatgacgggtgcagactcgggcgccggttctggcttaactgcggaatctgtcggttccacggagacggatgtgtcttcagtctcggttttggcgtcggcttgcggggcgtcctctgcctcgacagacggctttgcctcgatcggtgtggaggccatggtggtgatgccggcgttggcgttctcggggtcatagacgaccgtgagcgagatggcgggcagcggcgtctcgggctccggtgccgattcggtagcgccttgatcggcgggctcgtcggactgatcgtcctcggcctcgttgccaaagacatcgctgttttggaacgcaggcgtctcgggttggttggcggcttcttcggttgtcgacttgggggtctcgttgagctccgcagcggcttcctgctttgacatggctttgggatcggtcgtggcggcgatttcggtttcggcttctgctgctacctcaatagcgacttcgatctctgtctcgggctcgggctcgggctccggagcgacttcggccacggactcgggctcgggaagcttaacgtgcttgggacgcacggccttcaggtccttctcgccgcgctttttctttttgtaggactgcttggcgcccttggtggccttgggcttgtcctcgcccttggcaagtgcggcatcccatgcctcgttggcgatgaccgtggcatacaggcgaccgcccttaaagacagtcagcttaatgcagtcgtcgagttcctcgagcaactcgcgcgtggactcgaagcccaggtcataagcggccatgtcgccggcggcgagcgcctcctcgacctgcgtcataaacgtttgcttaccgcacccaatcgcgtcgcgcagcaggcgatacagatagatgtggttgcccagcgatagcgtgggcttaactattgtcttgctcatggcaaatctcctctttacacaccaaagcatcttaccatcgcacagggcttgccatctcgtcgcccaaggcaaacgggcgcgaaccgctatcgattcgcgcccgttgtacaggtcggttatctatgagaggcaaatgtgcctagttgcccgatgtcgtgccttggcttgaactgtcagatgtcgtgcccgatgtggtgccactcgaattgctgttgctgctgtttgctgtgcccgttcccgacgtggtgtcgctcgtctggtcgcccgtgctcggttgagagccgtcagtcgtttggcttgagtcggtcgtgccggacggcgagctactgttggccgtagaggaatcggtgccctgcgattggttttgggtgttcgaggacgaattggcagaggcagagctgtcttgcgtgtcgtccgtctgtgcctgctgatcctgcgactgggtgttgccatttgcatcgctctcggtcgtgcgcgacgacaggattggctcgggacgctcgcccagaccctcaccggcagtggtgataaggatggcaccggcgcaggcgatgaccgcgacgatggcgatggcgatcgagaagatgatgaccttcttttgcgtctggctgcgctctgccgccgccttggcgcgcaggctgttgggggcgacgcgcgccgtggtcgcgcgccccgcaatctggcgcatctcctgcgtggtcgcggcgccacccaggcgctcctcgacattgggctcaacgggctcgtagacgccggcagggtagtcgacagcggcatgcgtgcccttgattgcttcggcgctggcggagataaagtggcgatagacctgcgaggacacaacagtgatgactgagctcacagcggcaccaatcaccgagccggcaatgccgatctttgaagcaagcgcgacgctcgtggcggcagctgcggcgccggcgatgatttggggaatggaaatgtcgtcgaacaggccctttttgggcgcgatggccatggtttgtccgatggaatggttctcgtgcacgccgttgttgagcgcggccggtgtcatgacgcgcgtgcgcggcgcgtcggtgtacttggttgtcatacggggtcctcccggtgtaaatctgcttcgtttcgtttagccatcagggtacccaccagatgtgaatcgtacatgacatttaacagataccatcaactcatcaatagctcaccaagttggtgggatgcggttacacccggcggttgaactacaatagggcttgctaattgttgtgaatggcgtctacgcacgggagcattcttatgaatcttcacctttctcagtctgatggctttttgcgtgtggcggcggcgtcgccgcagattcgcgttgccgatgtcgagggcaatgccgaggttgcgctggcggctgttcgcgatgctgccgagcgcggcgttcgtgcgttggtattgcccgagcttaatctgactggctataccgcagccgatctgttccataaccgtacattgctgcatgcctgcgaggctgctctggtgcatatcctcgatgaaacccgcgagctgccgattgtctttaccgtcggccttcccgttgcggtggccgaaaacatctacaactgcgcggccgtgtgctgtgcgggcgagcttttgggccttacggctaagaagtatctgcccaactatggcgagttctacgagcgccgctggtttgccccggcgcctgccgatcccgtgtgggttgaatttgccggtcagggtccggtgccgcttggctcggggcttgtctaccgctgctgtgatgagggcgccgaggacctggtgctgggcgttgaggtctgtgaggacctgtgggtgccggcgcccccttcgaccgagatggcgcttgccggtgcgacggtgattctcaacccgtcggcctcggacgagattatcggtaaggcagattaccgccgcagccttatctctaaccaaagcgcgcgcctgtactgcgcctatgcctacgcggacgcgagtgagggcgagtccacgactgacatggtctttgcgggggagaacctcgtctacgaaaacggctccaagctcgccgcgaccaaactgcttacctgcgatacggccgtcgccgacgttgaccttgaccgcctggttgccgagcgccgtcgctcgacgacgtggacccgcgcggacgatgcgccggaggccacgaccgttgagttctcttttgagggcacgctctccgaggctcccgtcctgcgcaacgcctgcggcatcgaccgtgtcttcccccgcgcgccctttgtgccggccgaccacggtgatctggccgagcgctgcgagaccattctcgacctgcagaccgccggcctcaagacccgcctggcccatacaggcaccaaggctgcagccatcggtctttcgggcggcctggactccacgctggcactgcttgtgaccgtgcgcgccttcgatgcactggggctgccgcgcaccggtatcacggccgtgtccatgcccggctttggcacgacgcatcgcaccaagtcgaatgccgagtcgctcgctcgcgaccttggcgtgagcttccgcgaggtttcgatccacgcggccgtggagcagcacttcaaggacattgagcacgatccggccgtgcaggacgtgacctacgagaacagccaggcccgcgagcgcacgcagattctgatggatctggccaaccaggctggcggttttgtcatcggcacgggcgacctgtcggagctggcgctcggttgggctacctataacggcgaccacatgagcatgtacgccgtcaacgcgagcgtgcccaagacgcttgtgcgccatctggtgcgctatgcggccgatgtctttggcgggcatattgccgaggtcttgctcgacatcctcgacacgccggtgtcgcccgagcttctgccgccgacgggcgatggcgagatcgctcagaaaaccgaggatctggtgggcccgtacgagctgcacgactatttcctctattacctgctgcgctttggctttgagccgggcaagatctaccgcatggcgcttaagagctttgagggcgtctacgacgagaccaccatccacacgtggctgcgcacgttctatcgtcgcttcttcgctcagcagtttaagcgcagctgtctacccgacggtcccaaggtgggctcggtcacgctcagcccgcgcggcgattggcgcatgccgagcgatgccagctcgcgtctgtggctcgcgcagattgacgcgctgcgcccagtcgactagcaccgcgctccgattggctcaggttggctaaattgaaccaaaacaggggatgcaagcgttacacttttgcaatctgatggcccgtgtcgcgcggcgctcttgtcggagcgccgcgtttttgtatcgaaaggtggcaccatgcaggcatcgcagcgtctcgaccgctttggcgcggaggtcttcgcctcgctcaacaacaagcttcttgcgcttaaggcccagggcaagaccatttacaacatgagcgtgggcacgcccgactttaagccatacgatcacgtggtcgaggcgttgacccaggctgcgcaggatccggagatgtggaagtatgctttgcgcgatctgcccgagctcaagcaggctgtgtgcgattattacgagcgccgttttggggtttcgggcattacgccgtccatggtgcagtcgtgcaacggcacgcaggagggcgtgggccacttgggcctggcgctgctcgacccgggcgacaccatcctggtgcccgatccgtgctacccggtctttgaggcaggcgccaagatcgccgacgccaagctcgagtactacccgctggtcgccgagcacaactacctgccctatgtggcaggcatcgaccccgaggtcgccgaccgcgccaagtacatgatcgtgtcgctgcccgccaacccggtgggctcggtgggcatgcccgaggtctacgaggagatcatcgccttcgcccgcgagcacgacctgttgatcgtccacgacaacgcctactcggacatcgtgttcgacggcgagccgggcggcagcttcctgcagtatcctggcgcgctcgaggtgggcgtggagttcttctcgctctccaagtcgtttaacgtcaccggcgcccgcatcggctttttggtcggtcgcgaggacgtggtatcggccttcgccaagctgcgcagccagatcgactttggcatgttcttcccgatccagaaggctgccatcgcctgcctcaacggcccgcgcgatgaggtcgaggcgcagcgcctgaagtaccaggagcgccgcgatgccctgtgcgacggtcttgaggatctgggctgggagcgccccaacgcgcatggttccatgttcgtgtgggccaagctccccggtggtcgtaccgactcgatggcgttttgcgaggagctcatggagaaggcgggtgtcgtcgtgacgccgggcgcgagctttggcccttcgggcgaggggcacgtgcgcatggcgctggtgcttccgcccgatcagatcgctctggctgtcgaggctattcgcgaagcgggtctgtattagggattcgtttccatgagtcaatagctcgaaaccgatttcgtgcagttattatacgaattctgcaaacaatttcggtaaacggtcgatatttggctgtaataggagcataatcaaagtcccgattggatgtattgggattacggcaagccgctcgggacgccctgggcggtttgtttgtggagagagatgggagtttgtaatggttaacgagaagaaggtcgctattgtcggctgcggtttcgtcggttcgtcttcggcgttcgcactgatgcagagcggtctgttctccgagatggtcctcatcgacgtggacaagaaccgcgccgagggcgaggccctggacatcgcgcacggcatgacgtttgccgagccgatgaagatctacgccggcgattattccgatgtcgccgatgccgctatgatcgtcgtcaccgctggtgctgctcagaagcccggtgagacccgcctggacctggtcaacaagaacgtcaacatctttaagtccatcatccccgagattaagaagtccggctttgacggcatcctgctgatcgtctccaacccggttgacgttctgacctatgccgccatcaagatgtccggcctgcccgagggccacgttatcggttccggcaccgtgctcgacactggtcgtctgcagcagatgctcggcgcacacgtcgaggtcgacccgcgcgacgtccaggcttacgtcatgggtgagcacggcgactccgagttcgtcgcctggtccagcgctcaggttgccggcgtgccgctgagcaccttctgcgagcttcacggccatctggagcacgaggctgccgagaagcgtatcgccgaggacgtcaagaactccgcttacaccatcatcgagaagaagcacgcaacctactatggcgttgccatggccgttaagcgtatctgcaccgctgttatgcgtgacgagcagaccgttctgcccgtttcctcgctcatggtgggcgagtatggcctgtccgatctggccatctccatgccgaccgtcgtcggtcgcgacggcgtcgtctgccgcgtccctgtgccgctgaacgagtccgagcagagcgagctcaccgcttctgccaaggccctcaaggacatcatcgacagcgtcgatttctcctgctaaatccggctcgtttgccagcaagctacaatgaaggcgtccaggccccacggcccgggcgcctttttggtgcaagggggtcaggtttgtttgcaccaaatggggcgcgattggtgcaaacaaacctgaccccaatgcaccattgttgatgggagaggcatgtcggattcgcctaactttttgagttatgcccagacggcgttcgattcgtttgaggagcggccgttttgcgcggtggacagcctggtgtttgcatggctgtcgtatttgcgcttgccgggggatatgccggagcttgccggctggcagggactggacgtgcgtgagctactgcgcgccgagtgctaccgggacatgattggcgacctgtgggatccggaggagagccgcgccttgttggaggctgttgcggcaagtccgcgctaccgcggcgtgcgcgtgtgcggatatcgtgccgtgagcgacgtggcaacgacggagcagtttgcggccatgacgttccgattcccggcaggattttcctatcttgccttccgggggaccgacagcacgatcgtgggctggaaagaggactttaacatggctttccggtgtcctgtgccggcccaggaatctgcggcgcgctatgtggacgaggcggtggccgcgattgatggtccgctcttgtgcggaggccattccaagggcggaaacttggcggtgtatggcgcggcgatgtgctctgacgctgctggcgaccggatcgaacgggccttctcccacgatggccccggctttgtcgaggagttcctgagcggtgacgccttcgcaggtctttccggccgcatcgacaagaccctgccccagtcttcgattttcggcatgatgttcgagacgcaggaagattacgccattgtcgagagcaccgaattcagtctgctgcagcacaatccctttagctgggtcgttgacggctacgactttgtgtattgcgagcgtctgtctgccggcgctcgatacgtcgatagctctattcgcgagatgctgcttgcagtggggcctgccgagcgcgagcgctttgtagatgcgttgttctccgtgtttgaagccacaggggccgaacggttcgcagatatcgcagggaatttgcgcgagagcctgccggtgatgctccaggctgctcagagcttcgacaaagatacgcgccgtttcatctcgcagaccgtcgtcgcaattcttaaatgcgccctgctgcccaagcgttccgagctcaacgttcctgctgccggcaagagcctggcagagcagctcgaggcgtggcagtccgagctcctgcgctaacgctggtgcaaaggggcatgttggtgcattggggcgggcacgaccgctatactgattcgtgctgaaatcgatctagaacggaatgccgtatatgaaaatcaatcacgcgatcttgcatatcctggactttgactcggccgtcaacgtcatgagccagcgcgagctcgatatcgagagccgtaccgtgcgcaactttgtgaccacgcatctgcgccgtgcccgcacttcggccgacaataagcgcgccacgtttgccgaaaactccgcattcggcggcgagctcaagggctatttctttggcgagcgcgagttcgtggacctgtcgcagcagattgcggagttcatctcctccgagctcaccaaggccgaaaaggccgagtccaccgatgtgctcgtggcggactttgacgatgacgaggatgctcgctggtttgccgtcatgctgttgggctccaagcaggcctttatgcacgaggtaggccgcgaggagggcgaggtgcgcaacgacatcgcgcgccactatgctattctgccgaatccttcccaaaaggtgccgagctacgccatcgtgcgcgcgagcactatggagatcggctatgtggacaagaagcgcaagatcgccggcgaggaccgtatgcttattcccgacgggctgctgcagtgcgatacgggcgtgtcgggcaaggagattatcgacaccgtgacgcgtgtggtcgaggaggtcgccgaggagcacggcgcgaacacggctgtggcgctcgccaaggtcaaagccgctgttgccgagaaggtcgaagacgatgaggaactgccgccttgggatatcgtcgacgaggtctttgaggacgaaccggtcatcaaggagagcgtgcgtgcggcgctgaccgaagagaaggtgcctgagcgtgtgcccgtggagcgtaagcaggttgaacgcgcggccgtgcgcaatcacaagattcgtaccgatacgggcatcgagatcagcttcccggccgaaatgggctcgaactccgagtacatcgagttcgttaacgagcccaacggcctcatctccatcgagctcaagaacatcggaagtattgagaatcgatagggcaatagtttcttccgaagagaaatctggattatattttgaagtatactttgaaatataatccagattattttttggaggtacaaatgtccccacttgttctggaaaagccggtgtttacaaaagatcaggtagtttctgctaccgaagcgagcaagtccttatctgccgttcgcaagcgtgctaagcgcgcgccgcagtttatcgccgatcataacgacatcgatactgtgattatcgactacgccgcctatgaggaaatgtacggcgccctacagtaccttcgcgaacttgagattgatcgcattgcggcggatcgaatcaaaaacggaccacatgagtttattccgtttgaagatgctttaaccccggaggaatccttgccaaagcaactcaccatggttgaatacgacggaaccctgagataaagaaaggccgaagtcccggattgggcttcggccttcttgcttgggattgaattgcgctgcagactgacacgtctctacagctggcgcaggtcttcttccaggcccgtcttgctgtcggttttttcgtcgcgcatcttgatgacgcgggcggggacgccggccacgacggcgccggcggggacgtcctcgacgcatacggcgccggcagccacaacggcgcccttgcccacacgcacgccctccaggaccacggcgttggcgccaatcatgacatcgtcctcgatgatgacgggcgtggcgctcgcgggctcaacgacgcccgcaagcacggtgccggcgccgatgtggcagttcttgcccacggtggcgcggccgcccagcacggcgcccatatcgatcatggaaccctcgccgataacggagccgatgttgatgatggcgcccatcatgatgacggcgcggtcgccgatctcgacgcggtcgcggataatcgcgccaggctcgatgcgggcgttgatgcccttaaggtcgagcatggggacggcggaattgcggcaatcgttctcgacgtcgtagtagtcgatggaatcggcattggcgtcgaggatggccttgagctcgtcccagtcgccaaagacggtcttgccgcggcggccgccgtagacgtgtgcgtcgccccactggaccttcatgccgggcttctcgcggacatatagcttgacgggcgtcttcttgggcgcggtggcgatgtaattgataatctcctgtgcatccatctcggctgcgttgctcatatactgtttctcctttacgtgggcttggttaatgattggttaggcaaacatgacctggtcgaaggtgtagaagccggggtcgcggacgacgagcttctgggcggccgccagggcgccgttgacgaagatttgtcggctcgtggcgcggtgcgtgagtgtgacctcttcgtcctggccaaagaaaccaacctcgtgcacgccggcgacggtaccgccgcgcagcgagtgcatgccgatttccttggggtcacgcgcgccacacatgccctcgcgaccgtagacggggtgatagccagcctcgggctcggcctcgacaacggcgtcaagcagcagcttggcggtgccgctgggggcgtcgaccttttggttgtggtgtgtctcgacgatctcacagtcaaagccgggcagctcgcgtgtggcctgggccaccaggtgacgcagggcggcgatgccgatggagtagttgcccgagtgcatgacgcgggcgttctggcccagctcgcgcaggcggtccatctgctcgggcgtatatcccgtggtgccggaaacgagtgcggcgcccgtgcgctcgacataggtgacaacggcgtcaaaggtcacgacgttcgagaagtcgatgatcacatcggccgccggggcgctctcgagctcggtcagatcaaagccgatctgggcgacgatatcaaagacgggctgaccggcggcatcgacaatgccctccgcggtggtgcggatgagcgagcccatgcggcccgttcccataatgacggtcttaatcaagcagaccagctcccttcagagcatcggtgagtgtggcacgtgtatcgtcggccatggggcacagcggcatgcgatagtttgcctcgatcatacccatctgggcgagcgcttccttaacggggatggggttgacttcgctaaagagggcgttgatgagcggctgaccggcaatctggatctcgcgggcgcgctccacgtcaccgtccaggtaggcgcggcacatgtcgtgtacgagctgcggctgcacgtcggcccacacgctgatggtgcccgaggcgcccaggctcatgagcggcacggtaagcgcgtcttcgcccgaatacatacggaagtcgtcggacagcaggtgcgcgatcttggcggcataggcgacattccccgaggcctccttgatgcccatgatgttgggatgtgctgccaggcgctcgacattgcgctcgctgataccgcagccgcaacggccggggatattgtacaggatgcaggggatgtccacggcatctgccacagttttaaagtgctggtagatgccctcctcgttggacttgttgtagtagggggtgatgagcagcagaccgtcggcgcccaggccctggtaggtgagcgacttggtgagcatcgtctgcgtggagttggagcccgagccggcgatgacggggatgcggcctgcgacctgcttgaccacggcggcaacgacggagttgtcctcgtcatcggtcatcgtggcgctctcgccggtggtgcccaaggtgaggatggcgtcggtgccattctgcaggtggaaatcgaccaggcgttcaagagcatcaaagtcgacgctgccgtccttcttaaacggggtgacgagggcgacgattgagccctcgaggttacggacatccatattcttctccttcgcttccgcgatctggatgcgtttattccattgggcggcgacggccaggcgctcgccctgggcgcgacggcgggcgctttcggcgcgtgacttggccagcagctcgcggccgcacggaaggacgtcgagcgtggcaaagtagtcgcccgggcgctcagcgcgtcgaatgaggtcggcggatccgtcggggcgcagcaatacctcggcagaacgcaggcgtccattgtagttatagcccatggagtagccgtgcgcgccggtatcgtggatcacgagcaagtcgcccatatcgatctgcggcagctcgcggtcgatggagaacttgtcgttgttctcgcacaggttgcccgtgatatcgtacgtgttcgtgacgggggctgcggtcttgtcggcgccacccggctggcccatcaccgtgatgtggtggtaagcgccatacatggcgggacgaatcaggtcgacggcacttgcgtccacgccgatatagtccttgtagatctgcttttcgtggatggccttggtgaccaggcatccgtaggggcccatcataaagcggcccatctcggtgcagatcgccacatcgcccatgccggcgggaaccagaatctcgtcgtaggctgcgtgcacgccctcgccgatggcgtggatgtcgttggcctgctgctcgggcagataggggatgcccacgccaccggacaggttaatgaaggcgacatgagcgcccgtctcgcgctccaagcgcacggcaagctcaaagaggatgcgtgcgagcttggggtagtagtcgttagtgacggtgttgctggcaaggaaggcgtggatgccaaaattctcggcgcccttggccttgagtacgcggaaggcttcgaagagctgctcggtggtcatgccgtacttggagtcgccggggttgtccataatgccattggaaagctggaacagaccgcccgggttaaagcggcagctgaccgtcttgggaatggggcccgcgacgcgctcgtagaactcgatgtggctgatgtcgtcgaagttgacgatggcgcccaacttgtcggcaagctcaaagtcggccgctggcgtatcgttggacgagaacatgatgtcgtgtcccgtgatgcccagtgagcgggcgatcatgagctcggtatagctcgagcaatcgcagccgcagccgtattcgttgagaatggagataagtgctgggttggggttggccttgacggcaaagtactccttaaaccccgggttccatgcaaaggcgtcgcgcacctcttgcatgttgcggcggatgcccgcctcgtcgtatagatgaaacggcgtggggaactgctcgacgatgtgctctagcgtctccttgtccacaaacggctgctttgccgcatatgcctcgttgggggtcaatgccatgtcccgtaaacctcgctatccagacggcgccatcggcgcatcgaatccgcatagcgtggacccaatgtccggatagcgctcccgcattgctgcagacagtcctgcgggtgtttcccgcaggcccaccaggtcgttcgtgcccgaaaaacccagttcggcgggtttcgcctccccgcagggtcaaagtctgccgactcgcccgcggctcttcgtgcccgcgcctctatcaagtggtaaagaccctaccacgttgcactttaccaaacaagagtattcgtatataacgtttaaaaaatgcagggatatgctggaaataagggtgcgacaatcttgcggcacaataaataacaaccgacgtgcacctatgaaaggaacctttatgaccgagctccaagaactccgtcgttatcgtcgcgacttgcatcgcattccggagctcgacttcgatcttccgcaaactatcgcctatatcgagggtgtgctcgattcgcttgcctgcgaggtgacccatccgtgtccgagctgcgtctgcgccttcttcgatgccggtgtaggcgctgcgcacgccacggcgattcgtgccgacatggacgccctgcccatcgcggaggcaacgggtgtggatttcgcctcgacgcatcccgcccagatgcacgcttgcggccacgacggccacatggccatggcgctcgcggcagcaacttatgtcgatcgtacgattcgtgagcagccgggcgccatcgggcgcaacgtgctctttgtgtttcagcctgccgaggagacgaccggtggcgctaagacggtatgcgagagcggcgtgttcgagcgttacggggccgatcacatcttcggcttccatgtgtggcccgatttgcctgccggcacgttggcgagctgctccggtccgctgctggcgcgctcgagcgagacgcacattcatatccatggcgcgagcatccatatcgccaagaccttcggcgttccggtcgaggagtcgcacgatgccgcgctggcggcggccaagttctttgttgccgaacgcgagctgatggacgagctgggtgccgacgagccctgcatcggcaagttcggtctgctccaggccggcaccgtctgcaatgcggtggcgggggaggcccatgtcgccggcagcttgcgcgtgtttacggacgacatgttcgaccgtgcgcgcgagggtgtgcgccgcgtgctggacgaggcctgcgccgcaacgggttgcacgtacgatctcgactttgccgagggctacccgccagtcgataacgaccccgagctgtttgccggcgtcgcgccggccctgcccgagctgcagcttgtgaacgagccactgctcattgccgaggatttcgcgttctaccagcgccatctgccgggcgtgttcttcttattgggcacgggcgtgccggagggccaagacaatccgagtgacgccgagggttgtcccgcctatgccaccagcgccctgcataccgacaccatgctctttgacgaggaaatcctgctcaaagggctcgatgtctacaaacgattgctttcgcttagctaattcttagaggagcgtcctctctggaaacacgaacaaatgtacgatataatagagatgtaagtctatagaaacgtttgacgttattaacgtaaggcgatactatgattgcatcctataaagatgaagataccgaacgctttgccatgggtacgcgggtcaggaagttcattccttttgagcgggtcgcattgaggaagatccgccaactgcaggtctgcgcttcgcttgatgatcttcgcattccgccaggcaaccgccttgaagcattgaagggcgatcgcgccggtcaatacagtattcgcgttaacgaacgctatcgggtctgctttgagtggagacaggggatggcttggaatgtcgaaatcgtcgattatcacaaatgaggaggctgtggccgatttgctgtcaccggtgactcctggcgagcttctcaaagaggaatttcttgttcctatgggtatttctcaatatcgtcttgcgaaagagaccgggattccggctcagcgtatcgggcagattgtcttgggaagacgtcgtgtgacggctgacaccgatcttcgtctttgccgctactttggcctgacggatggttattggctgcgcgcgcagatggcgtttgatctggaggccgagaaaaggcggattaaacctgagctcgacaagattgttcctgtccagcaggccatcgcattgtagagcccaaagacgctgagaatggagtggcgatgaggcgacgtcggcaatctgccgtatatagtccgggtggttgcgggtgtggtttgctactgctcccggttgttgtgctgagtattggcatgatgtttgcgcttgccggtttggctgcagcggcgctcgtgttgctgattgtcgccattggcgtaacgatctggctctatcaccgtcgcgaacaacgccgcgccgacggcaagaccaatgtgggatggattgtctttttggttatcgcctatctgctgagcatcagttacctggcgttctttgtcctgttgatgatcagcgcctttaccggggaatctgtcacagtgggctgatcctgcctgctgacggtcgcgtaaagggcgtttgttcggggcttggacaactacattggccgtttaccgctgccttagctctgagctaatgaatttaagttcaatccttcctacgatgggctgtgtgccggcacggtagccggatcgtaggaaggatgcataatggcaaaagagggaaagaaaccgattggtaagatcgtcctgggcatcatcgtggtgctggctatcgtcggtgccgtaggctctatgggaggaaactcctccaactcctctgcgggcgatacggcaaaaccggccgaggctacgcaacaggccgaagagcaacaagagccgcaggagccttatacgattgccgatgaggtcgaggatacgtccaatcagtttgcctataagatcacgggtacgctgaccaataacacggacaaggaaaagagctacattcagattgagtacgtcctgtatgatgccgatggcaatcaggtcggaactgcttttgcgaacaccaatcatctgaaggccggcggtacttggaagtttgaggcgacgggaactgcgtcgcccgaccaggtcgctagctgggagcgttcggacgtgagcggtttttagcatgttgcatatgctgggggaggtgaggccgtatgcccgataaaaagttgacggaggagctgctcaatgagttgctcgatgcgccgagcatcgatggctatatcaaggaacacgactttgctgccccttcgctttcggactacctcaagcagttgctgcaagagaagggtttggagcgctctcgcgtggtgcgtatggccgacctcaacgagacgtttggctatcagatctttaccggtgcgcgccatccaagtcgcaataaggtgctgcagattgcctttgctatggcgttgtcgatgaaggagaccaaccgcgcactgacggctgccggagtgagcgtcctcaactgcaaagaccgccgcgacgcgattatcattttttgcatcgatcgcgggtgtagtctccaaaaggtcaacgaagagctgtatcgctttggcgaggaaacggtgagttagcggctgacggctgagccggcggtactgctacggcaacgatgtaaacgaacagggcgcggatgccatgaggtgtctgcgccctgcgctatgatggacgctatggatactcaagacccaacatattccgacgacgaactgaccgccgcgcttgccgagcacctggcatcgctcgatcgcgacgacagctatcgcgtggatcgcgtacttaagcgctctggcgtcgaagcgaccgagctcgtgtactttgaaggctccagcggtgggtcgcttggccccttcgtccgtaagcgcattgacgcatcggcccagattggcggggcgtatgagcgcctgtttgaggcccagcgtgccgggcgccgttttgaacactttcctcggatcgtcgattgtcgccgtgcgggcgatgaactcgacgtagtgatggagtatgtcgagggcgagacgctcgaggccttagtggggcgcttgggcgcgacgcccgattatgcgcatgggttatttcctgctctctgcgatgcggtgggagagctccatgctggttttgcgacagcgggggagccggcggtgccggtgattcaccgcgaccttaaaccttcgaacatcatcgtgtcgggcgtgcggtatgcacccaatgccggtatgagcttttcgtcgctggtgattatcgatttggggatcgcgcgcgtatggcgcgacggtgccgatgccgacaccgttaagtttggcacgcggccctatgcgccgcccgagcaatatgggtttgggcagacgagcgtgcgcagtgatgtgtatgcacttggcgctcttctcttcttttgcctgacgggggctgatcctaagccgggacgtgacatgcgcgagcagtgcgagacgggcgctatccccgttccgttggccgatgccatctgcatggcgatggcgctcgatccggccaagcgctttgccaatgcgaaggcgctgggacatgctgtgtgcgcggcatttgagctgtgccgtcccgcgttttcggtaccgggcgcaatgccacccgtggcggcacaagccgcatcgactgcctcgccatcgccatcgccttccacgcaacagcctcagaacatcttatcgccggcgcccgcccgtcaaagcctgctttctcgcgttccggagcctttggggcgcgcttggaacatacttatctgcctctcgcttctcgtcttttttgccgggagccatttcgctgtctttcatccaacgggcgccaaccaaaactacccgacgtggttccttgcggttgagtacttcttttttgtcgacggtctcacggtgcttttccacttcgccgtgctcgacaagcgccgacttcgccggcgattcgcgctgctcgacagctatcgcggcaagaaactcgcgaaactctggctcaaggcgctgggcgtgctgcttatatgcatgatcgtcatagttgcggttgccaatgcgaccggtgtcgttgacacctctgccagctaaaagaaaagggccccgtttggggccctttgcagttgcgcttagatgcggttcatctgagcggcgaccttgttgtaccagtcctgccacgtgggcgggcagtactttttggccgctgccggggtaagggtggagccgtagttggcgcccaggtaggcaacatgagcggagatgccctcgctccagctgccaaagctgcgccaaccgccgccacgagcgctccagccccaggcgttgtaggaattggcgcaataagtgcccttggtgctctcgatgcaggcgatggcgggggaccaacgggggtcgacgccggtattccaagcggcgacggcaaagttgtagccctggcctgccatgggggagccggcaagataattatcgatgcggctcgtccactcgttgatgaacgaatcgtaatcggagttaccggtattggcgttgttcaccgtggtatcgatggtggtgttggtgttggtggcctggctgctggaattgctgccgctaacgccctcgcctgagagcttctcggcggcagcggccttgtcggcctcaagcttggcaagctcggcggcattttcctgctcggcttttgcctgcgcctcgctgcggagctgctgggcctgtgccagcgcatcctcggcgtttttctgctctgcctcaagctgggacttggcctgctgaagctcggccttgttctgctcgagttcggtttgcatgttgttgagctcttcgatctcgtcgacgctcgagctcgtgatctggttggtgtatttgcaggtggtgatgaactcacccaggctctgcgcgttgaccaggaagctcacgatgggattggtgcccttctggtacttgtacagatcgcgcatagcggagcttgccttggcctgctgctcgggaagcttggcctcgatttcctcgatgcttgcctcattggagtcgatctgcttttgcaggtcgtcgagtttggcgcgggcatcgttgtaggcgctcgtggcggcttcaattttttgctgcgcggcggaaagctgatcctgcgttgcctgcgaggcggcatacgccgcaacgggggagagcatcggcgtggcagtcagtgcgacagcgagtgccgcgctcgtgatgatacgagccggcttcgacgcgatgagcgctgcgacgcgatgattcgaatgctgcatccaatccctctgcaatcaatcgtaggttatggttcgaacggtattctactactgctttcgacctcaacttgaaccttaaaggttccaaagggtcaagttgaacttgaggctttggctttgacctgcagttatagtgaattgttgagaaaccatagagttcaactttaacgttacggaactcggtctgatcgcagattcacgccttaagggctactccaacatggggttttgcacctatagggctccctcgcggcgtgcctgctcaatttcttcgagcgcctcggctggggtgaaggaacacgtgccgtcgccgagcttgactgtttggatatcgtctccgacatgcacctctccgcctcgaagcaccacaccgaaaatgccctcgtggggaaagatgcaatcaccggcgagatagtagatggcgcagcgggtgtggcagaccttgccgatctggctgatctcgaccagaacgtcgttgccgatcttgagctgtgtgcccaaggggagcgaaagcaggttgatgccttgtgtggtgaagttctccccaaagtcgcctttgtgtacatcgagcccgcgatgctgcgccgtccggattgattctgcggccaaaaacgagacttggcggtgccagtgcccggcgtgcgcatcggaagcgaggccaaactgctcaatgacggtatcgtgcccatcggcgacgggagacttgcgtgtgcctttgtgcgccgacgtgttaatcgagacgatgcgggcgggtccttcgtaggcgttgctggcggtgcgtaggggagcggttgtctgtgagcgttccgctagcacgcgttttgcggcgtcaaggatggggttgtcggctagatgttcttggggcacgcgtgcgcctttcgcttatgggattgacaatatgttgaatcctacaacaacggtaggttcattgcccgttgtcgtacagcggtgagcgctgtctttgcgccgagtttgctcctccgattgccatagatacggtggagctttgggtactggcggtttggcacgctagaatgaaccggttgcactaagaccgtccgttgtgcgggcagttcacgataggaagtttccatggcattgcagtttacagagcgcgagttcattcccgtgctgctcggtggcgacatcaacgcctattcggtggcgcgcgccttctacgaagagtatcaggtcaagagtctggtctttggcaagtaccagacgggccctgcgtatcgcagccagattatcgactacacgcccaacgtcgacatcgataccatgcccgtgatgctcaagaccgtcaacggtatcgctcaggcgcatgccgataagacgatcgtcctgatgggctgcggcgataactatgtcgccttggtggctcaggcaaaggatgccgatgagctggcggataacatcgtcgctccctacgcgccctacagcatgctcgagcagtgccagaagaaggagatcttctacgagctgtgcgagaagcatggtgtgccgtatccgcacacctttaccttcactgcgcagatgctcaacgcgcaaggcgaggcgccggccgaagtgctcgaccagatcgactttccgttcccgatgatcctgaagccgtccgacggcatcatgtggtggcagcatgagttcgagggccagaagaaggcttatgagattgccgatcgcgccgagctggagcaggttatccgtgactcctatgccagcggctataccgacgacctgatcttgcaggatcgcgtgcccggcaacgacgagtacatgcgcgtgctcaccagctattccgatcgcaacggtaaagtgcgcatgatgtgcctgggccacgtgctgctcgaggagcatcagccccatggcgttggcaaccatgcctgtatcattaccgagcccaatgacgagcttatgggcggcgtgcgcaaactgctcgaggaccttcactttgtgggctattccaactttgacgtcaagtatgacgaacgcgatggctcgtttaagttcttcgacttcaacacccgccagggccgcagcaactactatgtcaccaacagcggctttaatgttgccaagtatgtggtggacgagtatgtgttcaaccgtccgtttgagccggagtttgtgacggcgcaggacgaggctctgtggatggtcgttcccatgggtgtcgtcgacaagtacgtcaaggatcccgagttgcgcgccaaggtgcatcgcctggataaggaaggcaagggcgccgacccctcgtttatgaagggcgactttgtctttaaccgctggctgcgcatgtggcacaccaagctgcgccactttaagctgttcaagacgtattacaagtagatgagtgcggcgcccgtccggtttacatcgggcgggcgcgggtatgatacgcgcaattgcgcaagcgtcaccaaggaggcggcgatggaaaagctgggagttatcggcggcatgggcgccgaggccacgtcgtattactacgaccaggtggtgcgccatacggcggctacgtgcgaccaggagcatatcgacatggtggtgctttccaagtcgaccatgcccgaccgcacgctggccatcaagaccggcgagcatgccgagctgctggcgaccatgaaggagtgcgcccaggcgctcgagacgctgggctgtgcacacatcgccattccctgcaatacgtcacactacttctacgaccagatccagtcgtttacgaaggtgccgattatccacatgccgcgagagtcggtgcgctatgccctggcgggcgcggtgatgggggagtgcgagttcgatcccaacctaagcattccggcagagccggtgcgcaaaatcggcatcatgggtaccgatggcaccgtgggcgcgggcgtctatgggcgcgagtgtgaggcggcgggtgtcgaggtcgtctaccccagcgagaagcgtcaggccgacgtgatgtcgctcatctatgacgacgtgaaggccggacgtgagcccgatatggataagttcgaccgcgtgatgtgggagtttgcccgtagcggctgcgatcgcgtcattctggcctgcacggagctctcggtgctgcagaagtatcgtgagatgcccgagattaccctcgatgccatggacgtcctggtgcgtgaatccatcattcgcagcggcgccccctaccgcctctagtcccatacctaccaaaaagggacaggttaattttggtaggttttatctggagaaacgcaaaaggcctcggctcgtttgacgcgagccgaggccttttgcatgtaccggttgccgctgcgagtgctagaacaggaatcccaggatgatgagggcgacgctgatgacgaggacggcgatatccaggcccttgatgggatagcgcttgtacgagctggcacgcgtgcgcaggtaaaagccgcgctgctcggctgcaagcgcggtggcgtcggtcttgcccacgctcgagataagcagcggcacgcacaacggcagcatgagtttgagcttcttgatggggttcttggtgtcgtactcgacaccgcgtgcggtctgcgcctccatgatggcgttcatctcctggccgaacaccggcacaaagcgcagtgccgtggtaaaggtgaaggcatagcgatacggcacgtgcagcacctcgacgcaggcgttggcaaggtcgttgagcttggtcaccatgagcatgaggatgagtggcaacgccacgcccagcaagcgcagacaggcctttgatccggtgatgagccccgtgtcggtgataaagccccatatcacgttgccatcgcgcataaaggccagctggagcaacaacatgataagtgcgagcggaatcagcagcttgagcagcgagaacaggcgatcgacgacgccggcgtaggcgcccagcgcaagggtgagcgccaaaaagcccaacagcgctacataagtgtcggacaaaaaaatgccgatgatgatggcggcggcaaggcccagtttgacgaccgggttcaggcgatgcagcagcgtatcgcccggcatatagtcgatgacgttaaccacggcggaccatctccttggtaatgcgaacgatatcggtgacctcgctcacctgcgcaaaagcgggggagacggaggatgccaagcggcgcgagagttcaatgacctggggcggctccacgtaggcacgctgcatgagcttaatattcgagaacagctcgtgcgtgcgtccgcggtcgaggatacggccgtcggccatcacaacgatgcgctcggcaaagtcggaaacgacttccatatcgtggcagaccatgatcacggcgcagccgcgctctgccatggtgcgcaccgtttccatgacggtcatgcactcacggtagtcaaggccgctcgtgggctcgtcgagcactacaatcttgggctcaaccactacgacggaggcgagcgccaccatttgtcgctggccgcgcgaaagcgagaaaggcgcctcgtcggcgggcaggccaaagcggtcgatgacgagctgggcacgacgcagggcctcggcgcggtcgatgccggcaagctccaggccaaaagcgacctcgtcgagcacggtatccttgcagatctggcggtcggggttttggaagagcgttgcgacctcgcgggcgatgcggctcgtggggactgcggcggtgtccaagcccgtaacgcgcacgctgcccgaggcgggtttaagcaagcccgtgagcagtttggtaagcgtggtcttgccggcgccgttttggccgacaatgcccacgagctcgccagggtagagcgtcagactaaggtcgtgtacggcggcgccgccattgggataggcaaactcaacatgatcgaaggtgagcacgggttcggcgtccttggcatgagggcgcaacgacggggcatgcggggagcctgcgggcgcttgggcgtcgctggcggcgtgcgcggggtcgacgatgcccgaaatcaggtgctcggcctcatcgacattcaagcaaggggtgccgcttgccaggccatcggcctcgaggctattgaagatgcgtgtgacgcgggggcagtcgacgccgatggtgcggagctcgtcggtgtgcgcaaagacctcgtgcggctcgccctgtagcgcgatttcgccatggttgagcacgagcacgcggttgcagtactccgagagcagggcgaccttttgttcaacgaccacgatagtgatgccaagtgtgcggtttgcctcgcgtagggtctcgaagaccagcgtggagctggcggggtcgagtgctgcggtgggctcgtcgagtaccagtacgcgggggcgcatggcgaggatggcagcgatggccaccttttgcttctgtccgcccgagagggtggcgatctcgcggtcgcgaaggtcgctgataccgacggtctcgagcgtctcgtttacacgctgctcgatctggtcgtgagggacgccaaagttctccaggccaaaaagcatctcgtcctcgacgaccgaggcgaccatctgcgtgtcgatgtcctgcagcacgctgccgacgatctgcgacacgtcggtgagcgagacctcgcaggtgtcgtggccgtcaaccatgacggagccaaagaacgtgccggtgtagtggtggggcacagcgcccgacaggcaggcggcaagcgtggacttgccggcgcccgagggcccgatgatgccgataaagtctcccttgttcacgtcgagcgagatgtgcttaagcgcctgctcggtctgcgtaccataggagaacgagacatcgtcgacgttgatgatcgttttcatggatacctttcatggtcattggggacgttcttaaatgacgagtcgtttaagaacgtccccaaatgctagctgtttgggacagtctttggtgatggggccgctaacgcgcggcccgtccatcatatcaggctatttgttgagcaccttgcgcagggggaagaagagagcctggaccacgacggcgttgaagacggcggtgccgagcacgatgggcaccttggcgagcgcggtgggcagcgcggcacccatgatgacggtgcccaggacggcgaagagggcacctgagaccagggtggtgagcaggccggcgatgaaggggttgaccttgttgccgccgatgttggacttgacgagcgccgccatcgtcagcgcgccagcaagctcggtcacaaagttgaggccggggattgacgtggtgatctggatgacggctgccgacaggatgccaaagatggctgcctgggcaaagctcgcctgcgtgagtgcgatggccagggcgtaggcggcaatgatgaactgcggcttgatacccgttgcggcaagcgcgttgcccacggtcatgttgaggataaagccggcggcaaggaggacggcgagcaggacgagcgaggtgatatcgaggatgcctttgtcggaagcggcgttggcagaaatagtacgagcctgagtgtcggtggccatgatgttctccttaaggtgggatttgagataagagtgtcctagacccccacgaaaggggttaaatcgaaaaagggattaattttgaataatggagcacggagacggctttacgaggggccccaggttggcgcgaaagaggagcgaagcgtacttgggtacacgagcgacgaatgaacgccaagatggggtggctcgtaaagccgagcaggttagttgagcctaagggccttctggatgggcaggtagagggcgccgaccaggatggcgttaaagacggcggtcatggcgacgacaggcagcatggcggcagcgagctcgcccaccacgccgagcatagccatcttgatgaccatgaagataacgcccgagacaaaggtggtcacgaaggtggcgacaatggcgacgacaggcttaacttgaccgttcttgccggcggcgttaacgatggcggccatgagcatggcggcgatgccctcggcggcaaaatcgatgaacggcgaagtggtggtgatctggatcacggctgccgagataagaccgatgacgagtgcctgggcaatgttggggcgcacgaccaagatggtgaggcagaaggccgagatgatgaactcggggctgatcatgccgcccgagatgcccgagatggccttaccgacggtgaagttgaggataaagccggcggcaagcagaatagcgagcaggacgagagcacggacgtcgagtttgccgcggtcggcggtctggacggtgcggggctgggtggcggtggtgttctgagacatggtgaaaatcctttcggaaggggagtgcaagagaaagtaagcggaggcgcgtgatgcgaatgcgatcgggctcgagatagaaaaaggcccccggtcgaaaccggaggccttccaatcacctagagcgcaaaaacaggcgtgagggactcactgtcgaccgatcgtattcgcatcacgccaccaccagttgttgagagacttcatcgtgttcttcatgttggtggctcctttcgtgatgccgtggcgcggtcgcgcctaattgctgttgcgctgcactatagcacagcgaagtgtgtgctgggaaatcttttttgaaaagatttcagcggtgtttcccactggtcaaaaaggcaggcgggacgaaccgtgccatcccgcccgcaccagtgagggattactccttgttgcggcgatagaggatataaccgcctgcggagatgacggcaacgccagcgatggcgaatgcggccaccatgcggccatcaaaacgatcgccagtggtgggcaggccgcccttggtgttcgtcttgttggtggttaccgtggtcgtggtgttgtccgacttgccaggcttctcaggcttgacagcgggctgctcgggcttagtgggctgctcaggctgctcgggggtgctgggctgttcgggcttaccgggctgctcgggagtgccgggctgatccggggtgaccgggtcggtggcaagggcgtccttggcgtaggtgatggactccttgaggcccttggtctcggtgttcaggtcgctcggggtgaagcgctcgtcaaagtttccggccttctgataagcgcgcatctcctggagcagggccttgcacttcttgtaggtgttctcggtggcagccttgcctgccttgttggccagagcggtgcgaccctcggtggtcgtctcggccagcatagcggcgtcaacttccttgttctgctcgatgagctcgttctggagcgcgtcgaggtaggtgcggacactggtaccaagggtgtcagggttctcaaagcagagcgagctgatgtccatgaggacgtagttaatggagttctcgggctcctcgttgtacacgacgtctttcgcattgcagtggtcgaaggagacggtctgatcgctgaagtaggggctaacttcagttatcagagcggagtacagcgggatggcgacagagtacgcggcacgggagagcatttcccactggatggtagcgacttcgggatcatacccgcgacgaatctggaagagattgatctcggtgttgcgctcgctgccgatgcaataaacgccatcagtgttcgcgttgagaccagggacgttctctccgcggttgccgaaggcacgaatcagctcaaaggtgctccaaccagacttgccaggcttgaagaacagaggctggatttcgctgaccatagctcccttttggacgggttttccatccttatcggtgatagttttaatttcgtaatccgtgccttcggtcagctgactagcaaaataatggcggccttgcacatagcgggaccattggttaacgccagaatcggcgaggctttcgccatacgtttgggcgacatcgaatttaccgtcagcggagtatttggcgaaacccttctccacgggcatggactcgatgtccttggagtgcaggcagttctcagtatcgttcaggtcgacatcgtagttgaggctgccgatgttggggttgagtgaggcgacgtcgtcggccagcttcatggcaatccattgatgggcagaaagcgtggcgaacagccaggtctcgttgttgtcggcgataatgatctggtcgttagtgcaagtgccctgctcgtcgatcaggctgccgaggagctcgacgccctcgcgggcattggcgctctggcccaggatgacgctgccgtagctgtactcgccgatgccggtagcctcatcgattgggtctgctgctttggcatcctcgttataggaggtgctcagcgtagcggagcaagagacacccttctcgttgataccggcttcggagtaggcgtcggtgtggccctcccaattggagggatggtcacgtacgtagctgtagcgatatgtaggcttattcgaagtgtattcgaaagcagactcattcgagctgtacgtaaagccggcttcgtgggcgggttcgatgccatagtgcttgagatagcgcttgccaaagtcctcggcacggccatagtacgtgttgccgtcggccgttagatctttgcccatgtacatctgcgtgcaggcgagcgcagaggtcggcatggacatgatggttgcagctccaaaggcgaggcctatgcccagctttttgagcgcgttgacggggtgagttttcctcataatccctcccagcgtgcgaaagccctctgtcgccagagggcttcagccaataaagacactcccttagcgtaacgaatcggaaacaatattcatctatgaaaaatacttactcgataagcgtaatgaaatatacgatgagcggttaattatactcagtctgtagctttagccaaataaagacgccctgcaattactgcatctggataaagcgtctggaaataccgaaatgaaaaatcccccgctgtttggcaaatgcataaacagcgggggagatgataatcggatgaatatcataccaatgtggaattacttcttccggcggtggatcacgttaatcgcatagccgacgagcatggccaggacgatgacgataaaaccgagcaggggattgtcgttcatgggttcctcctattttccgagcggggagaattcgtcgacgatgaggtcgagacattgcggaagcgcgcgggcgccaaagacgccggagttgctggagataatctcgccatcgaactgcatgcccagcgacggtgtacaggtaatcttagcttccttggtctggatgatcttgaactgcgggcgaccgagcaccttgccggcggggtcgagcgcagcggtgatcacggtgggcagcaactgcacggtttttacgggctcgatgaccgcgatgtcgaccatgccgtcgttcatgcggcagtctgggaacaggttgatgtcgttttggatgaccgaggtgttgcctgccatgcagcagatgccgtctagctcctcgacaatgccgtcatgctcaatcgtaaagtgcgccactgtgggattgggcgtagcaagcgccgacaggaagtaggcgatctcgccaatgtcgtttttggtgggggctgccttcatcatgatctcggcgtcgaagcccgagccggcgatgatgataaaaccatggcgcttttcgttgccgtcctcgtcgagccaaaagagctcacccatgtcgaccttgaccgtgcggccggcgcggcaggccttggcgagtgccgccgcctcgggggcattgcctatgttgttgaagaacaggcatgccgtgccagaggggaagacgagtgtggggacgccgcatccgcgcatctggtcgagcacgttggagacggtgccgtcgccacccgagactaccacgcgatcgaactcgcgcacgtccgccacggcgtcctcgggctccatgccatcgccgataaagcgcatcacgacctcgtcgccgccctgcgccagggcgtgcgtgaatgcgaagatttcatctgagctggggcccgatgccgggttgtggatgataaggcagcgcatacttacgttcccgttctgtgactaaccgagtatagttgtaagacaatgccgatatcctacccgtgtttttcgggcctaaccttattcgatgggttgatatgtacatttccacacatcaggctctactcgacttttgccagcgcgccagcgagttcgacgcgattgccgtcgataccgagtttttgcgcgagcgcacgttccatcctcgtctgtgcctggtccagattgccacccctgccgagagcgtcgtggtcgatccgttggtgatcgacgacctgtcgccgctcgccgagcttatggccgacgagggcgtggtcaaggtatttcatgcctgctcgcaggatatggaggtcatgctccataccgtaggagtgttgccgcgtccgatttttgacacgcaggtggctgccgcctttttgggcgaacgccagcagatttcgtacggcgcgctcgtgcagacgttttgtggcgtctctctgcccaagaccgagtcactgaccgactggtcgcgccgtccgctgaccgacaagcagatcgagtacgcgatcgatgacgtcaagtacctgatcgtcgcctataccgagatgatgagccgcctgcgcgagctgggccgcgtggactgggtgctcgacgagctacgcccactggccgacgagtcgcactatcgcgctgatcgtcacgaggcattccgtaaggtcaagcgcatcaactcctgcagccgccatcaactgggcatcgcgcgcgagctcgccgcctggcgcgaggaccgcgccgagcgccgcaacatcccgcgcaagtgggtcatgtccgacgatacgctgctggcgctcgtcaagcgcaatcccatgcgcgtcgaggagttccgcagtatccgcggtaccgatcagctgggggagcgcgacgtggacggcgcgctcatggccatcaagcgcggcgcgagttgcccgcacgatcgcctgccgctcatggtgcgcggacaccgccagatctcgccggagctggagagcgtgacggatctgatgtatgcgctcattcgcctggttgccgagcgctcgggcgtggcgacctcggtcattgcctcgcgcgatgacttggccgactacattgagcatcccgagcagagccccctgcgcgaaggctggcgctttgagctcgtgggctcgcgcctggacgatctgctttcgggcaatatgggactcaccgtgaaggacggaaagatagagcttttatagttacgcggttttgacaggcactgcaaacgttcgagagcggcaatgccaaaacattgatgctgtctctttggttgggcgaatgggtagaatgcctccaacgtgtaactcgattcggaggaattcgcatgccctattactatggatacggctttggtatcgacccgctgtacctgctggttgttcttgtctgtacggtgcttggtcttgccgcgcagagctatatcaactcgacgtacaagacgtggtccaaggtacgctcggacggcgacacgggcgctgcggttgctcgccgcatgctcgacgccaacggttgcaacgccgtgggtatcaagggcgttgccggcgagctcaccgaccattacaacccgcaggacaacaacctgtatctgtcggacgccaaccgctcgggcggctcggtggcaagcgttgccgtcgcctgccacgaggcgggccatgccgcccagcgccaaagcggctatgccatgatgaaggtgcgcagcgccctcgtgccggttgtcaactttacccagaacacctggacgatcgtgctgcttatgggcctgttcatgaacattgctgggctcacgaccctcgcgttgatcttcttttcgtttagcgttctgttccagctagttacgctgccggtcgagatcgatgccagccgccgcgccgtggcatacattgagcagtcgggtatgagctccaagcaggtcaacggtgccaagaaggtgctgacggcggctgcgcttacctatgttgcagcggcgctcacctcgatcattcaactgctctacctcatggctcgctacaacagaaactccaaccgataacaaatggggctgacgggcgccgcggggatttgtgtccccgcggcgctgtactatgtgtgggacttgaatttgcacagggccggagccctggtgcgcgatgacgaaaggaggctgcgtggcaggctggaatctaaccggcaacagcgtttccgccgagttcgacgggtcggacgagcaggagcgcaaagagctcagcgtgagccaggcggtcgagatcgccgctggtgcgctcgatgcgattccgcagctgagcgtcctgggcgaggtcaccggctttcgtggccccaatgcccgaagcggccactgctacttccagatcaaggacgactcggccgtcgtcgattgcattatctggaagggcgcctatctcaagcgcaccttcgatttgcgcgatggtatgcaggtgagctttaagggcagctttaacctctacaagcccacgggccgtatgagctttgtcgctcgctcgttctcgctggcgggggagggcctgctgcgtcaacaggtggcacaactggccgaaaagctacgccgcgagggcttgatggacgagtcccgcaaacgtcgcatcccggtgttttgctcacgtgtggcggtcgtcacctcgctttccggcgccgtgatcgacgacgtcaagcgtacgctgcgccgtcgcaacccacttgtcgagctcgtttgcgtgggcgccaaggtgcagggcgagggagcgtctgccgagcttatcgacggcttgcatcgcgccgctgcgattacgcctacgccggattgcattttgctcgtgcgtggcggcggttccttcgaggacctcatgaccttcaacgacgaggaacttgcccgcgcggtggcggcctgtcctgtgcctgtagtgacaggtattggccatgagcccgatacctcgatctgcgacatggtgagcgaccgtcgcgcctccacgccaacggcggctgcagaatcggtggcaccggccatgacggagctggctgatgtactcgaggcgcgtcatcagcgtctgggcgctgcgatggcatcgatgatcggttcggatctggtcgatctggagatgctcgaccagcgtggtcggcgtgcctgggatacctatacggcacgcttgggcgatgcgctcgatgcagccgcgtgccgtccgtgcctcaacgatccaacgtttatggtcgagcgtcgcgagtcggagctcgccttgacggccgatcgcctgtcgggcgccattgcgcgttcggtcggggctttccgctccaacttcgagcgtctgcccgagcgcttgattgcaagcacctcggggctcgatggcaagcgccatgcactcacgctcgcgagctcccgcctggagcatcaggggcgcacgatgttgaacaagcccgcgtccgacttgggccgtgcggcagcctcgctcgacgccctgtcgccgctcaaggtgcttgcccgcggctattccatcgcgtatagcgaagacggtgtggctacaagcgcccagacctttaagcccggcgatgccatccgcgtgcgcatggcggacggcaacgtgtcggcaaccgtcaatacggtcgaatagaccgcgtttcacagtgatagacctttaggaaaggaaacagatatggcagagaagaccccggtcgagcagcttacgtacaagcaggcctcgcaggagctggaactcattatccgcagcctggagtcgggcgacatggagctcgaggagtcgctcgagagctacacccgcggcgtcgagcttctcaagagcctgcgtacccgcctggccgatgccgagcagaaggtctcggtgcttcttaaggatgtcgacggcaacgacgtgctcgccgacggcgaagccgccaacaccgacgacaacctctcgttctaaccatcccgaccaaatataattaccttggtctgcgagaaaggaaccaaccatgtgtgattgcatcttctgcaaaatcgccaaccacgagattccctcaaccgttatctatgaggacgaccaggtcatcgcgttcgacgaccttaatccccaggcgccggtccatacgctcgtgattcccaagaaacactacagtgacatcgccgacaacgtgcctgccgagaccatgggtgccatggctcacgccatccaggaggtcgccaaggccaagggtctggaggacggtttccgtgtcatctccaacaagggcgtcaacgccggccagaccgtcatgcacttccacatgcacgtcctcggcggcaagaacctgggcgagaacctcatctgagggcgcgcagtccgtcgccttggctgcctttggagtaatctatgcagctttctcaactcgaataccttcaagcagtagcgaaccatggtggcgtgcgtaaagctgctcgcgccgttcatgtgagtccacaggccgtttcgtcggcaattaagaagttggaatctgagtatcagattgctttgctcgaccgatcgacgggggaggctgctttgtctcctgcgggccgggagtttgcgcgtcgtgcacgcatggtcttgacacaagtcgatgatctcaaaaagtacgctcaatcgatgggcgacggcgtttcgcccgacggccattttcgtctctatgccccctgccttcacggacgggggctccttttttccgaatactggtacgactcgtttgaaagcttgcacccccagatccacctcgatgtgtggcatcaaccaacggccacatgctttgagtcgctcatgcttggtatttcggatgcagccatctcatttgaggaaccacgggacagcgccctttcttcgaaatgcttgggcgaaaaggagctcaaggttctttcgtgcccggcgggccatcaatctgtggaagctatgaccattcgtgagctactgggcggcaggcttgctgttccaattaatttgtcaccctgtctcaatgcaatcaaccaatgtcccgaagcccagctcgttaatttccgtttccgtgatgtcgaatacggaagcagggctcaggttgagtttcttcaagccgggggattgatattgagtttgtctgggtcccctctcgcatcggatggatcagaagtgagcgagtgttccattgaaggatcgcgtgacgtaactctgcctatctacttttgctatcggcaaaattcctggactgatcgacaccagacggttttccttcacctattgcgccatctcgcttcgtgagactatttgacatcgcgtcgtcaagtgaatattgacgcttcgtaacgcatggttgacggcttcgctttcatacttttccaagattttggtttggattattgactcttggagggcgaagcatgaaaaaccgtatggttttgctttatatggcgttcgttttcctatcgaacttcagcaccatcttgtattttctgacggtttaccttgagtttgtcggattctcgatggtggcgatttctggcatgatgattgcataccaagtgagcaagtttattcttgaggttcctactggctatattgcagacaggtttggacgaaaggcgagcggcctcgttggcatcatgggaatgcttgtgtactacgccgttctgcttctcgcccggtctcctctgcttttaatcggcgcgtttgctctcaaaggttttgccgtcgcatgcgtgagcggatccatcgaagcgatttacatcgacagtgtctctcaggaccagctcgtgagacttaatgtggttgagcgattcgtcttctatgcgtcttatgccctttctgcttgtgtaggcggtttcatctcgtccgttggtgcgtattacgtcggtctttcggcagatatcttcgccatggtgctgacactggctgtcgttgcctgtatccctgaggagcgaagagaaggcactatgacgacgttcgagcgtggaattagcccaaggatgattggggcggctattacgagcaacagtattcttcgctcagcgtttgttatggactgctctcaggcttttgctttcgtcgctttggaagactttttctcgctgctgcttgcagaccgcggaatgaacgccgttgcttcgggtgtgaccattgcggtccagctccttgtctccgcctccatagggtttatcgtgcccagtgtgattgctcatgtcgacaagggcagttttgcgcgtatttgcggcatcgttcgtcttttcttgactgctttgtttttgatcccctttactccagcctatttattgcccgtgttctatgtgctgcagacggttgcttactcgttatttgctccgatcaaatactcggtttttcaaaatgctgccgattcatcgatgcgctgttcactgatttcggttcaaagccagatggtggcggtgggcgccgttcttttctatctgctcaatgctgtgttgagtagcgttgtgggtattcgggttgtgctgcttgttgcgcttgggatttcttctctggcgtatgtccccgcgctatttcgccttacaagtcaaaggtcatgagcgaccaggcatcgataacttatatatcaacgcaataaacccgagcgcgagggcgtttgggtttattattgaagcgtatgtaacctggcggcgccacaccgcctgttagtagggagacacatgaacgttctggtcgtcaacgcaggatcttcgacccttaagtatcaggtcatcgataccaagtcccacaaggtgtccgcaaagggctcctgcgagcgcgtctgctttaccggcggtacctttacccacgctgccaacggttccaaaaaggtgaccgagaacatcgagttccccgaccacaaggtcgccatcgaggtcgtcctgaaggacctcgaggccaacggcgtcaagatcgagggcatcggccaccgcatcgttcagggcggttggtattttggcgattcctccctcgtcgacgaggacgttctcgccaagattcgcgaggttgccccgctcgctccgctgcacaacaaccccgaggccaacgttatcgagttctgcctggagcagtatcccgacctgcctaacgtcacggtctacgacaccgccttccacttcaacatgcccgaggtcgccaagacctacgccctgcccaaggacgtttgcgacaagcttcacattcgtaagtacggcgcccacggtaccagctaccgctacatctccaagaaggtcgccgagatgaccaacggcgaggcccgcaaggttgtcgtgtgccacatcggttccggcgcttccttgtgcgccatcgaggacggcaagtgcatggacaccaccatgggcctcaccccgctcgacggcgtcatgatgggcacccgctgcggttccattgacccggctaccgtgtgctacctgcagcgcgagggcggctacaccttcgacgaggttgacgagatgatgaacaagaagtccggcctcatggctgtgaccggcggcaagaccaacgactgccgtaacgtcgaggagctcgccgctgctggcgaccccgaggctcagctcgccttcgatatgtttgtctacaagattgccgccaaggctgccgagatggcaacctccatgtgcggcatggacacgctcgtctttaccgccggcatcggcgagcacgctccggcagttcgcgccggtgtggctgaccgtctggcctttatgggcgtcaagatggatcacgctcgcaacgctctgcgtggcgatggcgcctggtgcctgtccgctaaggattccaaggtcaagatcttcgtcatccctacggacgaggagttcatgatcgcttccgacgtcgagcgcatcgtcaacggcaagtaattgatgcaaggggaggggactggatggccttgtgccgttcagcccccttttatgcgctttgggcgaagagtttaatagatatttattgaattctgataacttcttattaaggatacggccgccttatgggtttgccgaccgtactgtaatcacgaaggagtctcatgaacgtacttgttgtcaacgccggcagctcgagccttaaatatcagcttttgaataccgatacccgcgaggtcttcgccaagggtaactgcgagcgtatcggctcggagatgggcatctttggccattccgagaacggtggcgccaagcagaccgaggagattcctttccccgaccaccgctcggccattgcgcgcgtgctcgaggagctcgagaagaccgactttacgatcgatggcatcggccaccgcatcgttcagggcggctggtacttcgatgattccgcggtcgtcgacgatgaggtcatggctaagattctcgaggtggcgccgctcgcgccgctgcacaactacggcgaggccgcagcgattgagtattgccgcgagaagtatccggagctgcccaacgtggccgtcttcgatacgtcgttccatatgaccatgcccgaggtcgcctacacctatgcactgcccaaggacgtgtgcgacaagtatcacgtgcgcaagtacggcgcccacggcacgagccaccgttacgagtggatgatggccaaggagatcttgggtacgcgctgccaccgtctgctgtcgtgccacctgggcaacggcgcctcgctcgccgccatcgaggacggcgtatgccgcgataccacgatgggcctcacgccgctcgacggcctgatgatgggcacccgttgcggttccatcgacccggccaccgtgtgctacctgcaacgcgagggcggctatagctatcaggaagtcgacgacatgatgaacaagcagtccggtctgcttgccatctcgggcatctccaacgacgcccgcgacattcgcacgcgcgcctccgagggcgacgagcgctgcctgctcgccttcgacatgttcgcctacaaggccatgcagcaggccggttccatgatcgcttccatggcgggcgtggataccattaccttcactgccggcatcggcgagaacgactggtcgatccgcaaggccttctgcgactgctttgagtggctgggcgtgcgcatcgacaacaacaagaaccgcgaggccgtgggcaacggcccgcaggtcatcagcgccgccggctccgccgtcacggtcatggtcatccctaccgacgaggaatacatgatcgcccacgacgtcgagcgtctgaccaagaacaactaacgtattcgtctgtaattgacaaaaaggcctccagagcaacagctccggaggcctttttactagcaggcggacggcggaaacctcatcccatttcgagcgcaaattctgggacacgctttccggttgaggcacgttgcggaaagtgcgacccacaataaagcaaaattccgtcccgtagtttcccaaacaggccccaaggggaaactgcatcccacaattcgcctttaaactgggatacgctttccgcctgaacagccgccgatccgcaccatgcctcgcagatccaaagtgaccatatccgcaacgcctgcgctagcgacaaaggcacccagccatccaggtcttcagctccagctcgtagccaagccgccgtccactccagatgccctgattgctacgtggcggcagggaccctacagggtaaagctctgaaaactttccgcaggacggaggaagcccccgccgcacgtagtgcgcagcgggggcttccgacatgtccgaggacgttttcagaggtttaccctgtagggccccgaggggatatgtccgctactcagccatctgagcctggacggcggtgatggccacgacacccacgatgtcgtcggcagagcagccgcgcgaaaggtcgttgaccggcttggcgatgccctgcaggatggggccgtaggcgtcggcaccggcgaagcgctggaccagcttgtagccgatgttgccggcctcgaggtcggggaacacgagcacgttggccttaccggcgacggaggagccgggagccttgagctgggcgacggtggggacgatggcggcgtcgagctgcaggtcgccatcgatggcgagctcgggagccttctccttgcagaacttcacggcctcctggaccttcttggcgacctcgccaccggcggagcccatggtggagtaggagagcatggccacgtgcggctcaacattgcccataaaggtggaccaggagtgcgcggaggcgatggcgatctcggagagctcgtcagaggacgggttgatgttgaggccgcagtcggcaaagatcagcgtgccgtcggtgccaaactgcggggtgtcggtgcacatcacgaagaaggccgagaccagcttggttcccggggcggtcttgaggatctgcaacgcggggcgcagggtgtcggcggtggagtggcaggcgccggagaccaggccgtcggcatcgcccatcttgaccatcatggtgccaaagtaggtggcgtccatcacctgggcgcgagcctgctcgatggtgacgcccttcttggcgcggagctcggcaaacttctgcgcgtactcctcgtgcttctcggcgttgcgcgggtcgatgacggtggcgccgggaacgttgatgtcatcgggattgcccaggatgacgatgttggccaggccctcctcgatgatcttgttcgccgcgacgatggtgcgcgggtcctcgccctcgggcaggacgatggtcttaaggtcggccttggcggcagacttcatacggtttaggaaatcgctcatgttactccttacaagcgttccgctaagctccaggccctcggctgtacacgaataaacccgctgctagcgggtttacctttcaattatgtacgccgcggtgcttgagctttccttgtgtggcaagctcattataggacgcattagcgctataatcgctctgataaatatgtctcgacgtatgttcgagaaaaagcccagttaaaaagcgtgtggcttttgacaaggagtatcgatgcagattacctcaggcctgcctgaaggctttaatgccggtgcgtacgacatgatcgttgtcggtgccgggtacgctggtgccgtttgtgcccgccgtcttgccgagactatcggctatcgcgttgccgttctggagcgtcgtagccacattgcaggcaatgcctacgactgcgctgacgaggctggaatcctgatccacgagtacggtccgcacatctaccacacctttaacgagcgcgtgcacaacttcctgtcgcgctttaccaagtggacggactatcagcacaaggtgcttgccaacatcaacggcactcttatgcccgtgcccttcaaccacgcgagcctcaagcttgcttttggcgatgagcgcggcgaggagctgtatcagaagctcgtggagacctttggcaaggatgtcaaggtgcccattatggagctgcgcaagaagaacgacccggatcttgccgaggtcgccgattacgtctacgagaacgtctttttgcattacaccatgaagcagtggggtcagactcccgaccagatcgatccctcgatcactggtcgcgttcccgtttttgtgggcgatgacgatcgctacttcccgcaggcccccttccagggtatgccgcaggacggctacaccgcgctgttcgagcatatgctcgatcatgacttgatcgacgtgttctgcgacgtggacgctcgcgatttgttcgagattgacgagaccaccgttaaagttgacggcaaggtctacggcggcgagatcgtctacaccggtccgctcgatgagctgttcaatctcgacctgggtgctctgccgtaccgcacgctcgatatgaagttcgagacgctcgatatggatcagttccagcccgtgggcaccgtcaactacaccacgagcgaggactacacgcgcattaccgagttcaagaacatgaccggtcaggtcctgcccggcaagaccaccatcatgaaggaatactccaaggcctatacgcctggttcgggcgagacgccgtactacgccattcttgagcccgagaaccgcgagctctatgagcgctatcttgagcgcgttcagaacctgacgaacttccacccggtgggtcgcctggccgagtatcgttactacgatatggacgccgtgaccaattccgccctcgatctttcggatgagattatcgcctgccatgcataaagtcataacattcggtattccctcgtataacgccgccaaggacatggaccattgcatcacctccatcctggagggaagcaattacgccaccgatatcgagattatcgtggtcgacgacggctccaaggacgagacggccgccaaggccgacgagtgggaggcccgttatcccggtatcatccgcgcggtgcaccaggagaatggcggccacggtatcgccgtcctttcgggtctgcgcgaggcgcagggtacgtactacaaggtcgtagactccgacgactggctcgacggcgcggccctttcgaccatgctgtcgatcctgcgtggctttgaggagcgcgaccagcgcgtcgacctgtttatctccaactacgtgtacgagaaggtctatgagggcacgcataccgctatcggctacaagtttgccctgccgcgcaaaaagattttcacctgggatcagatcgggcacttccgtctggaccagaatctgcttatgcacagtctgtgctatcgcacggacgtgctgcgcgagtccaacctgcctatgccgccgcacaccttctacgtggacaacatctacgcctacgtgccgctgccgcgctgcaagaccatgtattacgccgacatcgacctctaccgttacttcattggtcgcgagggccagagcgtcaacgaggctacgatggtcaagcgtctggaccagcagttccgcgttacgcgcattatgatggagtcgttccacctgttccaggacgttgagtcttcgcgcctgcgctcgtacatgatgggctacttcaccatgatgatggcgatctgctcggtgctcaccaagctttccgaggaagaatgcgccgatgagcgcctgaagacgctgtggaatgatctgaaggcctacgacgagcgcatgtatcgtcgcgcccgctacggcgtggtgggcttctttaccaatctgcacggtcgggcgggagacaaaaccacactcggcctataccgtcttgcctcaaagatcttcaaattcaactagcacagaaacgctcgggtaacggggacccctggtccttaacttgctacttcgaacagtcctgcgcaagacggaggcgccactggcgcctcctttgcgtcaagactttagtctgctgggcgcgcagcggccagctttaaaccacccgctacgcgggtggagacaaacggctttacaaagccacccctccgaccgaaaccctggaccttgggattaagagtcccctgctctaccaactgagctaacgacccgatatcaacacgaagcaagaactggggtgggtaaagggactcgaaccctcgacctacgggaccacaacccgtcgctctagccaactgagctacacccaccgtgtcctgtgcgcttcgcgctcgactattattgcaaggaacgccacgcgatgcaagccccaattttcaagaattttgaaaagagtttttcgagaccatttcgagcatttcccaccggtttcataggagtaaacttgccccactgcaaatgctcgaaaggaccggcatgaaagaactctccaaccgcacggcaacgtttaccgattccgtcatccgtcgcatgacgcgcatctccaacaagtatggcgccgtcaacctgtcacagggcttccccgactttgatcccccggcgcagctgctcaatagcctcggcaccatcgccaccgaccccaagccgctttaccaccagtactccatcacctggggctcccaagccatgcgcgaggcgcttgccgccaagcaggagcactttatgggcatgccgatcaaccccaacgagaacatcgtggtcacctgcggctccaccgaggccatgatggccgccatgatgacggtcaccaaccccgacgacaaggtcgtcattttctcgccattctacgagaactacggcgccgacacgatcctttcgggtgccgagcccatctacgtgccgctcaacccgcccacctttgactttgaccgtgaggtcctcgaggcggccttccgcgacaacgatcccaaggcgatcgtcctatgcaacccgtccaacccctgcggcaaggtctttacccgcgaggaactcacctttatcgccgacctgtgcaaaaagtatgacgcctactgcatcaccgacgaggtctacgagcacatcgtctacgcgccccacgagcacgtgtacatggccacgttgcccggcatgtttgagcgcaccatcagctgcagctcgctatccaagacctactccatcaccggctggcgcctgggctacaccatcgctcctgccgaaatcaccgagcgcatcaaaaaggttcacgacttcctcaccgtgggcgccgccgctcccctgcaagaggccgtcgtcaccgccctcaacttcgacgacagctattaccaggaggtcctcgacctctacaccgccaagcgcgacctattctgtcagggactcgacagcatcggactcacgcacaacgtgccgcagggcgcctactacgtgatgatggatatctcggagtttggctataacagcgacctcgacttctgcgaggacctcgcgtccaaggtgggcgtgggcgccgtgcccggctcaagcttcttccgcgagcccgtcaaccacctcatccgcttccactttgccaagcgagacgagacgcttagcgccgcgctggagaacctcaagtccctgcgtgataaaatcgagccacgcgggtaaggacggccagtaactaaaggcactaaagaaacctcgtgaacccgttgggatacgaggtttctttttatagcgacctcatttattttttagagcgctatactttagagaaggagcaactcgtcccagagagaggaatactatgcaagagcagcagcttatcggagcgctcgaggccggcggcaccaagatggtctgcgccacgggctatgcagacggtacggtcctggagcgtgagcagatcgcgaccacgaccccgcaggagaccgttgaggccgtcaacgcatggtttgcgaacaagggcatcgccgcgctgggcatcggcgcctttggccccaccgcagtcaaccctgcctcgccccaatacggcaagatcctggagacgcccaaaacggcatggcgctactttgacctgctgggcaccatccaaaacgagctcaatattccctgcggctacgacaccgacgtcaacgtcgcctgcctgggcgaggtcacctttggttgcgcccagagcctcactgacgtggtgtatctgaccatcggtaccggcgtgggcgccggcgtgctctcgggcggtaagctcgtgcacggcatgatgcatcccgaggccggccacatcctggtcactcgcgacccgcgcgacaccatcggcgagcacagcggctgccccttccacgacaactgcctcgagggcctcatcgccggccccggcgtcaaaaagcgctggggcggcaagagcgccggagagatggccgacgacccagatgccatggacctgcttgccggataccttgcgcaggcgctcatgacttacatcctgtgctacgcaccgcagaagatcgtcatcggtggcggcgtggccgaccacacccccatcgtgccgctcgcgcgcaagaagtgtgccgagatgctcaacggctacatcgtcacgtccgagatggtcgacatcgatagctacatcgtcaacaacagcctcgagggcaagcagggcattatgggctgcttggccctgggcgcacaggcgcttcagtagcagacgcacccgcagggcgtggcgcgcccggcaaatccgacctacggaacaacgccaccacgccccatataagccctcgaataaaaaaggccgcctaggaccaaacaatacgtcctaggcggcttttttggcgcacatcagcgaccgtaagagatatcggagcacaacgcccgttgccgctccacagcagtcgatcatcacatcggtgatcatgccggcacgtcccggcacaaagagctgaatcgtctcgtcgatcgagggaatcagcagcaggaacaccgccgtgggcagcagcacgtcaaaggtgcgccgcccctcataatcaaaggcatgcgttgccaggatgccgagcaccatatactcggtgaaatgcgcgcacttgcgaacaacaaagttggtcacccatgcatatggaagtcccacgccgtgcaggaaaccgcggatagcttccatgaccgttaggctcagcgagcccgaccccgagccgggaaccagcgaattgccccagatcaagagcgccatcaggcaggtcacgaccgcccattttcgattgatcttaaccatgcagaagttatgcctccgcgcggagcggcgcgaagctggcggtaccgccctcgataacgctcagataggcacggcccgtacgcttggcggtagaggactgcaggcgctcgatctcttcctcgaggatctgattgacgcgctcgtgacgacgattttccataatgccggcggcaatagcctcggcccgctcgatgccctcgcgcgagatacgggcggtatcctcggggaacacagcgctgtgacggccgacataggcgggggcagcaggctgaggggcagcgacgggagcgggggctgcaacgggagcaggctcgtcaatctcatccagaatcgcggtggcggcggcccacatgtcctcgtggcccgagtaatcggccatggggacatcaacctcgagcgaggcatccggaaggtcgccggtgtcgatgcgatcttgggcatcaatcgatgcggtgatggctgcaggctcatcgaggtcatcgagatcgatgtccgcggcaccggaaatgataggcatgctggcaaggtttgcgttgtacggcgcagcctcagccgcctgctgctgggcaggagcgccccaaagcgagctttcggcggcacggcgggcggcaacggcctcctcgtccgcggtcatgtcttcatcaacgtacgaattatcggcagaagcgttcgcgtccgccgaggtagcgctgtaggcgttattggctgccgcgttggcaacgagtgccacgaaagccgccgtgctgcccgcaggggcggcctgggagcccgacacggcacgcgcggcggcggcgatgtcgtcgcgattgaaggagccggtctgcccgccgttggtgagctcgtcgatggcgacttgatagacgtcgcgcgagcgcgcagggtcgcagctaaccggcgaatcgtcgtcgagcatgctgtcgatcatggaccaagcctcggcctcgtccatagcatctgcggctcgagcgatggtaggaacaccatcgtcggcatgacggcgctggaacgcaccggtcaggccggaaaggaatgccgaggtagactgttccgactgagcccgagaagcagaagccgcagcgtaaggtatcgcatcctgctgctgagctggaatcgaggcggtcttgaactcgctttgatgctgattgagatttgcggcaccgcccatggcatcgggctggaacagacgctcttcacgctgcgcacgatactcggagatacccagcgaggcggcatagatacccacgcccgccaccgcgcccacggcgaagggaaccgcacccgccacgaccgtctcgttcaccgacgaaaacggcagcgtcgcggcatacataaccacgggagcggcaaggccgatcccgcacgaaagtccggcaaggactgctcgttgtgttgcatcagaagaagccatgagctctccccatcttccagcacccaaatcgcatcattcagttggctgcgcgagagaagatgaagcggggctatgccccaaagcaacggtatatggttcgtttcatctgcgttttccgtcgcgaagcttaaaagctattatgcgaaaccgccctgccgattgcaagcgacgatgtcggattgaaacgggaaacctgctgctcgtcggtcttacggtcaaaaataagcgcggagcggcgctatggaaaagggccgcggctcaaagccccgaccctttatcgcattgatgactatcgcagcgcgtggatgacagcctagaacgtctgctcgtagtcgctgtgttttttggccgaacgcaccaggaactcctggttggtgttggtgcccttaagacccttgataaacgatgcggctgcgcgctcggtgttgttcataccggcaagaatgcgacgcagaccaaagacaaacgggcgcatctgctcgtcgaccaacaggtcctcgttacgcgtaccggaggcaacggggtcgatagccgggaagatgcggcggtcggccaggtcgcggtcgagcttaagctccatgttgccggtgcccttgaactcctcaaagatgacctcgtccatcttggaaccggtgtcgatgagggcagaggccaggatggtgagcgagccaccgttctcgatattgcgggctgcgcccaggaagcgcttgggcggatacagggccgccgaatcgacgccgcccgaaaggatgcggcccgaggcgggcgccgccaagttgtaggcacgggcaagacgcgtgatggagtcgagcaccaccacgacgtcgccacccagctccacgatgcgcttggcgcgctcgatgacgagctctgccacgcgggtgtggttgtcggcaggcatatcgaaggtcgacgccacaacctcacccttgatggaacgctgcatatcggtgacctcttcgggacgctcgtcgacgagcaggcagatgaggtgcacctcggggttattaatcgagatagactggcagatcttcttgaggatcgtggtcttgccggccttgggtggggacacgatcaggccacgctgacccttgccgatcggtgacacgatgtcgatggcgcgaccggtaatagagtccttgccgtgctccatgcgcagcggctcgttgggatagaccggggtgaggtcgccgaacttgggacggttgcgaatctgctcggggtcaagaccgttgatggtcgtgattttggcgaggccggcgcgcttgtcgccgccgcgcgaaggacgcagcgagccctcgatgacgtcgcccgtgcgcaggcgcgcggagcggatgaggtaggcgggcacgaaggcgtcgtcgttggacttcatgtagccatgggcgtggatgatgccggagctgtccgggcgaatctgcagaatgcccttgatgtcgcggaagccctcggccttcgcggcggtggtgtagatctcctcgacgagctcggctttcttcttgccggtcgtctcgatctcgaactccttggccttctcgcgaagttcggcgaccttcatggcagcgagctcctcgcgcgaaagcgtgggctcggtgggagcggcattacgctccttgttgcgctgtttgcgatcgcgctggcggttgcgacggtcgttgttgcgctcgtccttgcgctcgttgcgctcctcgttgcgcttgtgctggcgacggttggggcgagcgccgtcttcgccctcggcggggacggcaccatcggttgcggcggtgtcaacattggccgcagcggcgtcattggcctcggcgccagaatcaacctgcgcttcgacatcagcctgctgctcggcggccttgaccttaacggacttcttgcgaccgcgcttgggcttctcggatgcaggctgttcgacgtcctggggctcgacggcatcagtcgatgcatcggcggtcgtctcggcggaatcctcggacgcacccttcttggcagccttagccttggacgtgcgcttagcagcagtgcgacggctgcgaccgggacggacgtcggcgggctcggcatcggcagaaacggcctcggaagtcgtagcatcctggacgggtgcatcggcagcagttgaggacttgccggtcgcctcagcatcccgagcggcggcggctgcggctgcggccttctcggcctcgacaaaggccttgggcttgcgaccgcgacggtgcgggcgcaaagccggatcgacaacgggaacttcgctggactcgacaggcgcagcgggctcaacaggcgatgtgccctcccctgccgcggaacggaccgaagcctcagtgggctcgggggccacctgttccgcaacctgctcggccttagcagccgtgcggcggcgtgtgcgcggtgccggcttctcggtcggcaggtcggcggcaggggtctcgatggcggcaggcgtctcgggcacagacggagctgcaagctcggtcagagccgcggcctcgcgctcggcagcacgacggcgggcgcgcaccacctgagcctcgctaatctgcgccaacgcacgtgcctgcgcgacctcatcggaaatcggcgccgaggagtcagccgcaacggtgcgcttggcgcgcgtcgtgcgcgtggtacggcgcttgggcttggtgacctcctcgccgtcagcggcaggcttggtcgtgcggcgcgtacgcttgggctttgccggagcagcctcctcaccagttgaaggcacggccttctcagccgctgcaggcgtaggcgtcgaagcagccttaggcgtctcaggagccgaggcttgcgcgggcgccgcaacctggtccgacgcaaccggtgcagcgggagcagcttgcgtcgtcgttatttcgttttcttgctgttgatcagacacagtgtttgctcaactttcttttcaagccctgtgatcacatgctccctgcataaaccttcagggcggctaaacagtctagttccgttcaaaacgacgaacatcattgatctgtatcgagatgattgcgtcaactacgcagcgttagtgtaacacaaccgccgccacctgcaacttagtcattggggatgttcttaaacgaccagtcaaaaggtatactctttgatttaccgcccacaaatctgaccgcctccgccaaaactatggcggtttactacgatgaatcgctcaaccgcgactactccgtaaccggttgaactaaaaccgcaggtagatgccttgcgcttttttgcgaaaagccagcatggttggaattcctcaattcatcgaagtaaaccggcatagtttcgtatttccagcagttccaaattcgtcaatacgtcggcgtttgcgaaaaaagcccgacctccgtgggagatcgggcttatagggctcagttaaaccaaacctacacggtcaaatgacccgcagattacatctgctcaggcgcggaaacgccaacgagggtgagcaccagggcgagcgtcacgcggacggcatcgcaagcggccagacgggcacgcgagagctcggggtcgacgggacggccctcgctcggcagcacctggcaggcagcgtagaagctgtggaagtcaccggcgagttcctcggcaaagtgggtcagacggaacggagcgcgatcgcgagcgcagctggcgatcaggtcggtgagctcgttgagcttgcgcgaaagggcgagctcggtcgggtcggtcagcagcgagtaatcgacgttctcaccgatggccttggcggcaacggccttcatgcccatctcgtcggcctgctcggcggtaacgtcggcggcacggcgcaggatggagcacacgcgggcgtgggcatactgcacgtaatagaccgggttggagttgtcgcgcttcttaacggcctcgatgtcgaagtcgaccatctggttggagctcttggagatgagggtgtagcgagcggcatcggagccgacctcgtcgacgagctcctgcagggtcaccatggtgcccttgcgcttggacatacggacgggcttgccgttacgcagcaggttgacgagctggcccagcagaacctcaaacttgccgggatagccaagagcgtcgcagacgcagcgtacgcgctcgatgtaaccgtggtggtcggcgccccagatgtcgatgacgtgatcgacgcgctggaacttatcccagtgataggcgacgtcggaggcgaagtaggtgtactcgccgtcggacttgatcaggacgcggtccttgtcgtcgcccaggtcggtggaacggaaccacagggcgccgtccttggtgtagaggtagcccatcttgtcgagcttctcaaaagcgcggtcgacggcggaggtgccggcggtctcgccctcggtgtccttcacgtacagcgagcgctcggagtaccaacgatcgaagtcgcagttgacggcgtggcagaggtcgcgcatgttgtcgaccatcttcacgtagccgcgctcacggaagctctccatacgctcctgcggatcggcgtcgacccacttgtcgccgtcggtgcgccagaactcggcggcctcgtcgatgatgtagtcgccgccgtaggagtccttgcccagagtctcggcaaagttgtcctgatacggatgggtctcggggtgctcgtcgttctcgtcggcaacaaaggcgtcacggtcggcgatcagcagcttgtgagcctcgtcgatatcaacgccctgcttggcgatgatgtcggcaagctgcatatagcgcgtgctgatggagttgccgaaggtgttcatctgagagccgtggtcattgatgtagaactcacgctggatctcatagccggcgtggtccataacgcggcagagcgaatcgcccagcgcggcccagcggccgtggccgatgtgcatggggccgacgggattggcggaaacgaactcgacctgggtcttcaggccaccaccgacgttggacttagcgaagtccatgcccttctcgcgagcctcgccaaagatggcattcttgacggcaacggagaggtagaagttgatgaaaccggggcctgcgatctcaaccttctcgatcgcgggatcctcgggcatatgggcaacgatggcctcggcgatcttgcgcggggcgcagtgggccagcttggcggacttcagggccatggtagaggtccactcgccatgagaagtgtcagccggtcgctcgatagcgcaatcgtcaagttcaaatgcggaaaggtcgccggcctcctgggccgcagcaagcgcagcgcgtaccagctcttcaatcttctcgggcatagatcctccttgtgttaaagcccccgagctcttggtcactcgtagggcaaaagccagagtttgtagcactctatcacaagcgacggacactgtcgcagggtaaagctaatagatattgcatatgcacataattgactacagcttgtatggagtcactcaaagatgccgttctgcctgcagattatgcaggcgttgaaaatgcataaaggtgtgaatgagctgcgtctgttatcgaatactcttacctatcagagttgtgtgcttttcctgcataaagtaagggtttgcgcacgtcagcgtgttattctagacatacgtaaattcgtataagttggaggtagcatgttctcaatcggtcaacacgtcattcatccgggccagggagtctgcaccgtcgtcggttttagggacgatacaccgcagcccatgctgctgctcgagaccaagcagggacatgcgcagacgatcctcatgtaccccgtggcgcaggccgaccgtttgcacgccgccatctcgcagcaagatgccgagcacctgctgagccactacgacgagctggagtgcgacacctttaccgagcgcaacagctcgcttgaggagacgcactttaaacagcagctcaagctgggcgcgcccgagacggtccgcgtggcaaagaccatgatgcaccgcattcgccaggccgaggaagccgataaaaagcccagctcctactacatgcgcgtactcaaggaggccaaacgccgctccatcgaggagttcgccgtggcccttggcgtcaccgaggaggccgccgaagcccgcctagcccaagccgccctcaactaacccacccgcgccaaaaaccaccacaaaggggacaagcacctttgtggtggttttcttgttctagtagtattcattcttagcgatacccacgagcacaaggagtcacttatggcagagccgcttaccgccggaatcacccgcgaccgcgcgttcgaactgctcaacgagcacaacaaggacccgttccacatcacccacggcgagacggtcgagggcaccatgcgctactttgcgcgcgagttcgaccctgagaacgaggagttttggggcatcgtcggcctgctgcacgacctggattgggaggagcatgaggatgaccccatgaaccacaccatctatgcggccgagatcctcgagggcgagggcgcctctcccgagctcattcgcgccatccagacgcacacgtccgatttcaacacctcgctgcccaagcccgagctgcagatggagaagatcctgttcgcctgcgacgagctcaccggcttgatcggcgctgccgtcatcatgcgtccgagtaagagcgtcatggactttacgaccaagtcgctcaagaaaaagttcaaggacaagcgctttgccgccggatgctcgcgcgacgtgattacgcagggtgccgagatgctgggctgggagctccccgagctcttcgaccgtaccatcgcggccatgcaatccttcgctcccgaccgcgacaccttccaggcttaattccaaaaccaccacaaaggggacaggcacctttgtggtggtttttgtttgtgcaggcgttaggggcggacctggccggtgcctcggagcttgtatttgtaggtggtgagggcctcggcggcaaaggggccgcgggcgtggagcttttgggtcgagatgccgatctcggcgcccaggccaaactcgccgccgtcagtgaagcgcgtgctggcgttggcgtacacggccgaggcatcgaccgcgtccaggaagcactcgcaagcatccgtgtcctcggcaacgatggcctcggagtgcatcgtgccgtagcgattgatgtgtgcgatggcgtcgtcctcgtttgccacgactttcacgctcatctcgagcgccagatactcgcgaccccagtcctcctcagtcgcggcaacgtagtcatcgccctcggcaagcccggcgtcggcgcatgcggcgcacgtggcctcgtcgccgtgaatgagcacgccgtggtcatgcagcacggccacgaccgcgggcaaaaacgcatcggccacggcacggtcgaccagcagcgactcggcggcattgcacacgcccacgcgctgcgtcttagcgttgacgataatattgagcgctttatcgaagtcggcggattcatgcacgtagatgtggcagttacccgtgcccgtctcgatcaccggaacgagcgactcgcgcacgcagcgctggatcaggcccgcaccgccacgcggaatgagcacatcgacgacgccgcggagcttcatgagctcgccggtggcctcgcggtcggtagactcgatcatcgacacggcctcgcgcggaaagcccttggcctcgagcgcatcggccagcagttcggcaatcatggcacacgagtgataggccagcgagccgccgcgcagaatgcaggcgttgccggtgcggatgcatatgcccgcggcgtcggccgtcacgttggggcgcgcctcgtataccatggcgaccaggcccaacggcacgctcacgcgggtgaggtccacgccgcttgcgagcacgcggtggtcgagcacgcggccgacaggatcggacagctcggcgagcttctccaggccggcggccataccctcaacgcgctcgggcgtcagcagcagacggtcgaggagccccgccgaggtccccgcatcgcgcgcggcggacatatcgagctcgttggcggcgacgatggagtcgacaccgttgcgcagtgctgcggccatggcgcgcacggcctcctggcgctgctcgtcgctcgccgtggcaagcgaggccgacgctgccttagcggcaacggcaagatcgtggacatacgtggctatatcgaccgacatgggcggccctttctcctagaagtttgcaaccatggtagccgatttgcgcatggcctcgcccgcggcggtagaattggtcaacccgaaacaccgcaacgaacggaagactcacatggccctcatcacttcgtaccacgtccccggcctgtatgtcgaggaccacagcatcgacgtccccctcgactggcgcggcctggagccgatgctcctggccgtcggcagcaccatgcgccgcggcgccatgccggcgcccatcgcaggtgcgcccgaaagcatcaagctcttctaccgcgtggtttgcgcacccgaccgcatcaacgacgacctgccgctccttctctttttgcagggtggccccggtggcgagagcccgcgtccgctgtcgcccacaagcgatggctggatcgaagaggccgtcaagcatttccgcgtcgtgctgcccgaccagcgcggtaccgggcgcagcagctgtgtagacgggcgcacgattgccgcactgggcgagcgcgccgaggcggccggctccgatgctgcccgctcgcaggcggacttcctcaagcgccacctcgccagctccatcgtgcgcgattttgagtacctgcgcctggtgggctttggcggcaggccctgggtcacgctcgggcagagctacggcggctttttgacgttgagctatctgtcgctcttccccgagggcgtggcggcaagctttacctgcggcggcattccgcacgtgccggcgagcgccagcgaggtctacgcgcacaccttcccgcgcatggccgccaagacgcagcagtattacgaccgttaccccgccgatgtcgagcgcgtggcagccctggccgatgcgctcgaggctcagaagcccgtgctgcccgacggctcgccaatgacggtcgagcgcctacagctcatgggcagcgactttggcatgaagccgagctttgagcgcatgcattggattatcgatcacgcgtttgttacaggcgacggtacgctgagctgcggctcctcggtatccgacagctttttgatgcgcgccttcgagcgcaccaacacgcgcacgaatccgctgtactggacgcttcaggagttcatctacgccgacggcgacaccatgcccattcgctgggccgcagctgaagagaaggcacaccacgccgagttcgacaccctcgcgcgcccgctcatgtttaccggcgaggccatgttcccgtggatgttcgagcagatgcccgagctcaagcccttcaagcccgccatggacctgctgatggaagacaccagctgggacaagatctatgacccgcagcgcctggcctgcaacgaggtgccgctccaggccgcggtgtacttcgatgacatgtacgtcgattcgagtctgcagctcgacacgctcagccgtgtgggcaactcgcacgcctgggtaaccaacgagttcgagcacgacggcctgcacggcagtgtggtattcaagcacctcttcgacgagtccctcaaccgcggagacctgcgccgaatcttctagcaaaggagtgtccccacctgccggcacaataggaacgtccccaagtgccggaaaaggagaggcagcactgctggcaaaacgagccgcagcgctgcctctctttatgcaaacactatcaagttgtccctatggattgcgggcttctcggccaggtctgcgagcaggcggttgctggcaatctggtcctggcggcggccggcggcaagctccagcacgtccgaatcggcctcggcgataccgcgggcgacaaccatgccgctcgggtcgcacacgtcgagcacatcgccctcggcaaactggccatcgacctcgcgaatacccaccgcgagcagcgacgatccgcggctgaccagcgccttcgcggcgccgtcatcgaccgtcaccgagccgtgcgccttgtcgcccagtgcaatccacaacttgcgcggcgcaatgtccaggcgctccgccggcggatcgaacagcgtacccacgctctcgccgcgggccagacgcacgagcgcatcgggctcctcgcccgagcaaatcacgctttgaatgcccgccgtcatgagaatgcggctcgcgcgaatcttggtgatcatgccgcccgtacccaccgatgtggaagaatcgcccgccgaggcgataatcttggcatcgatcttatgcacgaccgggataaactcggccgtcggatcctcatgcggattggcggtgtagaggccatcgatgtccgagagcgtcacgcacagatcggcggaaaccagacagctcacaagcgccgccagcgtgtcgttgtcgccaaacttgatttcgtcgacggtaacggtatcgttctcgttgacaacaggcaccacgccgaggtccaccaggcgaagcagggcgtcgcgcgcgtgcaggtaggacgtgcggcgcgccgtgtcgtgacgcgtgagcagcacgagcgaggtgagcaggtcgcgcgcatggaactcctcgtcgtaggccgacgagatgatgcactgaccggccgaggcgcaggcctgcaggctcggcaggtcgccgaccggcttacggccgaagcccagcacgggatagccgcaggcaatggcgcccgagctcaccacgatcaggcgccagccaagctcgcgcagcgctgcggcctggtcggcaagcccgccgataaaggcgcggttgaccttgccgtcggcgcccaccaccgtggacgaaccgatctttaccaccatcgttttataagaagtcgtcatacgtcaaaccaatcaactgttcagcgaacggccgaggcggcggccagggaagcgtgactcgcccctaccgcccaaggaattagtgagcccagggaaaggcagaggccgcggccatgttcttacgcacgagctcgtcgcgcacctgagccaggccctgctccatacccaccacataggtctgcgggtacaggaagcgcttgaaagctgcgtccagatggtcgagcgcccaagcacagcgctcgcgcgcgtcctggatgctctcacgcggagccaccgcactgccatcgcgcacgatcggcaccagcagctcgcgatactcgagttcggacacgtcggtcaccagggcggcatcgttcacggccacaagggtattgccgcgcgcggcgccctcccccgccagatggtcctcgtcgtagatcatgtcgcagaccgggccgccaaagccgtcgtaataacggcgcacgcgttgcacacccgggatcgtgcgtttgtatggctgctcagagagcttgaccaccggcgtccatggatctgcctcgctcgcacggcgggcggaaagcttgtacacgccgcccagcgccggctggtcatagcaggtcgcaagcttggtacccacgccaaagctgtcgatgggcgcgccctggtcgagcagcgactgaatcgtgtactcatccaaatcgttagaaaccgagatccccacatagggcaggccctcggcatcaaaacggccgcgcacatacttggagagcttggcgaggtcgccggagtcgatgcgaatggccgacaggcgctcgcccaccgcttccatctccttggcaaccgtaatggcatgttcacagccctcgcgcacgtcataggtgtcgatgagcagcgtacagttcttggggctcgacttggcaaaggcgcggaaggcctcaagctcggaatcgaagctcatcacccagctgtgcgcatgcgtgccaaagacgggaataccgtagcggcggccggcgagcacattggacgtagaggagcagccggcaacgtagctcgcgcgcgcgacggccaagccgccatcgggaccctgagcgcggcgcaggccaaactcggcaacgggacggccgtccgccgccagcaccacgcgcgccgtcttggtggcgacaagcgtctggaacccaacgatgttgagcagcgccgtttcgagcagctggcactccagcgcgggaccggtgacgcgaaccatgggttcgcgcggaaagacgagctcgccctcggggacggcgtcgatgtttacatgtgcacgaaaatcgcgcaggtagtcgaggaatgcaggcttgaacatcgcgccgccggccggggcctggagtgaggcgaggtagtcgatatcctcgggcgtaaagcgcaggttctcgaccagctcgggcagctcggcggtgccgcacatgacggcataggcgctgccaaagggatggtcgcggtaaaacgcggtaaaacaaccctgctcattggccttgccgctctcccacaggccctgggccatagtgagctcgtacagatcggtgagcattgcaatgtcggtgggatgagagatatcggtcaaagccatggggcgacctttcggatgcgttgtgcagaggttgagggttggcgaggcgggcgtgcgggcatggagcccagcgcgaacaggctagtgcagacccatgctggtcaggatcgtgtagcccataaagatgacaaacgcgatgagggcaaggacaatgatgattttttgagccggcgccatgccagggatctcgttctcgcccgtaggctccttggaggtaaccatgcgctgggcaaaggtcatctcgtcacggctcggcttgggctcgacgggcttggaacgagcgacctttttaggctgaggtttaggtgcggtgggcgcgggcttcgcggcggcgggcttgggcgcggggacgacgttcgcggcggcctcctcggccttcgcacgctcggcacgcagggcggccagctcctcacgctcgcggcgtgcctcttcctgggcctcgcgacgagctttctcggcgcggagctcttccaactcggcgcgttcctcggcagacagtggttgggactcaagcttggccatggtacagccctttcttttaaaaaaagccgccgacacaatgtcagcggcttatcaaatccaagggtggagacgaagggagtcgaaccctcggcctctgccatgcgacggcagcgctctcccaactgagctacgtccccaagacaagttgatattttacctacggctcgccaactgtcaacgcccaatacccagtctttttgggacgcggctattttgacaacttttcgagcaggcgatcctctcgatgattttttaatccccgtcccagaaaaatcatcggcgagcgcactactttgcgctggtgaggacgccggtggtgtcgaacgccggggtgaagctctcgtctaccgctccgccttcttgccaaaacatcgtcgtaaagcccaggtcgtcggcatggtcgagcacctgctcgtactcctcgcgcgtcacggcgcgcgccaggtcgccgccttgttcgcgcatgagggcattgggcgtgtactggttcatgaccgagatcggcacgtcgcccaccgtctgccacaccaggtccaacacgcggcacgaatcgtccgcatgccccggcagcaccagatgacgcacgattatgccgcgcttcatgagcccgtcctcgtctaccagctctcccccgcggcgctcaatttcgcgcgccatctgggccagacccgacacagccacgcgcgggtagtccttaatatgagaaagcgactgcgcaagcccggcatcggcatatttaaaatccgtaagccacacgtcgaccaggtcgcccagcgccgccacggcactcgcgcgctcgtaaccactcgtgttgtagacgatcgggatgaccagtccgcgctcccgagctgcggcaatcgcggccggcagcaggtgagcataatgcgtcgccgtcaccagattgatgttattggcaccttggtcctgcagctccagcataatctcgaccaggcgctcgggcgaaatctcaagcccaaaattgcccgtcgagatctcgtggttctggcaatagatacatttgagcgagcagccgctaaagaagatcgtgcccgaaccggcctcgcccgagataggcggctcctcccacatatgaagcgccgcgcgggccaccttgagcgtgtcatcggcaccgcatacgccgtgcgcaccctcgtcgcgcaccgcaccgcaacggcgcggacacaaatggcaggcgggcgaaaaaagttcggtcaacggcgtcggcataaaaacatgctccaaaacaacgattcagcagctcaaacgtaaagggaccaaccgcacagacggctcgagcccaaggcgccgtaatcgtccgacacgatttttgtaatgtcaagactggaatcgataaagtgccgctttatgatgtaggtattccgccccccgcggagcaactgggtgaaccgtcgcgtttatttagggagcccacacagtcgtacctagtacaggtatccttcgttgttaaggacgctggaacagtcgatgagggcacccacctgttttaggtgggttcattttcgtaacgtggggggtggtttttatttgccgaaaaccaccattacagcccatatggatccccgccggtatcccgacaatccatcgacaacatcccaatatctggtaagcgcgtgattatcgctgcgtgcaattccatgcaccccccttggtcgagtatcatggttcggctatgccctttgcgcttagcaacctttgaccttttccttcgacgcttggcggtttttagattcatggcttcatccccgagctacataccgtatctatgcgtggcagcggcggcctttatcacgaccttcctcacggtgcccctggtcaagcgcttggcaattaagctcgacgccgtcgactatccttctaagcgccgcatcaacaccaagcccatcccgcgtttgggcggaacggcggtgtttttgggcctggtcgttgcctgcattgtgcaaatcctaggcacctggcacctaggctggccgcccgtcctggtgccgcacccgcgccttcacattagctatcccatgctggcgctctcctttaccgtcatctttgcgaccggcgctatcgacgacgtcttccagctcaagcccaagcaaaagctagccggacaggtcctcgctgcgcttatcgcctgtatcggcggcctgcggatcggcgtcatcgtcaacccgtttgcccccggcgagatcatgctcggatggctcgcctaccccatcaccgtgatctatctggtggcattcaccaacatcattaacctcatcgacggcctcgacggcttggccacgggcatctgcggcatcgcgtcgttcaccatgttttcgatggccgttctctcgggccgcatcgacgccgccgcgctctccattgcgctctttggcgcttgcctggcctttttgcgctacaacttcaaccccgcaagcatcttcttgggcgactcggggtcgttgcttctgggctttgcactgggctccatctcgctgctcaacgtgagccgcaccgccgcgctcacctcgcttatcatcccgctcatcgttgccggcgtgcccatcatcgacacgtttagcgccatcgtgcgccgcaagcgcgcccacattagcatcgggcaggccgacaagggccacatccaccaccgcctgatccaagagggctacaaccaaaagcaggcagtgctcctcatctacgcctggtgcatcatgctttcggccggcgccgccgcgattaaccaggtcgaggtgcccatgcgcgtgctcatctttaccgtactcgccattggctcggcggcctttgccaagcacctgcacctgtttgagcccgtgctgcgccaccattacaacaagcgcacgcacgaggacgagctcgtcacccccgacgatcccgcctttaagcaggaggagcaggcggcagaagaacgcagggaggagcgccaccacaggcgctagggtaagctgccgaggatgcgcccaggcgccgccggccaaacgcgcagccacgccgcgcccatcgcacatgccgccgctctcccgcccctcgcgtacttacgccccgaccctccaataaacgcgttatcatcttgacccatgaacatacgttaggagcaatcatgccaaacgagaacagctacgaggtcgcgctgcaaaagagcaacgccattcgcgagggcctggccaagacgcccgacaagttcaccatgctcaccggcgaccgccccaccggccgtctgcatctaggtcactacttcggcacccttaagggccgtgttgagctgcagaacatgggcgccaagaccaacgtgctcatcgccgactaccaggtcatcactgaccgcgacacgaccgagcacatccaggacaacgtgtacaacatggtcatggactaccttgcctgcggcatcgaccccgacaagaccatgatctacgcgcactccgccgtgcccgccgccaaccagctcatgctgccgttcctgtcgctggtctccgaggccgagctggcgcgcaaccccacggtcaaggccgagatggaggcctcgggccacgagctcaccggccttctgctcacctaccctgtgcaccaggcctgcgacatcctgttctgcaagggcaatgtggtgcccgtcggtcgcgaccagctgccgcacatcgagctcacccgcaccatcgcccgccgctttaacaaccgctacggcaaagtgttccccgaggtcgaagcgctgctgtccgagaccccgctactgccgggcctggacggtcgcaagatgagcaagagctacggcaacgccatcaacatctcgatgaccgcggaggagacggcaaagcgcatcaagaagagccagaccgattctgagcgcatgatcacgttcgatcccgagaaccgccccggcgtatccggtctgctttcgacggccgccatctgcaccggtcgttccgaggtcgagattgccgaggagattggcatgggcggctccggccaactcaagaagtacgtgaccgaggccgtcaacgagtacttcgcgccgatccgcgagcgtcgtcagcgctatgagaacgatctggactatgtgaaggacgtcctgcacgagggcaaccgtcgtgccaacgagatcgccgagcagaccctggccgaggttcaggacgccatgggcatggtgtactagccgagaacaataaacagcagtcaaacaaaaccgccgcgatgagtacaatcctcattgcggcggttttgttttcttcagaggtcggtcgccgaggtattcagccgctcggcagaacccctaagtcgcaagcaccctaagactatattctgttaagcaatgacgccctattgttttaacatgcggcagcgttttacagcagagccgaccgactggaaggagccccatgagctcagttgcgttttgtacatgcaacgaccggaaatgcccgtttaaccctgtcaaccacgacaagggctgcacgccttgtatcgccaagaatctgcacgagcacgagattccaacgtgcctgttcaacgcgatttcccccgatcggcttgaggccgataaagacgagtggtcgtggcaagcgttcgcgcggcatgtagaggcgtatctgggaagcaacagcccaagaatccccgcgggcgaagagacgccgcaggggcttacaaagatcggttgctgcaagcgggactaacaatcaaagtttgtgccgccctaaggccaaacgtcggcacctcattttgggataacggacctgatgttttgtcccatgattacgggaaagcgcccgccggccatggcagccgacgggcgctttcccgaagtacaccgttgaatcgcacagaggggaggaatgcgaatcaaactcaacagggcaggctttttcatcgcctattgcctgctccgttgctgaaaccaatatagttcgccgtggtttactttgtagcgacaataaacgccgccacaccttctccataagttagctcaggtaaactaaaaccaccacaaaggggacaggagcctttgtggtggttttgacacgaacgagtcgctacagcccggcaggccaacgacaggcacccagatcgacgtgcctgggatcggcaaacgtcacgcccttccctagcaaaagctcacgttgagcatcggggccgccaaacgcaaagccctcgcaaatgcggccatcggcaaacaccacacgatggcagggaatctgaccagggcgcggattgctatgcagggcataccccacgtaccgcgcactccgcggacgaccggcgagcagcgccacctgaccgtaggtggcgaccatcccctcgggaatctgctcgaccacctcgtacacccgctcaaaaaagccctcagacgccattgctcgctcccttccacccggaatagcctaaaccaccacaaaggtgcctgtcccctttgtggtggtttatagcaagtcggttagttgacgggctggaagaaggctacggctacggcgccgggacctacgtgggtgccgatggtggcgccaatggtgtggacaggcagttcgtcctcggtgtggccagcccacagtgccgcgctgtcctcgatatacttcttgagcaccgcatccgaaaggcccgtatagccgagcgccagcggcatggaaaagtcgatgccgcccgccttttcgaccttctggttgagcaggttacgtccgttcttggaaccgcgcgccttgcccagctgcacgatcagaccgtcctcggcagccaccacgggctttacgttgagcagcgtacccacggcaccggccgcagcagacaggcgaccgccgcgcaccaggtactccaacgtctcgagcaggccgatgacgaccacgcggtcgcgcacggcctcgacagccgccgcaacctgagccgcgccctggccctcgtccaccaggcgcagcgcatactcgaccagcacgcgctcgcccaaggtcacgttattgctgtccacgacgaacatgtcgccgcccggcgcctcggcaagtgccgtacgagcactctggttggtgcccgagagcttggcacccacggtaataatcacggcctcatcgccggcctcacgcgcttcggcaatcgcctgcgaaaaggcgtacgggttgacctgaccggtcttgggcagttcatcgcgctccacaagcatctcgtaaaagcgctggtgatcgatgtcgacgccatccatatacacatcggtgccaaaggtgacggacagcggcagaacacgcagagcggggtgctccgccggcgacatatcgcttgcggaatcggtaataatgcggacggacataacgaatcctttcttgcgcaggtcccgcgcggggaattttgacagcaatgccccggcacagcatacgcgctcaaacgggactatgcagtttttaatgggaagcaaatgccttggcggccttagatctcacgcagggtgttgagaatcgtacgcagcgacgcatacatctgctcgcgctgctccacacccatagccttaccggtggtgtcgagcacctcgcgaatgatgcggtccgcctcgctcatgctctcgccgcccagagcggtcaggcgcaccggggcacgatacttaacggccgcatcacccgagtcgtcgacctcgacgtagccgccctcctccagatgcgcgagcgtgcgcgagacggcggcacgggtcacgcctgccatgcgagccaggtcagcgccagtcaggccgtccttgctgcgctcaagatagtacaggcacataacgtcggagcccttgaggcccagccttgcgccctcggatgtcttaatgcgctggatctccttgtagagcccgctgatcagtccgacaaagtcctcgaaacgtgtctcgtcgttctgctgcatgggagacgaccgcctttcgcttgcatgatgctaacgggtaaacatcttagccgcacaaggcaacacccatacccaaatatcccatttgttaacccatcaacataaaaaccaccacaaaggggacaggcgcctttgtggtggtttggggcatcgagtttgatccgcaggcgtcgttacagttccacgcagggattgtcgcgggtcacaagcgtcttaacgacaaccgtcgctcccagatagcgctcgagcaactcggcgagacgatcaacggtagcctggcaatcccccatccgctcgggctccacgcactcaatcgccaggaatgcatcggccgaatcgtcggacagcgccgtgcgaacgccatcgcgccagttccagcagcggcatacggcgcccgcatcatcgatgtaggcgagttcgccgggcagcgtcgggtcatccgtttcctcgccaagtggcaggaacgcatcgccgccgtcagtcaccttcaagcaaagatccccctcaatcgcatgcaggtcctcgccgccaacgggcagcgcgtaggtcagcgacaccgtgttgtagatgtccaccgcgggcgtaatgtggcccaccggtttgcccttgagcacgcgcttgagcaggttctcaattgagcaacgcgcgccctttttggtcttgaacagccgataagcctcacgccatgccttaaccggcgcattctcgctgatggtatcactcgtcaggtgacgctccgcatcgatattggcgcggtcgagcaacgcggcaatcgcatcaacgtcctcttgaggaatctgagccgcgggcttcatgccctttacgaccacaacaccgacagccgcctgcggaaatagctcccaaaacgaatcctcggcaataaagctcttcatgcgctctcccttcatagcatgcgcccgagcccgggtgcctaaacaaaaagcacccttacgacggccaccttcaaagtcctacggtgccgccacaagagcgcttacgctgcccccatccggagaagggagcgatatgtcaggcgtattgtaacccgagtcatccgcgcgagtaaaaccaccacaaaggtgtcccctttatggtggttttgggtctgaagcaacgttagtgtcggagtcccagcaggccgcggccgcgatgacgggcgtcggcgtgcgcctgagcgtgcggaccggcggccttgacggactcgggcaggtgcgagtacttcttctcgaagttctcctcgaacatcaccgccagattgtgcgcggcctcgtcatagcgcgcggtgctctgccagtactggcgcggcaccaggatgccgtcaggcacaccgtggcacgtcgtgggaatgtcgacgttaaagatatcgtcgtggacgaactcgctgtcctcgatggtgccgtcgagggcgcgcgcgaccagggcgcgcgtgtaggccagctcaatgcgatggccaacgccgtagccgccgccgatccagccggtgttgacaaggtacacacgcgtgcggccgtcggcgatgcgctcaccgagcatcttagcgtagaccatggggtcgagcggcataaacggctcgccgaacagcgaagagaacgtgggcgtgggctcggtgacgccgacctcggtgccggggatcttggccgtaaagcccgtcacaaagtgatacatggcagcgtcggccgtcaggcgcgagatgggcggcagcacgccaaaggcatcgcaggtcaggaagagcacgacgcttggagtggtgcccatgcccttggtccacgcgttgggaatgtgctccacagggtatgccacgcgcgtgttgtgcgtgatcgagatgtcgtcgtagttgggcttgcggttctcgtcgagcaccacgttttcgcagatcgcgccaaagcggacagcgttgaagatctcgggctcgtggaacgcgtccaggccctcgcatttggcgtagcagccaccttcgatgttgaagatgcccatgtcggaccaaccgtgctcgtcgtcgccgatcagtaggcgcgtggggttggccgaaagcgtggtcttgcccgtgcccgaaaggccaaagaacacggcggtctcgtgcgtgacgggatccatgctggccgagcagtgcatgggtagcacgtcgtcctcgacgggcagcaggtaattcatgacgctgaagatggactttttgatttcgccggagtaaccggtgccggcaaccaaaatcacgcgctcctggaagttgatgaccacggcggcgctggagttgaggcccttaatggcgggatcgcactggtagccgggagcggcgagcacgcagaagtccggctcgccggtgcgtgcgatttcacgggcaagcgggcgggcgagcatctgcttaataaagagcgcttggctggcacgctcgcaggcgacaagcaggcgacgcgtatggttgcgatcggcaccggccataccgcgagtgacgaacacatcgcgctcgttgaggtagttgacgataccggccttgatggcctcgtagctctcggcagaaagcgggcggttgacggcgccccaggcgatcttgtcgtgcacgtcgggcgtgtcgacgataaagcggtcgttgggcgaacggccggtacgctcccccgtctcgatcaccagcgcgccgttggatgccatgcggccttcttcgcggcggatagcgtgctcgacgagctccgcggcgggtagatcgaccagcagacggggttgattctcggcgggatcttcgaccagcgcaataccaaagttggacagaacttctgcaggggtaacaccaggcatggggcctcctttaaaagcgcgacacgtggacgcggcgcgcactttactcacgtaaagcccgttgtacccgatatgcaaaaacgtttttgcggcaacggcgaagcgcccgcccaacggtcaaaaatcgcaggcaagcggcctagtcgttagggacactcttgaacaggcaacaaccaaggagcgaccccggatgccggcacttagggacgttcccaaagtgccggcacataaggaacgtccccaaatgccgtctactgaatggcgccgccgaaattatcgaacaacctgttcaaaaacacgaacgaacaccgtcgcgtctatactagagcgtagcaatagaaaggactccgctttgagcatcacgcccatcgatagcattcgccgcgccatcgcccgccgcaatggcgtcgccgaccccaccgtatcggacggggcgcacgggcagggcggacgcatcgagaacggcctgttccccgcatcgcacaccgccgaggagctcgcacgaatccaagagctaagccagcgtaacgccggcggtcccgacagcagccaggccacacgccgtcgccgcgagcgcgatcgccagcccggccccatccaccgcatggtcaatgcctggtggaaccgcctgctcggagccgtctacggcggcggcttctccacgcaagaagccgagtacgaagatcacgccacccgtcgcgactacctttggaataccctgggcaccgccgtgtggggcatggtgtttccgttgctcaccatcgtgtccacacagctcgtgggcgccgaggaggctggcaaattctccatcgcctttgtcaccggcacgctcatcatgatcgcgtgcaactacggcgtgcgcaatttccaggtctcggacatcgacgaaaagacgtcctttgcctcttaccagctcaaccgctggatctgcggagcgctcgcgctggcatgcggcctggtatacagcagcgcccgcggctacgatgcgcagatggccacaatcggcctgggcgtctacctgtataaggtgatcgacggcattgccgacgtgtacgagggccgcctgcagcaggccgacaaactctacctggccggcatgagccaaacgctacgatccgtcggcgtcatcgcggtctttagcgtggcactgttcctcacgcgcagcatgcccatcgccgccatggccatgggcatcgccgcgattgcctcgctcgtgctggtcaccgccccgctcgccctgctcgaaaccgaaaaatcacgccgtatgagtctgcgcgaggctggtcacctgtttatccagtgcgccccgctctttggtgcgctgttcctgttcaacctcatcgagagcatgcccaagttcgtgatggaaggcacactggcctacaaataccagctgtactttaatgcactgttctttccagcgcaggctattttgttgagcattggatttatctataaaccgcagctcctacgtctgtcgagcatttgggcgaatccgcgcaagcgtcgccgctttgacttgattattgttgccgttatggcactgatcgtggtcattaccggagcgtgcgccgcatttatggcaggccccggcatccccatcatgagctttatgtacggcctcaactttgagcgctaccgcacgctggcactgctaatggttgtcgccggcggcgtcaccgcggcaatcgactttatctacgccatcatcacggtgttgcgccacgccggcgatgtcaccaagatctacctgatctgcttcgccgtaagcgtggtgctgccggtgatcctgattaagctgctgggtctgatgggcgccgtggtgagctacctagccatcatggccctactcctggtgctgctgataatcgagtacgcccacatccgccagcgcatcgagcgcgaccgcaacccctacggcgcctaattagctgccccggtcaccggaatttgcgatggaatcgccccggctggggtctcgttgaagacaatatgcatcacgtaaaactaagtgagtagatttttaccgaatccctgaccacaccgacagagcacaagtctgtgacctgcggttttattgaggcaaatatgttgggtgctcggcatttccaaaaaagtctactcacttagccagcgggcagccaaatgattatttaatccccatcccagagaaatcaattagcgggcagaagggcaagagtagtcaaaaaagccccgtcccaaattagctaccacttgcaccgattattcgcccgggttgatgttcgcgtagaactccgccccatcatcgagccgcaggatgcccacgcgaccgaactcggagccggtggcggcggcgcagtcgatgtcgatgcgatcgggcacgccggcggtatcctcgccacccaggcgcacaatctgcccgcggcccgactcctcatcgagccccgccaggccgccaacctcgcaatagcgcccaagcgacaccgtgggcgtgtggccgctcaccacgaccgggccctcgccctcggcagaaagcagtcccgtcggcgcatcccaatagccgtgacgaatccacagcaggtcatcggacgactgcacggcgagcatttgccgcagcagctcgctatcggcatcgaccgctcccctgccgtcaccgcaatcgacaccatgctcaagcaaaaacgcgcgcgccgcctcggtctggatgccggcatgcaccagcaggtacgggcgctcctcggtctcggccaccgcgtagagcggcagcgcagccatccatcgcacgagctcctcgtatgcctcaaattccatgtcgttgagctgctcgcgcgtcgtccagccaccgttgatatcccaggtctcggcatcgagcggatcctggccaatgatggcatcgagcatgatctgctcgtgattgcccttgagcacgcgggcgttgggcagcgagcgcacgagcttaataacgccgaccggatcgggcccgcgatcgatcatgtcgcccagcacgtacagcgtgtcgtcggacgccagcgaaatcttagacagggcctcgtcaagcgcacgcacgtgcccgtgagcatcagatgtcacatagatcgccatggtacgcctctctttgcattgcagcggaagcccagcgccgcaactaaaacttcaagttgaacttaaacgttacccattgtactccgttgcaataaagctggaaagggtttccgagcagaggcaaagacggcagccgtctatgacgatatcgcgcacgcccgcaatccaaccccataaacccaccatctttgggtacaaataaccgcagacaactgaccgtgccacgccagccacccaggagcggacaccatccatgaaccagatccttctctttatcggcctcgttattattctgtgcctgaccatcaagcccgtcggcaaaaaactccccttccccaccctgctcatctttatcgcgctcggcatgctgttgggcgtcaacgggccggcgcacatcgattttagcgactacgcgctcaccgaaaccgtctgcagcacggcgctgctgttcatcatgttctacggcggctttaacaccaatatcgaccgtgccaaacccgttaccgtgcccgcggtactgctgagcacgctcggcgtcgtcatcactgccggcattacgggtgcgtttgcgcacttcgtgctgggttttgactggattggtggcctgctgctgggatcggtcgtggcatccaccgacgcggccagtgtctttagcgtgctgcgcgagcacaacctgtcgctgagaggcggcaccgactcgctgctcgaggtcgaatcgggctccaacgaccccgtcgcctacatgctcaccgccgtgctcgccacactcgcggccggcggcgacattaacatccccgtgctgctggccaagcagatcatcctaggcgtggggctgggccttgccatcggctggacatccagccgtctgattgagcgcgcacacgcaacggccgaaggcgcgcagaccatcttcttgttcgccgtggccatcgtcgcctacgcgctgccgagctacctgggcggcaatggctttttggccgtatacctggccggcattgtgctgggcgcaagcgacatcaccggtaaggtcgagatggcgcacttttttgacaccctcaccgagatggccgagatgaccatcttctttttgctgggcctgctcgtcacgcccgcgcgcctgccgcagatgctgctgccgggcctggcgctcatggcgtttatgctctttgcgagccgccccatcgccgtcggtctgctgctggtgccctttaagacgaaccctcgccaggttgcactcgtaagctgggcgggcttgcgcggcgcggcttcggtcgtctttagcctctttgccgtggtagccggcgttcccggcggtcacgacctgtttgacctggtgtttgtgattgccgtatcgagcattgtggtgcagggttcgctactgccggcggtggcgaagaaactcgatatgatcgatgcggccggcgacgtacgccgcacctttaacgactaccgcgacgaggacggcatgtcgtttgtaaagctcaaggtgggcgctggacatccgtttgccggacgctcgctcgccgatattggcagcgcgacggacatgctcgtggtcttggtgctgcgcgacggggcgcacccggtactgcccaacggcgataccgtcatcgaggaaggcgaccttctggtgatggcagccccaacgttcgaagagcgtgccgaggttacgctgcgcgaggtcaccgtgacgccccacggtcgcctggccggtcagcgcctgcgcgatgtgccgcaaggcaagcatccgtttattgtagtgatgctcaagcgcgacggccaaacgatcattcccgatggcaacaccctcatatacgccggcgacgaagccgtcatcgccacgctggcgtcgtagtgaccaggggttagctaatttgcgacgaagaaatcaagcgcctagagaacttcatgccttcgctcgcagatttggatttgcccgaggagtaaagcacccctcccccatgtaaccatcctgtaaatcatagcggcgcactcgggttttgctgtgattcggtcgcgcctgacgctccactgtgctaaagtatcccgaacgttcaaacgactacgaggggaactagaagatggcacgtgtgcacaacttctcagcaggcccggccgcactgcccaccagcgtgctcgccgagatcgccgacgagatgatggactaccgcggttgcggcatgtccgtgctcgagatgagccatcgatctagcatgtaccagcagatcatcgacgacgccgaggcaaccctacgccgcctgctgagcatccccgacaattaccgtgtcctgtttttgcagggcggcgccacgctgcagtttgcgggcatccccatgaacctcatgcgccgcgggcgcgccggctacatcgtgaccggcaactttgccaacaaggcgtacaaggaggccgccaagtacggcgaggccgtgctgctcgcgagctccgaagacaccaacttcgaccgcatccccgacatggccgacatcaacgcgcgtattgccgccgaggctgcgggcgacgggctcgactacgtctacatctgccagaacaacaccatctttggcaccatgtaccgcgagctgcctaactgcggcgatgtgccgctggtcgccgatgtttcgagctgctttttgtcgcagccactcgacgtcgagcgctacggactcatctacgccggcgctcagaaaaacgccggcgccgctggcgtgaccgtggtcatcgtgcgcgacgacctgatcgccgacggcccggcctttgcgcagacgccgcagtacatgaaccttaagacccaggccgccaagggctccatgctcaacacgcccaacacctttggcatctacgtgtgcggcaaggtgttccgttgggttgagcagaccggcggacttgccgccatggccgagcgcaactgggccaaggccaacctgctctacgacctgctcgagcacagcgagctgttccatggcaccgcgcaggccaacagccgctccatcgccaacgtcacgttccgtaccggcgacgccgaactcgacgcggcctttgttgcgggcgcggcagagcaccagatccaaaacgtcaagggccatcgcctcgtcggcggaatgcgcgccagcgtgtacaacgccgtcaccatggaggacgtgcaggcgctggccacgtacgtgaaggacttcgaagcgcagcatagtttgagcccgcgatctaactagcccgcaacacgcgggccgaccagccacttcaaaccacttgttataaacaaatccgctaaggagtttttcatgcgcaagattaaaaccatcgacgacattaccaaggacggcaaagtcgaatttggcgagggctacgagtttgtgggcaccgccgaggaggccgacgccattctgatgcgctccaccgacctgcacggctacgagctgcccgagggcatccgcgccatcgcccgctgcggcgccggcgtcaacaacatccccgtcgaggagtacgccaagaagggcgtcgtcgtctttaactcccccggcgccaacagcaacgccgtcaaggagctcgtcctgggcatgttggtgctctcgagccgcggcgtggtgcaatcgatgaactgggtgcgtgacaacgccgacgaccccgagattcaggtcgatgccgaaaaggccaagaaggcctttgtgggccgcgagctcaagggcaagcgcatcggcgtcatcggcctgggcaacgtgggctccaaggtcgccaacgcctgtgtcgatctgggcatggacgtctacggctacgacccgttcatttccgtcgagcacgcatgggtgctgagtcgcgaggtgcagcgcgtgggcacgctcgaggacctctgccgcggctgcgactacctcaccgtgcacgtgcccagcaaggccgataccatcggcatgatcagcaccgagcagatcgacctgctggcgcccgacgccgtgctcatcaactacgcgcgcgaaaccatcattgacgaggacgccgtcgacgctgccctgcgcgagggcaagctcagctggtttagctgcgactttgccacgcccaagaccgtcaagatgcccaacacgtttatcaccacgcattcgggcgccggcaccggcgaggccgaggccaactgcgccgacatggccatcagcgagctcaaggattacctggaaaacggcaacatcgcgcacagcgtcaactaccccgcctgcagcatgggcaaggcgcgcgccgcaagccgcattgcctgcctgcatgccaacgtgcccaacatgatcggccagatcacggccattctcgccaaggacaacgccaacgtgcagcgcatgaccaacgagtccgctggcgagaacgcctacaccatgttcgacaccgatgagcacctggacggcagcacgatcgaggcgctcaagcagattccgtcgatgtatcgcgtgcgcgtgattaaatagcgccggtgccaagcctgccagacagaccacgaagcccattcgcccccccgttttcacgaaacggggggcgattttgttgctccggacgactttaaaatgatacccagaacaagttttttcagataatcgatagtgaggctccagtcgctaagcacacccgctttgataaacagctttatcagggactttagtaggtaaaaatcggtctctatgtgccgaatgtaagttgactgtccattttccgaaacaacttattctaggtagcatttttaaggcccttccaaggcaaaatataagtattttgcgaccaaaactctagtccgcgcgaccattttccgcccgcgcggctacattcccgcccaatcgataaaaatctcctcacgaagccgccgttcgagctcctgctgccgcggcgtcttgtctttcagcggcacatcgagataggacatgatgagctccatcaccacgcggaaggcatcggaatcggccagctgaccataggtcatcagaacgacgggatatcccatggcttgcaaggccgtcgttcgatcggagtccgagatcttggattcaatggatccgtgaatggctttaccttggcattcaaccagacactctctgctgccgtccttatttgccagcaggatatcggcatagcgcctatcaagccccgaaatcaggcgggcactgcgcgtcaagcgaatctcgacgttattggtaaggcgcagcccttcgccgccgcgcaacctcgtaaggccaaacagcatcgaagcctggacctcgagcggcgatgccgccacccccgtaatgcatttcgcggcacgcgtgaacgatttagcgccgcggagccccgggatcttatcgacgtactcggtaagttcagagagctcaatcaagggaggtcgtttccacaagtctgttggattccccgaggtatcctttacgttttcccagcccgaccgtgcgtcaccccaccggcccccgtatgcctgctcaagtgccgactttacctgaggcgcaatcttgcacacggcaaaggtgccgcacatctcatacatgcacatgatcagacgctcgtttgagaccgaggaagccagggtcagcagggtaaagagcggggacgcgacatcgaggccaaactctgtctgtcgcatggaatcaaacggcctctccccgttccaaacatgcctgacaatgcgatcgcccttacgtccgcagctgccctgcgccaacacgtgtaacggggtgcccaggaaatgcgtgacgagcggatgctcacataggtgctccctgcgcggatcgtccgcagaatcgggcaggtccggcattattgccaagacctgtggaggtatccggtgataccgaaaggcagatatgtcgcacagcatgtcgtccatgaagggtacgtacccgctgcgtcgcttgtgaacccgctcggacggcaaacgcgctggctcggcctgcgaacggtaaatactgccacgcccacgtcgcggatctctcaggaggcttacaatcggtttggaaagcaaactgattgtgaggttgcatatggttgatgaggattttgcctggcggcttgcgcaggagcttgtgcggatcgacagctcagacccgggcgcgtatgaggacgagattgagcgcttcattaagaggctcattgagcagcagctggcacaacttgatagttctgcgctcgatgccgtgcagattgaggagctcgaagtgctgcccgggcgccgcaaccttaaagtcaccgtgccgggccaaagcgacgagccgcgactcgtctatatctgccacatggataccgtcaccttgggcgatggctgggacgcagacatcgcaccgcttggggcggttgtgcgcgacgataaactctatggccgcggtgcctgcgatatgaagggtggcctggcctgcgccattgccgcactggtccatacgctcgagcgcgtggcggcggatggcgcgctgccacgccgcggcttttcgctcatctgctcggtcgacgaggaagactttatgcgcggctccgaggcggccatcaatgccggctgggtcggctcgcgcgaatgggtgctggacaccgagcccaccgacgggcagatccaggtggcgcacaaggggcgtacgtggttcgagattgaaatggctggcgtgacggcgcatgcgagccagccttggaagggcgcggatgccgtcgccgccatggccgaggtcgtgtgttcgcttcgtcgcgcgtttgcggcgctgcccgcgcacgatgagctggggccttcgaccatcacgtttggccaaatcgagggcggatatcgcccctacgtcgtacccgaccgcgccaaagtttgggtcgacatgcgcctgaccccgccgaccgatacggccgccgcaatcaatatggtcgagcatgtcatcgccgtcgccgaagccaccgttcccggttgccatggcagctacaccgtgacgggcgaccgccccgccatcgagcgcaacccgaactctccccttctagcagcgctcaagcgtgccgccgatgacgtaacggacgcggacacgaccgtcggcttctttaccggctacaccgataccgccgtcattgccggcaagacaggcaaccgcaattgtatgagctacggccccggctcgttggcgctcgcgcacaagcccaacgagtatgtgccccatgccgatatcgttcgctgccaaaacgtgctcatcgcgcttgccgataacacgctctgggacgcaagcggccaagttggggcataataagccgcgaacaaaccgactcgcgcgttaggaccgtccatgaaagctcttccgtttccctgcatccgcccggctcaggaccgcgtgctcgaggcgctgcctgcgatggacagcatcctgagtgacagcggagccctgcgcggcgcgattaccgatgggcttatgctcaaagatccgggcgcggcgtattacgtgtacgaatgctccggagagccgggacgcgtgacgggtgtcgtggcgatttgcccggttaacgtgctgacgggcggcgacgaggctgccgccgagagcatcgacgcactcgccaccgcgcgcgcgatcgccgagctcaaggtgcagccgcgccccgtgtcgctcgcctacgaggcgtcgcccgtcatggatatcattttgagcgctgccaaagagggcgcatcgctctacgccgtcaccgatcccgcgggcgtcacacatcgcgtgtgggaggtcaagcgcgaggacgccgttgccgccatccgtgccatgctcgatcaggcgcccgacccggtgttcgccggtgactccgcctatgtcgccgcgctggctggggcatcgcagattctggccgacgaggcccgcactgccgacgcctactctggcaaagagccgttcaactttgctgtagccgtgctgttccccgccgcgcaggtcagcggcagcgcgccgcaggttccgacgggtctgctcactcaccaggtctcacggttctagcgaactcaaacgctaagctggaaaacccagcatccaaacaaacaaggggcggagatgcagcaaacgcatgcacctccgcccttttcgcatcaaacaattacgccggtaaaccgggccgcaacgtcagcgttatccacgctgcggacctgccgccgccacgagcggctctagccccagctcgcgcgcgtagtcttcctgcgtaaagacttcgaccagttcaaacgtatcggccgcatcgtcaaacgcaaaatgcagcactgagcagttgcccggcacgcgttcgcgctcgtcggccgccgcgccccgcacgtggtccaaaaactccttgatagctgagccatgacttaccgcgagcacgcacgtatggtccggacgctgcataagatcggtcagcgtcgccaccatgcgcgtgcgcacctggatctggccctcgccgccaaactgccgatagaagtcgcgccacgggcgctcgggcataagcatcacgcgctcggcctcaaagtcgccaaagaaccactcacgcaggccgtccaggcgctcgtacgccaagcctggccacaagttggcgatagtctgctcggtgcgatgaagcgtagaggtgtaggcatgatcgggctcaatgccgcgcgcacgtaaaaacatgccggcgcgcgccgcctggtcgcaacccaactgcgtaagcggcgagtcactccacccctgaatgatacgcttaaggttgaatatcgtctgtccatgacggaccagatacagatctttattcataggggtcctttcgttcgttaccaacccaagagcgaaaacgccccgtcgcaatagccaaaatgaagcacggcaccgttgtcgggtagctctcccccgccagtcacatactcaagaaactcctggcaggctgagccgtgggaaaccgccagcacgcagtcgtgctgcggcctggccatgatgcgggacagcgccgcgaccatgcgcgactgaagccgcacttccgactcgccgccaaaggccaccggataatcgccccagggctgcggcggcatctcgcgatttgatgtgccctccagcgagccaaaatgccactcacgcaggtcatcgaccagctcaatggaacggccctcgccaacgataagctcggccgtatgccgcgcccggcccaacggcgaggaatacacatgatcaaaggccacgccacgcgccgcaaacgccgtacgcgccgtcagcgcctgctcgcgcccgcgcgccgtaagcggcgaatcgtgccagccctgcaaaatgctctgcacattgagctcagtctgcccatgccgcaccaaatacagatctgccacacaccctcccctcgtaccaccacaaaggggacaggagcctttgtggtcattttgccgccggattgcaccgcaacgacgcacaactacagcagcacgtcggcgagcgaacgcttgggtacgtggtgcacctgcgcctcgtcgcgccaataattgatggagccgtcggggttggaatcgatcgcatcgatcacctgtgtctcggccggaacgccaaacgccatgatcagcttgagctcatatttgtcgttatcgagccccatggcatcgatcgcgcggggcgtaaaggccttgaacatgcaggctgccacctcgggcgaggcgctgcgggcggcgagcatcatcgtctgcgcggcaatgcccgtgtcgacctcggtaatgggagcggcgggcttgcccggaacggcgcgctcggccagaatcgcgatgtagccggtcgggcgctcaccctcatcggggcccggccaatccttgagcgcaccggcccatgcaagctcgtcaaatacacgcgcgcagtcctctgcaccgcttaccacatgaaaacgcagacgctgagcattggcgccacagggagccaggtgcgccagttccgccagctcgagcaaaaactcgcgcggcacgcgcatggactcgtcaaagcggcggcacgtgcgagcgcggcgaaccaacgcatcgaacgcatccaggccgagcttttcgcaaccttgctttgccatcgattcgacactcgacggtgcctcgggaactgcttcgttcatagggacccccaatacaagccaattgtccttaggaaaatctaacctaaaacgtaggcaataacgaacagggctgcaatgttctacacctgttgaatagaaaaccgcgacgtggggaacaacggaaacaattcggggcctttgggttacgtttcgccctccccgacccatacgccagcgcctttaagcgatactggttgtaacgatcaaggcttacgccgcacggaaaggagacgttatgggtatctttaggaacgatgaccaaaaatcgagccagtttggatttgacgagaaaagtatggcgggcaaagccgtcaaggccgtgcgctggatctacgccatcacgggcgtcgtggcgctcattgctggcatcgcgctgctttttgcacccgccaagtccctcgtctttttgacgaccgtcctgggtttttactttgtaatcaccgctgccatcaggctgttcactgccatttttgagccactgctgcccaccggctggcgcgtgacgagcatcatctccaacctactcattatcttgggcggcgtcataatcctgcgcaaccaggccttctcgaccgcgacgctcaccacgatggtggttatcgtggccggctttggctggatcgtcgaaggtgtcatgtccattctggagtccgagctttcgtccaaccgtgccctcgccatcctgagcggcgcactctccatcatcgccggcatgttcgtgtttatctatccgctgtggtcggccaagatgctcgtcatctttagcggcgccgcactgctggtgtttggcgtgacgctcattgttcgcgccattcagtttggcaaactggtgcgctagatgccaaagacgctctttattgatgccgacgcctgcccggtcacgcgcgagtcgattgactgcgcgcggcgggcgggcgtcgccgttgttatcgccggcaacagcacgcaaaacctggaacggcacattcgccgcgacgacccgcgcgatgccgagcacgcgcgacgcggcttttgggtcacgacgctcgacgtgagcgtgggcgccgacagcgccgactttgccattgtcgaacgcctgcaggcgggcgacgtggtcgtgacgcaggacattggcttggcgagcatggtgctcgggcgcgatgccgccgccatcggtgtgcgcgggcgcgtgtacgacaaggcgactatcgacatgcagctgtttattcgccacgaggaaaagaaggtacgccgcgccggcggacgcactcgcggtccggcagcatttaccagcgaagaccgcgcccgctttaaacgcaacctcaccgagttgctgcactaaccaaggtagatttttgagacatgcctaaaatctacctttttgttttgagcggtgtgagcgctcggaatccatggctcaacaaaaaacgggcttcaaaatgccatgcgtcgccgcattgcgcaggcgctgagcatggctatttgaagcccattttttaggcctacttagaggccaacggcggagaggatgaggccccagccagcgccgatgacgtacatcatgatcaggaacacggcattttcgcgggcgctgcggttggtgcggaacagcaccagataacccacgccggcggaaatgagcgtgccggcgagcatcggcgccagttgcagcgcgccttccagatacagctgtgtaatgaccacgctcgccgagcaattgggaatcagcccgacaagcgccgaacccaggacagcgagtatctcgttgccgcgcaggaactgctcgatcgcggactcgccgaacgtctcgagcacggcgaccagaatcagcgtcaccagaaaaatgaataccgagacctgcacggtgtgcgagatcgcgctgcggatgatcgacaggacaggcgtcccttcgtgggagtgggagtgaccgtgaccatcatggtgttcatgttcgccctcatgaccgtgatcgtggccatgtccgtgttcgtgctcgtcctcgtcttcatcgcaaccgcaatggtcgcgctcgcacaactcgtggatgtggtcggcgctcacgcccgcctcggccacctcgtcgatgatgtcaccgccgctgtggtcgtcgtgcgcgcagttcacgtgggccgggttggccgcggttcccagcacggtacggcgaatcgccgcgtgcgcgcgggcgttacggcgcaggccgcgaatggcagcgtccacgataaaacccgtgaccagtgcgatcagcgctttcgaagccaaaagcatcgccatagtctgcacgggaacctgctcggcaagcaacagcggcagcatctcatcggaggtcgaaaggaacaccgccaccaacgtgcccaaggtcacgacacggccggcgtacagcgttgctgccatggccgaaaatccgcactgcggcaccatgcccagcagcgagccaaccacgggacccgcagcgccggcgcgcttgatagcgccgttgacgcggtcgcccgcaacgtgctcaagtgtctcgagagcaagatacgtcaccaacaaaaacggcaccagcgacagcgtgtccttgccggcgtcgagcagaatatcaatcagtaaatccatgacggatggaacctttcgtgtctttcggcagcattgtaaaagtcctagcggtcaactagggtattgtagttgtcccgggcgcggtgccaatagttgcctatggtaaactatcatctcgccataactcagtaacctcgagccgcacaacgcggcccgtccaaggagtagcatatgaacgtatcgcaagcactcgaatacgagcgccagccgtttatccccatgtttatctacggcgaccacggcgccatggagtccgagcgccagaagggcgaggaggccctcaaggtgctcgagaccgagtactttaccgccgagggcgaccccggcttcgactttgccaccgtgcgcgacctggccgaccgcaaccgcgacctgtgcgaccagattggcgaggcgcgtctgcgcaacgtgacgcccgcgacgctctcgcgcggcctgtccgatgccgacacctgcgccgccatcggcaagatgcaaaagcgcaccgccgcgtccgttatgcgcgaaatccgcggcgaccgcgacgcgctcggcgtggcctacgcccgcaagcccatccagggcaccgtgctcggtatcgacatcgagaccaccggacgtgcacccgagcgcggctatatcatcaacgtgggctgggagatcatggagctcaccagcgacgccgtcccgcatgacgccgaggcacactactgcggcctgcccgacatctaccgcggcgaggatgtgccgttgtcgaatatccaccacatcacctgggacgacatcgacggcaaaaagccgttccgcgagaacaaagagctgcaaaagcagctgctcaagcttatgaagaagtacccgtacatggcacacaacgccgcctttgaggacagctggttcaagatccacctggacggctacgccgaggcacgccgcgccggcaagatcatcgtcatcgactcgcgccagatctgccgcagcctggacgccgacgtgcgctcgctcccccgcgagtccgcccccgccgcgctcgagaactgggcacgccgtcgcggcaccctcgcgcccgacgccaacgagcagcatctgggtctggacgacaccgacctcatgctccgcacggtacaggccgagttcaacctcaagaacctattcgcgaaatagcaacgcctgcgacaaacactacttgctcacgagcggcctcgcagcgggaaaccccgcagcggggccgccctacgttccacagatagatctgccatcacaaattctgaaccctcattttgaacgatttcgaccaattcccaacacgcaattcgttgtcggatggtgatacatcgatatcaaatgtgcagcaattgagtatttatatgctatagctaagctgcgaaaacttttatttagggcataccaactcataattgcgtcaagcttttggacagcatttggttagacctctaaaacggcttttccactcagcgccgtcaacacggcattagctgacacgatatatatcatgagtatcgtattgtcacataccactgcaaaagcggtctaccaggccgcgcattcggtgtctgcgaaaggcatcgagtcctgtaaccctgccgcgatttacggatcatgtcccaccggaacgctccttgacgcagccgcagaatggctcaccaaacatgatgtttcccttgacgcaaatgattgcctcgaggtaatggtgtttgatcgcaggaatgcgcgctatgcaatgaactgtcaatgccacgtttcgtcaaaacgattctcgagctcacgctttatagagctcaaagatggcatcttcattgttggcgttgagctttgcgcacttcaggccgccacctatctcccttttcgcgaactggtggagtactactttgaattgtgcggcgcttactcccttggaaccggctcttccacctcgtataacgagcgtttcgcgctcacctcgaccgaaaggttaaaacagttctttaattccattaccagatgcgacggtctggcccttgcccgaaaggcgattcaatgtgtgcgcgacggatgccggtctcctatggaaacggcctttgtcatgatgctaacgctgcctaaaagcgaaggagggcttggtattaagggaattgagaccgattgcgaggtgcaggtcaccgctgccgcaaagaatctcacgagacgcaaaaagttctttatggatgcgtatctaaagaaatctcgcacagacattgaatacaacgggttttatcatgacgcggaagaagaccgcgccatcgatgaggagcgcaagaatgcgcttgcgtccatgggatacggaatcatcaccgtcagtcgttattcctttatgcatgccagcgctttcgttagggtcatggaggcgatccaacggaaagagggcatacgcccctcgcgtctgccaaaagactttcaaatcatgcaagaggacctgagacagtttgtgctcagaaggtttatagaagagaaaaagagaattcagaagcagcttcgccaggattccgaagatcgtcaacgaatcgacctcgaaaaagcaacactcgaaggcatcacgctggatgacccgacaataaatgaagttccggcaatcgatgacatgcagactgtcgaatccgacagcccatcatttgcccaaataagcagcctcgcgcccgagggcagaatcttcggggccggaagctagaccggctaacaaggtgggtaccctagcgatgtgcaaaattgcgagtattcagcagggtcggccctccagcacccacaagttaatccaaatgaaaaacaaaaacgctatcgaacgggaacgttaggcaacatttgaggaagaccttgtctgtttaccgcccttggataactcttgagcggctttatttggcctggaatagattaacggaccccctatagttgcagaatactccaatttttgcacggcgcgggggcacccaccccggcatcggctatcaaaaccgctcagtccggaatctcgtccactattccccatcattttatgcgacgaattacctgtacgtcattgacatatgaacatgcgctcatataatcggaagtaagttatatgagcgcatgttcatatgaaaggatattgcaatgagcagccacgctgatgaaacaaagactggcatcgaggccaccgagccgatcgtccccaccacctgctcgcccgaggaccttcccgacgaggaacttctctacgaccttgccgacctgttcaaggtcttcagcgacaccacgcgcatcaagattctctatgccctcatgggccgcgagctctgcgtggctgacatcgccgaagcgaccgcgacctcgcagtctgcggtgtcgcaccagctgcgcacgcttaagcagtcgcacctggtcaagttccgccgcgacggccgcaacattctctactcgctcgctgacgatcatgtctataccatgctcaaccagggcatgagccatatctgcgaatagcaatcaaccacggtatcagcgcggccggcacccagaccgccaacacagggaaaggaacccaccatgaaaaagcagtttaagctcgacgagatcgattgcgccaactgcgcgcgtgaacttcaggacgagctggctaagctcgatggcgtcaagtccgtttcggtcaactttatgacccagaagctgacgctcgaggccgacgacgccaagttcgacgaggtcctggaccgcgtcgttgagttcaccgccgacgccgagccggactgcgagatcattctctaacccgcgcacacgttgacctgtaaggccgcgcttgccgcggcctttgctcgcgaaattatatgagcaagtgttcatacactcaaatgggaggtttgaatcatggcagccgccgaccccaaaaagaaaaagaagaagcgcaagaagaaagagtcccttgagcacaagcgcaaccgcatcctggtagcactgggcatttttgccgttgtttatgccctcgacgagctcggcgccctcactatcgcatttggggagcccggcaacatctacgccagcttcgcgctgttcctcgtgccgtttttgattgccggctacgacgtactgcaaaaggcattcaataacatccgccgcggcaaggccttcgacgagagcttccttatggccgtcgcgaccatcggcgcgtttgccatggtgctcttccccgacaccgacccgcacatggccgaaggcgccgccgtcatgctgttctaccaggtcggcgagttgttccaggcatacgccgtgggcaagagccgcaagtcgatcagtgccatgatggacatcgcgcccgactacgctaacgtcgagcaagccgacggcacactcgaacaggtctttcccgatgacatcgccgtcggcaccgtgatcgtggtcaagcccggcgagcgcgtgcctatcgacggcgtcgtcgtcgagggcgaaacccagctcgacaccgccgcgctcacgggcgagtcagtcccccgccccgccaagaccggcgacgatatcatcagcggctgcatcaacatgacgggcctcatccacgtgcgcaccaccaagccctttggcgagtcaaccgtcgcgcgtgttctggagctcgtggagaatgccagcgaaaagaaggcgcgcaccgagaacttcatcacgcgctttgcccgcgtctacacccccgccgtcactggcgctgccgcggtgctcgcgcttggcggcggcctggtgactggcgcttggtccgattggatcctgcgcggcctgaccttcctggtcgtcagctgcccgtgcgccctcgtgatcagcgtaccgttgagtttctttggcggcatcggcggcgcgtccaagctgggcgttctcatcaagggctccaactacctcgagacgctcgccgacgtggacaccatcgtcttcgacaaaacgggcaccctcaccaacggcacgttctcagtcgtcgcggtgcatcccgaggctggctataccgagcagtcgctgctcgaagtcgcagcccttgctgagtcgttcttcgatcaccccatcgcgcagtccgtgcgcgacgcctaccagggcgaggtcgaccccaagcgcgtgagcgactccgccaacgacgcgggccacggcgtgacggcaaccatcgacggcaagcacgtcgtcgttggcaacgccaagatgctcgccgcggccggcgttgaagcaccggactgtgaggttgtcggcacgatcctccacgtgctcgttgacggcgtgtacgccggccacatcgtgattgcagacaccgttaaggccgatgcggagcaaacgattcgcgacctgcatgccgccggtatcaaccgcaccgtcatgctcacgggcgaccgcgaggaggttgcagcgtctgtggccaagcaactcggtctcgacgagttccacgcgcagctcctgccgggcgacaaggtcgagcgcgttgaggcgctactcgcggccgaaagtggcaagggcaagctcgcctttgtcggcgacggtatcaacgacgctcctgtgcttacgcgcgccgatgtgggcattgccatgggcgccatgggctccgacgccgcgatcgaggccgccgacgtggtgctgatggacgacaagccgtccaacatttcccgcgcgatccgcgtggcgcgcaagaccatgtcgattgtttggcagaacataatctttgcgctgggtattaagctgctgattctggtgcttgcggcgctgggcatcgccaatatgtggcttgccgtctttggcgacgtgggcgtggcgatcatcgccatcctgaacgccatgcgcgcgatgggtgtcaagaacctgtagcgtctgtggtccttccggccgggaccgggcttgggtttgaaaacgtcctcgcgcgccgctgaccggtggacggcaccgagccgtctggttgatttgaagaagggggaggtctcgcggcctctcccttttttgcgtttatgagcttctatcacacatagtcgctgtgttttatgaccctcgtttgtcgcatcttccgtgaacgggctacaataactgagtctgtgcaatatggaggtgaacatggctgaagctggtatcggcgttgacatcgtcgagatttcccgcatgaaatcaattcttgaaaagacgccgtcgtttgctcggcgtgtgtttaccgaagaagagtgcgcgtactgcgacgcctcttcgcgtcctgccgctcgctatgccagccgctttgcttcgcgcgaggcggtgctaaaggctctcggaacgggatttagccaaggtgttggccgcaaggatgtttcggttacgcgcgataagctcggaaaaccgaaagcattactttccggtcgcgcactcgagattgctcaagagctgggtgttgttgaggtcgctctttccattacgcttactggagacttggccgttgcaaatgccatcgcgattaccgaagatgctcggcctaagccaaaagatgaaaaggtgagcaccaagaaacgcgttgcgcagacatttaaagaggctcgctctgtattagatgagctcgagcagctgcagaattcagctttgtcggagcacctgggcgatgcttcgcaagatacgctaggagcatagatgaaaccggttttaagtaccgaggaagtcgttcgtctcgaggatattatcgaacgcgaaggaacttcgaaggccgagcttatggagctggcgggtgagtttgccgctaacgagatcttaaagcttaatcccgatcgagtcctcgttctggtcggttttggcaataatggcggcgatggttgggtggctgccgatatcctgagccataagggtgtggacgtggatatcgtctccccagttgagcccgatgagattcccgccgcgctggctcgccacgttgctcgtcgtactgccggccgtgatgtgcacgtttgcgtcggtccctcgcgtgacgagctcgaagtgttgattgataaggccgatgtcgttgtcgacgctatttttggcaccggtttccacgggaatctgcgtgcgccgttctccatttggatccctacggtcaacgaatgcgccgattgcgtcgtgtctatcgatgtcccctcgggcctgaatgccgagactggcgcggttgatgacgattgcattcgtgccgagcgtacggtaacgatgattgcccctaagattggtttgtatagtgccgatggtcctgagtacgctggtgatttggtctgcggtaatctttacgatcgtcttgacgaggttatcgatgatgtggaccatgcggccgagatcgttgagcctggcgacttggtcgattacttcgctccgctgccaacgaatatcgataagtattcccgtggctctgtgctcattgttgccggctctgcgcagtaccctggtgccgccattatggcagccaagtctgctgcccgtgctggtgccggttatgtggcggtcgcaacgccagatgcctgtgctaaccttattcgcatggcgcttccttcgattcccgtctttgctatcccgtccgattcccgcggttcctttggtgctgctgcgcgcatgacggtgtgcgagattgcaaagaagtacagctgcgtgctgtgcggtcccggtatgacgacgtctgctggcgctatgcaggtggtctcgggcttgcttgagcttgatgtaccgctcatcttggacgccgatgcgctcaactgcctctctaagattgccattgacggtatcgatagcaatcccgagatgtatcgtcgtgagcagccgctcgtcatgacgccgcactatcgcgagctttcgcgtcttgttgccggtgacgaggtcaacgatctggggactgcaatcgcggccgcgcagaaggttgtctgggctgccggctctgacaacctcgtcgtcattgccaaggggccgacgacggctatctgtggcgttgagcgcgtgctgttgccgctctcgggtccggcgtcgttggcgactgccggttcgggcgatgtccttgcgggtattcttgccggcacgctggcaaccatgcgtgatgagatggatcgctgggagctgctgtattcgtatgccgttgcgcttcacagctatgcgggttttgccgcggcgacggagttcggcgagaagagcgttatcgcgaccgatttgatcgacttgatcggccccgccatggagttggcggcaaaggatgcgctcgaagatctgggaatcatggacgaagggtcggatgactaatcatgaataaggccgatttgacgcgctggtcctgggttgagatcgaccgcggggcacttcgccgtaacacgagggcttacaagaacctgctcgacccgcgtcagcgtctgtgctgtgtggtcaaggccgatgcctatggccatggtgctgtagagtgcgccaaaatcatgtactctgccggagcagacatgtttgctgtggcgacggtcaacgagggcgttgagctgcgccagggtggaattaccaagcccgttctgatcttgagcgagccgcctatcgaggcaatccccacgttgctcgagttcgacatcatgccttcggtctatacgtccgattttgcgctggcctatggcgaatgcgctgttgcggccggcaaggtgggcaagtaccatctggctatcgagacgggcatgaatcgcattggcgttcactatacgcaggtgctcgactttgtacgcggtattagtttccatcgcggcatccaatgcgatggcgtctttactcactttgcaacggccgatgagccgaccggttgggactataaactgcagtgtcagcgttttaccgaggccgttcaggcgataaaggacgctggctttgagtgcggcatcgtgcattgcgccaatacgccgtcctcaatgctcgattcctcgatgcattttgatatgattcgcgccggcatcggtctatatggcctgcagccgtgtgagttgagcggtcgtgtgatgcagctcgatcccgtcatgagcgttcacgcgcgcgtgacacgcgtggcgcatcctgcgatgggcgagggcgtgggttacggttttacctatcgcgtacctcgcacgcgcgtccagatttgcacgttgccgatcggatacgcagacggtctttcgcgtacgctttccaaccgcatggatgtgctatatcgtggcgagcgcgtgcgtcaggttggcaatatctgcatggaccaatttatggttgccattcagtccaacccggcgcacgagattcccgaggccgagtacggtgacgagatgattattgtcggccgcgacggcgatgccgagattaccatggacgagatggcgcgcctgcgcggcacgattaattacgaggtcgcctgcggctttggcatgcgtctcgacaaggtctacgtgtaggagccaccatgggcgtcatgcacatccccggccatagccatcaggcgccgcgcgaggtcgcgctcgaggagatcgaggcggttttaggcgattgccgcctgtgccagctttatcaatcgcgccataacatcgtttttggcgtgggaaatccccatgcccgtgtgatgtttatcggtgaggcgccgggccgcaacgaggatttgcagggcgaaccctttgtgggagcagcgggcgaggatctcaacgacatcctgtcgctggctggccttaagcgcgaagacgtttatatcgccaacgtgcttaagtgtcgcccgccgggaaatcgcaatcctcgtcccgaggaagttctggcctgctccccgtttttgcgtgagcagattcggagcatttggcccgatatcatcgtgacgctcggcaatcccgcgacgcactttgtgctcaagaccgagatcggcattaccaaactgcgcggcaggttccatcagatggggcactttgtggtgatgcccacgttccatccggcggcggcgttgcgcaacccggcatggcaggagctgctggaggaagactttaagatgctgggcgactacctggagcgacatcccgcgccagagagcgcctcgaactaataaggagcgcatatgtccctggagcgcctgggggtaggtactttcaaaacgacttgcaccgccgatacggagcattttggcgagctggtcgcaccgtgcctggaagatggcgatgttttgattttgaccggcggcctgggagtgggcaaaacccactttaccaagggtgtctcacgcggtctgggcgacgggcatatggttacaagccctacgtttgcgctcatggccgttcacgaccaaggtcgtattccgctgttccactttgacctgtaccgcctggagcatgcctacgagctcgaggatacaggcattttcgatgtgctgggctatgagggtgcttgtctgctggaatggggcgaacagttccaggacgagctgacggatgagtatctttcggtaacgctcaaacgtgatgagaacgatggcgatgtgcgaacgataacgctcgaggcgcacggcgagcgcgcaacggagctttccgatttgattgataaggctgtacaagatgagcttgcttaacgataacgcgctggtggtggcgctcgatacctcgaccgacatgcttgcctgcgcggcaagttggaccgatgtgcagacgggcgaggcgaagctggcgagtggcgaccatctgtgccgccgccacgctaacgttgagctcgtgaataccgttgatggcgtgctggcacaggccggtttggaccgcagcgatgtcggctgctatgtggtcggtcgcggtccgggctcgtttacgggcgtgcgcattggcatctccaccgcaaaaggcctggcgcgcggtgccaacgtgccgctgctgggcgtatcgacgctcgatgcttgtgcctggacggcgtggaaggctggcgtgcgcggcaaactcggtattcttgccgatgccatgcgcggcgaggtgtacccggcgctgtatgtgttgaacgatgagggccccgagcgcctgtttgagcgcgagcgcgtggctaaggccgccgtggcgctcgacgagtggcgccaggccgcggactgggaccaggtccagctgactggtgacggtctcgtgcgatacggaaagctgctgagcgaggatgagactgcccgctgcgtggagcgcgacctgtggtggccttcgggcgggggcctgctccttgcgcatgccgcaggtgatggcgacccggcccgcgtcctaccgatctatacgcgtctttcggacgcggaggaaaacgagcgtaagcgtctcggtcttgccgagagtgcgcagagtgaaattacgggcgttgccgacgagcttgccggacgtcatctgcagttccgtcccatgggcgcggcagatgccgagggcgcaagcgcactggaggctgtctgctttgaaggtgccggacatgagacatggacgccgggcatgttcttgtctgagctgggcgaggacgttgccgctccgcgcagctggtgggtggcacatgatgatggtcagctgctgggtcttgccggcggcatggtcgtggatggtgacgtgcaaattatggacgttgccgtcgatccggcgcaccgccgcgagggtatcgcccgcaagctgctgtcgcacgtgagctatgacgctcagatgcttggctgcacgacggcctcgcttgaggtcgaggacgacaacgagggtgcgattgcactctatgccgccttgggctttaccgaggcgggtcgccgtcgtggctattacggtgcgggcaaggatgccatcgtcatgacggcaccgctgcctctggtgcttccggtcgacaatgcttcgcccgagccgacggcagctgaacggcgcgtatggccgctgcccgcacccgagcgcaccgttgaggagcgtgccgaaatcgagcgccgtcgcctcgtgcttgccatcgagagctcctgcgatgagacagccgtggcgattatcgacgcggacggcaacatgcttgccaaccaggtatcgacgcagatcgatttccacgcccgttttggcggcgtggtgcccgagattgcttcgcgcaagcatgtggaggtcatcgtgagcgtcgtggacgcggcgctcgaggatgccgcggcatcgcttggtcttgagggcggagcgattgcccccggcgagcttgccgccgtgggtgtgacgcagggtccgggcctggtgggtgccctcgtggtgggcgtcgcctttgccaagggctttgcctatgctgccggcaagccgctcgtgtgcgtcaaccatctggagggccacctgttcgccaaccttctggcgcagcccgacctcaagccgccgtttatctttacgctggtctcgggtggccacaccatgcttgtccacgtaaaggcgtggggtgactacgaggtgctcggcgagacgctcgacgacgccgtgggcgaggccttcgataaggtggccaaggcgttgggcctgggctatcccggtggccccatcatctccaagctggccgagacgggcaatcccaaggcgattgactttccccgtgcactcaatagcaggggagactaccgcttctcgctgtctggtcttaagacggccgtgacgctatacattgagcaggagaccaaggctgggcgtacgattcatctgcccgacctggcggcttcgtttgaggcggcggtctttgatgtgcagtacaagaaggccaagaacgcgctgcatgccaccggatgcaaggagtactgcatcggcggcggcgtttcggccaacccgcatctgcgcgagatgatgatcaaaaagctcggacgccagggcatccgtgtgacggtaccgcctctctcggcatgcaccgacaacgccgccatgatcgcggaggtcgcccgccgcaaattcgaccgaggagaaatctcgtcgttcgatgtcgacgccgatccgaacatgacgctgtaactggtagggctcggtccccggtcggaggggccggatataaggtttcctgctctacagtcctgcgcaagacgaaggccacattaagtggccttctttgcgtgcggaactcgcgataaaccttatatccggcccctccgaccggggacctctctgtatcgatatagcttctgagctggttcggcgtcgacagcgaccagcatagttaacctaccagcgtcgaatttccggcgttctttagttgaaagaaaaagatggtgtgcggagctttgctccgcgcatttgggatgggagtccctgtgcgctgcgggagccgggcggcacatatgaactttatcgcgagttccgcacgcaaaggaaagcacttaatgtgctttccgtcttgcggccgctgaccggtggacggcaccgagccgtctggttgatttgaagaagggggaggcctcgcggcctcccccttttttgcgtttaaagaggattgaaatggcggtatccgccttcgcctgggctctcttactgtttggctgtattttgagcccatcttatttatttgcgcgataataactcccattggcgttagggagggctagatgtttaccgtttttgtcttgggcaatattgcttcgggtaagtcgactgcctgccgctatctcgaatctcgcggtgccatgcttatcgatctggatgagcttgccaaatcgctgtatgtgccaggttccgagatcgtcagtgcccttgcagaggagtttggctgggacattttggacggggagggcggcattcgccgcaacatcctcgctgctcgagcttttgtctcgcctgacaccgtcgcgcggctcaacggcattgttcatccggttcttatcgaacaactttcgatgaggattctcgatccggtttgttgcacggtttcgtctccccgttatccctttgcggttgtcgaggtttctgctccgactggttttgaggatgcatttggcctggctgatgaaatactggtcatcagcgctcccttggaagttcgtcgtgagcgtgccattcatcgtggtatggagccctctgatttcgatgctcgctctgcatgtcagcccgatgaggcttcgctatgcaacctcgctacgacggtaatcgataatgctgcaggcgataactcgctctttgaacagctggacgcgtggcttgcgcatcatggcttttgcgacgtaacggataaggaggaggccgatgtctaagacacgtttctttacgtggtatcgcatggcaccacttgccgtcgtgttcgtcttcggtcttatctcgctcatctactcgtatgctcctgccgctttctttaaaccgttgtatccgattgactatgaggcgtatgtaaagcaatcgagcatttcgcacaatctggatccgtatttggtgtgcgctgtcatcaagtcggaatcgaattgggatcccgaggccgagtcgaatcagggcgctcagggattgatgcaactgatgcccgagacggcccaggatatgattgccaagggccttgtcgatggtgacgagtattcggctgacaaccttaacgatccggctacgaatatcgagtttggctgtgcgtatctctcataccttttaacctatttcaacgggtcgaccgatagcgccattgccgcctataacgccggcatgggcaatgtcgacgggtgggcgcaacagagcacgtcgttgcataatgcaatcaccttccccgagactcaggcgtatctgattcgcgtcaataacgcctgggttcgctacaagaccctctatcccgatcagttcgtataggactatgcctgccgcctgcgtatactgcagatatatgagttaggagtatccatggcggaatttgaagttgagcgtgttggcggagagcttaaacgttttggcgttgagggctctgaggtgccatttaaggtcgtatctccttacgagcctgcgggttcccagcccaaagccattgagtcgcttgtgcagggcgtgagagatggagatcgctatcaggttctgttgggcgtgactggctcgggcaagaccttcacgatggccaagactattgaggccttggggaagccgacgctggttatggctcccaataaaacacttgccgctcagcttgcgagcgagcttaaggagttctttcccaacaacgccgtggtctattttgtgtcgtactacgactactatcagcccgaggcgtatgtgccgcaaagcgatacatatatcgagaaggattcctcgattaacgaggaagttgagatgttgcgccatcaggcgacggcatcgctgctttctcgacgtgacgtaatcgtcgtcgcatcggtctcgtgtatctatggcattggctctcccgaggactatgctggtctggcaccgaacgtcgacaagaaggtgccgcttgagcgcgacgactttattcatgcgcttatcgatatccagtacgatcgcaatgactatgatttggcgcgtggcaccttccgcgtgcgcggcgatgtcgtagacgtgtacccgccctatgccgagcatccgttgcggtttgagttctttggcgacgaggtcgagctgattgccgagatcgacgaggtcaccggcgagatgctgcgtgagtacgaggccattcccgtgtggccggcgtcgcactacgtgactgagaagcctaaggtcaaggcggccctgaaatcaatcagcgaagagtgcgagaagcgcgtggccgagctcaaggcaaccgataagctgctcgaggcccagcgcctacagcagcgcaccgattacgatcttgagatgcttgagaccatgggcttttgcaacggcatcgagaactactctcgtcacctggacgggcgcaagccgggcgagccgccgtttaccctgatcgattactttcccaaggacatgctctgcatcatcgacgagtgccatgtgacggtgccgcaaatccgcggtatgcacgaaggcgaccgttcgcgtaaagtgacgctggttgagcatggttttcgtttgccctcggcgctcgataaccgcccgcttcgtttcgatgagtttgaggccaggattccccagttcatctacgtttcggccacgccgggcgactacgagctgcgtgttagccaaaacgacgttgagcagattattcgtccgaccggtctgctcgaccccaagattgacgtgcgtccagttcgcggccagattgacgatcttgaggacgagattcgcgagcgggtggcgcgcaaggagcgcgtgctggtgacgacgctgaccaagcgcatggcagaggacctgaccgaccatctgcttgatgccggcattaaggtcaattacatgcactccgatacggcgacgatggatcgtgtcgagatcctgcgtacgctgcgcgagggaaagattgatgttcttgttggcatcaacctgctccgcgagggcttggaccttcccgaggtttcgctggtagcgattctcgatgcggataaggaaggctttttgcgcaaccgccgttcgctgattcagacgattggccgtgcggcccgtaatgccgacggcgaagtcatcatgtacgcagacgttgtgactgattcgatgaaagaggccatcgaggagacgcagcgccgtcgtgagattcagatggcatataacgaagagcatggcattgtgcccaagacggtccgcaaagccattaacgatatctcgagctttatcgccgaggccgaaaagaccgtgggctccaaggggcgttcgaagggcgattcactgggtcacggcgcgttctatacacccgatgaaaacggcgagggcgccgtaccggagacggtggcgcccgagcagacgcttgccgagcagctggaagggctgccgcatgacgagctcgtgcgaatcgtcgagaccatggaggaggacatgcgtaacgcttccgccgccatggactttgaggaggcggcgcgtctgcgtgatgcggtcgtccagattcgggcgatgctcgagggtgcatctgaggacgaaacgatcgagcgtttgcgttcgcaggctcgcaagggttccacctttgcatcgggcagaaaacgtcagggtgcacgattcaagaagtaacgaacgggccccgagctccttgtggagctcggggcccgtgtctttcgaacgctggggcgcgcgttagaggtctgcgatcagggcttcggcacaacggatgccatcggtggcggcgctcatgatgccgccggcatatccagctccctcgccgcaagggtagaggcccggggtcgacgtggcgtggcacgctcggtcgcgggtgacggtgacaggcgagctcgaacgcgtctccacgccggtgaggacggcatcggggcggtcgtagccgcgcagctttttgccgaacaaggggattcccaaacgaagcgattcgacgacatgctgcgggagggcttcgtcgattgccgtccaggttacgccaagtggataggtgggcttcacttttccaggtgccgtgctggcacgtcccgcaaggaaatctccgacgagctgtgccggtgcgttccagttggagccgcccaggcgataggcggtctgctcgcaggcgcgctggagttcaatgcccgcaagcgggtcatcgctgggaaggtcgtcgggcgtgacgttaacgagtagggcggcattggcgttgcgcccgtcgcgggcattgaggctggctccgttgacgcacagatagctctgctcggaggaggcggcaacaacctgcccgccaggacacatgcaaaacgagaacacgctgcgatcgttggggagatgggccacgagtttgtaaggagctgctccaagcgccggatgccccgccgatgggccatattgggcacggtcgatgtcgcgctgcggatgctcgatgcgtacgcccatggcaaaggtcttttgcgcgagggccacgttatgggtcttgagaagttcgaatacgtcgcgagcggaatggccgcaggcgagaatgagatgctttgtgacgattgtctcgctcgcggtgctttggggcgattgaacatcgatgcctgtgatggcgccggacgcatcggtgcgaatgtcgatgagttttgtgcgataacgaacggttccgccgagctgttcgatgcgctgggaaatgttggtgacgacggcgggaaggatgtcggagccaatgtgcggcttggcgtcccacaggatatcgcgaggcgcgcccgcttcgacgaaggtctcgagaatcaggcgatgggcgggattcttggttcccgtattgagctttccgtccgagaaggttcctgcgccgcccaggccaaactggatattgctctcggggtcgaggatacgctccttaagaaagaggtcgattgcctgcgagcgtcgaagcgccgggtcaccacgctcgataagcaagggcttaagacctgcttcggcgagggtgagggcggcaaagaggccggcgcaaccggcaccgacaacgacgggacactccttgggtgcgttggggacaggggaggggaatgagggcgccgcgccatcgaccatgcggatgcgcgagcgatcgcgctcggcaacgctgctgacagcctcctgctcgagtcgggggtttgtcagctcgactcgaaagctcaaaataaaatggacgtctcgctttttacgggcgtcgatagacttgcgatggagctcgatggctttaatctgggaatccttgcatcgcagggctcgcttggcggcgcgtctgccaacggtaaggcaggcatcctcgtcgccagcctcatcgagggacgcgtggacttgggtgatttcgatcatcgaggtctccttagatgcaagaaagaggccgcccggtgtcccagacggcccgaatgcgttttgattatagactgcgcggctatagactgcttgcagcgcgaatgcccgagatccaggcccacgcaagattaaagccgccacaatcggcatcgatatcgagcgcctcgccacagatgaaaagtggggcgcctaccgcgttgttcacgcagagtctgggagctgagacgctctcgatgggcacgccaccgcgcatgacctgggccgaacactcctccgccgttccctcgacgagcagcttaaagtgcttgaggatcgagaccagatggatgacatcgtgtgacccggggtggcactgttcgaatgtggtgcagacgacgtgagagagctgcggggcaagcatgccgtcgagccagcggagatcgtgggacgaaaagccgccgagcagctcaactcgctggttgagcatatcgagcaactcacctttggagaggtcggggaaaacgtcgagcagaatcgtgtcgccgtgctggacacggcgggagaggttgaaggcggcaacgcccgagatgccaaaggttcggaagagcacttcgccgtcttcgtgccaaagctcctcatgattgcgggtgagcgtcagacgggcgcggacgcgcaggccatccaaggtcttgagcgccgtctggtcgccaacgaccgatgccgacacggggcagaggacggggtgctgcggcgtgagggagagatcgaacgtcctcgcgatgtcggcaaaactgccgcccgtggcgataatcacagcctttgtttgcagcgtctcgttcttgcgaggtgcgtcggcaagcgccttccgaagcgagcggacctctgtttttcggtcgtcgtgcttttttgccttgagtgtccgcgcgggacggtctatttgaagcgcccagccctcgggagctttggatgccgagacaacgtttgccccgcagatcaaggcgatacccaagcgatcgcaagcgttgagaagcgcatcgcgcaccgattcggcgcgaagggaacgcggatacaggcggccttcctcggaggtcgtcatgatgcccagcgaggagaagaagttccctagctcttcttcgggctgaggtcccatgacggattcgatgaatgcggggtggttataccgctggaaatcgattgattcgttggaaaggttgcagcggccgtttccggtcgcaagtatcttaaggccgcaggcaacatcgcgctcaacgatgcagacgcttttgccggcgcgtgcggccgtaatggcggcggcgagacccgaggccccgccgccgattaccaagacgtcatagaaggcgtttgcgttcacttaggcctcgtcggtctcgtgcggggcaatggcctcgacggcagagacggcctggggcagcatgccgtcgggcagtgcggtctcaacttcgcccttatcgcaggcctcggcgagtgccggattgatgggaagttggcccaggatctcgaggttgtagcgctcggcaacctcggggagcttgctcttgccaaagacttcaatcttcttgccgcaatcggggcactcgatatagctcatgttctcgacgatacccagaatggggacgttcatcttctcggccatattgaccgccttggcgacgatcattgagaccagatcctgcgggctcgtgacgatgacgatgccatcgacgggcagcgactggaagacggtgagggcgacgtcgcccgttcccggaggcatgtcgaccagcaggtagtcgatgggaccccaggaggtctcgctccagaactgcctgatggcacccgcgataaccggaccgcgccagaggacagggtcggtttcgttttggagcagcaggttggagctcataaccttgacgccgtgctcggagatttcgggcagcataaggttgccgagggcgtggacatgtcgtccgctcatgccgaacatcttggggatagaggggccggtaatgtcggcatcgaggacgccgaccttgtgaccgtgacgggcgagctcggtggcgatggcgccggtgacgaatgacttgccgacgccgcccttgccggaaagcacggcgatgacgcgcttgacttcggacaacgtgttttcttcaaattcctgtggcgcggtttgtccgccggcggcctgtgcatgctcgcaacccatgtatgactcctttgtatatgttggggacgaagccccgcggtgtgacacgagcgtcattgtaccctcgtttgcgagcgggagtcattcgtgatgtgtctgtccgggagcgtgcgttgcaatgttatgtcactccagcgcacgggcgagcttactgaaccttgctggcgaactcaaggtattgaatgcgctgcagcttgtcgatcgtcgagacataggggctgtctttcgattccaagtcatagcgcagcccgtcggctccgagatagccggcgacattgatggtcggcacatcggaccttgttgcaagcaaggccttttggtaatcggtgagcggagcgccgatcttattaagggttatggctgcaatctcgtttgcaccgacggtgtcgtagacgttgagctcggtattgccggcgatttcatagttcgcccagacaaaataggtcgactgataaatgcggaaagcgtggcttgccgtgtcttcctgcgggtacagctcatcgttgagagccgttgcggcgctcggctgatgatcgccaaagaagacgagcacgaccggtcgaccgatattgcggagctcgttgataaagtactcaaggtctcggtcggatgcgttgatgcaggtgaggtaggtgttgagtgcggtattggtgccctcgctggccccctcgacccaataattcgtcagctcttcggcgggaacggtgccgacatcgtatccgccatggttttgcatcgtgacatcgaagataaactgcggggcgtcgtcggtcctcagcaggtcgagtatcttgtcataggtggcgtagtcgcatacgccggcatggtaatagggtgcaccttcgaaatcggcgatagataggaaatctccaaagcccagctgctgatagattttatctcgatggtagttaacggggttttgcgggtgcatggcagtggcggtgtatccaagttctttaaggtcctttgccaagctgttgacatcattcatctgatatagctgatagggaatcttgcccactccgacaaaggcggtcgtagctccggtcaaaaactcaaattcggagttcgctgttccgccacctgcgaccgaggcgagcatagtgccgcgcacgagcgtgtcgggaagtgagttatagaatgcggggccggtatacccggccgcctggagctgctcaaagcacgaaaggtcgctaaaactttcgttcatgacggcgacgatcgtcggcttgatttcattgaattgagcaacggcggcggcgcgctgctcgctcgagccatatgtgctgtcatagacggcggcaagctcccgctcgatgtcctgagcctcatcggacgtatagccctcgggcttttcgatgggcagctcgttgaccatttcggtgaacgaggtgagaaagccctgagacacatacgtcgtaataggctgccagcggtcaaatccaaagtcgagcgcctgttccaagtcgatgctggaaaagccagagagacccacggcggtcaccagcaggaaggcacagagattgccggcaatgacaggggatacgcgagagggcgtacggagctttcgcgggcggatgagcgaaagaagcccaaaggagatttcgagcagcgcaagtgacgtgacgataccggcagtaaaggtgaactcgtatccttcgcttacctccgctgcggtgcccagggccaaaatatcgctcggcaggatggcttcgcctttaaatgtcacgacgaagtgctcggcaatgccaaggatacagcagacgatgggcacaagggccatgacccctccgtgccgttgtcctagcaaataaagagagagcaggatcgtcgcgagcagtccgacggaaaaaccaaatgaattggcgggaatgcgatagaacgtgtcgttgcaggcgatttcgagcgaaacgaacgagagcaccgaaaccgcggcgatgacgagaacgtcgcgacaggtgcaagcaatcgttcccgttgcgaaatcggattggtcgatgaatctcgaaatcaagggctcgacaagaagcacgacggcagcggcaccgagtgccgaataggaaagaatccatagggagctgtcttcgtttacaagcaattgattcgtaatccaggcagctaccacaccgagcggaatgaggagcgtcgcgcaccaaaaggcgcgggcaatgggcggcttttcatttcgcttgattgaaaaatatacgcgcacgacgacggcggctacgataaggacggcaatgaatatgggcagattggccatgtcgctcgaagtgatttcaagggggatatcttcggtcatggacgttcctctggttcagcaaattaagttcagtattagattactgtaacctttccacggcatttcgagaaacaaagcacccgatacgcaacgcaaaaggtctgcgaatcttgtattacgaacatctgtgcgcgtcgagtgcgctaaactcatcgacaatatgattcgatgcaataggaggcaaggagcttccatgtctgattcttctatcgttattcgcggcgctcgtgagcacaacctccgtgatatcgatgtttccattccgcgtgaccaactcgtggtcattaccggtctttctggctcgggcaagagctcgctggcatttgacactatctatgccgagggccagcgtcgatacgtcgagagtctttcgagctatgcgcgccagttcttgggccagatggacaaacccgacctggattcaatcgacggcctttcgccggcggtgtcgatcgaccaaaagacgacgtctaaaaaccctcgctcgacggttggcaccgtaaccgagatttatgactatctgcgcctgctgttcgcccgtgtgggcaccccgcactgtcccgaatgcggccgcgtcattgagcgtcagacgaccgaccaggttgccgacaaggtcttggcggcgggggagggccgccgcgcgtttgtgctggcaccggtggtgcgcgggcgaaaaggcgagtacaccaaactgtttgaggaccttcgcgccgagggctttagccgcgtgcgtgtcgacggtgaagtgcgctcgctcgacgatccgatcgatctggacaagaagttcaagcacgatatcgaggtcgtggtcgaccgtatcgtaattcgagagaactccctaggccgcatcgcagagtccgttgagcaggcgacggcgctggcgcacggcaatgtaaacgtgtgcatgctgcctgaccgcgatgctcccgagggaaccgagggcgagctgcttgagtattcgctggcgctggcgtgcccggagcacgggcactccatcgacgatttgcagccgcgcgatttctcgttcaacgcgccctatggcgcatgtcccgagtgcgatggcctgggctttaagaagacagtcgatgccgaggcgctgatcgaagacccctcaaagtcgattgccgacggtgtctttggcagcctgttcggcaattccaactactatccgcaaatctttgccgcggtctgcaagcattttaaggtgagcgccgatacgccctgggaggacttgcctccccgcgtgcgtcgtgcgtttttggatggcatgggcgacacgaagatttcggtcgactatcaaaagctcgacgggcgtcgcagccagtgggataccaaattctcgggcgtgcgcaacatcctgtatgagcgctacaccgagacgacgaacgagaacaccaaggcgcgcctggagaagtatattcgcgaggagccgtgctcgagttgccatggcgcccgtctgcgtcccgagatgcttgctgtcaccgtgggcggtaagtcgatttatgaggtttgttgcctgtcgtgccgtgagtcgctcgagttttttgagagcttggagctcaccgagcgccagcagtttatcggcggccgcatcgtcaaggaaatcttggagcgtctgcgttttctggtcgacgtcggccttgactatctgacgctcgatcgcgcctcggcgacgctttccggtggcgaggcgcagcgcattcgcttggcaacgcaaatcggtgcgggcctcatgggcgtgctctatattctggatgagccttcgatcggtcttcatcagcgcgacaacgaacgcctgatcaagacgctcgagcgcctgcgcgatatcggcaataccgtcatcgtcgtcgagcacgacgaagatacgattcgcgctgccgactacgtgatcgatatgggtcccggtgcgggcgtgaacggcggacacgtggttgcggcaggaacgcctgccgatatcatggcgtgccccgaatcgatgacgggcgcctacctgaccggcaagcggatgattcgcgtgcccgaagagcgccgcaaacccggtcgcggctgccttaaaattacgggcgctcgagccaacaacctcaaaaacgttaccgccaagatcgagtttggtacgcttacggttgttaccggcgtgtcgggatcgggcaagagctccctggttaccgacaccatcgcgcctgcccttacgaatgccattcaccgttcgacgcgccctgtgggcccatataagaaaatcgagggtatcgagtgtatcgataaggttatcgatatcgaccagtcgccgattggccgcacgccgcgttccaaccctgctacctatatcggcctgtgggatgatcttcgcgcgctgtttgcgagtacgccggagtcgaaggcgcgcggctactcaccgggtcgtttctcctttaatgtgagtggcgggcgctgtgaggcgtgcaagggcgacggacagatcaagatcgagatgcacttccttcccgatatctacgttccctgcgaagtttgcggcggtaaacgctacaaccgcgagacactcgaggtcacctaccgtggcaagaccatctcggacgtacttgacatgagcgtggccgaggcactggctttctttgggaatatcccgcagatcaagcgcaagcttcagaccttgtatgacgtaggccttggttacgtgagccttggccagcccgcgacgacgctttcgggcggcgaggcgcaacgcgtgaagctcgccaaggagcttcatcgacgccagacgggcaagacgttctacattctggatgagccaacgaccggtctccattttgaggacgtccgccagctgctcgacgtgttgcagcgtctggtcgatgcgggcaacacggtgctggtgatcgagcacaaccttgatgtcatcaaggttgccgaccgcctgatcgatatgggccccgagggcggcaatggcggcggaaccgtcgtggtctcgggaacaccggagcaggttgcggactgtccgcagagttatacgggcaagtttttggcgccgttgctcaggcgcgaccgggagcgtcaggctcaacttgatgttcaataaataggcgattcagtttatgggcgccatcgactccttgtgattcgatggcgcttgctgtgccgaagtgacgtatgcagtcgaattggacatatacttaatccttgcgtccgaatgcgagggaaaggatatgtcatggcaaaggctgcaaagacgccaaaaaccaatgcgatgcgcgagctggaaagcgccggcatttcctatgttctacatacgtacgaagacgatggtgatgagtcggtgggcctgggtgtcgcgatttcggagcagcttggcgaggagcccggtcaaggatttaagactttggtctgtgtgacaccgtccaacgactatgtcgtgtgctgcatccctgttgccgacgagctcgatctaaagtccgccgctcgtgcggcgggggagaaatccctggccatgatgcatgtgaaggacttgctagcggcgactggctatgttcgaggaggctgcagcccggtcggtatgaaaaaacgctaccggacgctcattgatgagacatgtgtcctttgggataccatttttatttcgggaggcaagcgtggttatcagcttgagcttgcacctgatgatttaattgcattttgcggggcgacggtcgccccaattacgagagaggactgagcgatgccgcaggaagaattgaagtgcggagctcattttgcaaaagaatctgcgcctcagacaccctcatccgaagcttcttcgtcgcgagacgacactgacgacatgggctcgtcggactactccacggttggtcgttccgccgggcttatgaccatcctgaccatcgtgtctcgcgtcaccggttttatccgcacgtgggcaatggcggccgctatcggcatgtcgctgctctcgtcttcctatcaggtcgccaacaacctgcccaatatgctctacgaactcgtgatgggcggcatgctcgtgacggcgtttttgcccgtgtacatgggcgtgaggcgtgagcagggtcgcgaggcctctaacgagtacgtgggcaacctgctcggtattctgctattggtgctgggtggcatttcgttgctggggaccgtgttcgccccgggctttatctggacgcaatcgttcctttcgggtgacggcggcagcatggataccgctgcgttcatgttccgtttctttgccatccagattctgttttatggtttgggctcggtgttttcgggcgtcctcaacgcacaccgcgactacttctggtcgacgtttgccccggtcctcaacaatgtgatcgtcattgcgagctttatgggctttgcgcccgtgtccgcacagttcggcgaacgtgccggcatcatcttgattgcggccggtacgaccctcggtgtctttgttcagatggcatgtcagatccccgcgcttggcaagcacggcgtgcatccccatatccatatcgactttaaggaccccgcactgcgccagacgattgcgctcggtatcccgacgctgctcgccacggtgtgcatgtttgtctcgacttctatcaccaacgctgctgcgctggtggtccagcccgagactggtccttccgtcatcgcctatgcgcgcctgtggtacacgctgccctacgcgctgattgccgcctcgctttcgacggcgctctataccgagctctctcacgacgcacaggagaaggattacgacagcgtccgcacgggcatttcgcgtggcgtcgcccagatgctgttcttcctgattccattcgcgctgtacctgattgtcttcgcgcgtccgctcaacatgatctactgcgctggcaagttcgatgagtccggtgtggcgctggtgtcggagttccttatctacctggcactttccctgccgctctacggcgtggtcgtgctgatgcagaagagcttctctgccttgctcgacatgaagccctatagccgctattgtctgtattccgccatcggccaggccggctcggttctgctgtttggcgttgtgctgggcttcggtatgccggcaatcgcgctttcgtatgtcgttgactacgtgatcttggttggttgctcgctgtggtggctgcgtcgtcgcctgcgtggtcttcaggttaaatctatcctgcatggcggtttctttggccttttgctcggtggcctgggtgctgccgcaggcgccggcgtcatgcgggcgcttgagcactttgtcggggcacttggcggctcgattctgattactcttggctacgtttgcgttgcgggtgtcgtctcgcttgctgttacctttggccttgccgtcgtccttaagatgcccgaggtctcggcgctgattcgtcgcaagtaggtgcgcgtggccggtcacgacaacattccaacgcttgccgagcaggtttcgcgcgttcccacgcagcccggctgctacctttggaaagacgccaagggcgatgtcatctacgtgggcaaggcgaaaaacctgcgcgcccgtatgcgtcagtacgtgacgctgcaggacgagcgccagaagatcccactgatgatgcagctggtggcgagcttcgactatatcgtggtggagaccgagcacgaggcgttggtgctcgagcgcaatttgattggtcagtaccatccgtactttaacgtcgacctcaaggatgacaagagctacccctttatcgccattacaaagggcgacctgtatcccgctatcaaatacacgcgtgagcgtcataagccgggaacgcgctattttggaccttataccgatagccgcgcggcacgtgagacgatagatacgctgcgcaaggttatccccatctgctccgcatcctgtgcggagtggcgtcgttgtcgccgtatcgtcgagtcccacaagggcgaggaagacatcgtcaatatgatttgcgcgcaaaacgggcgcccctgcttcgactatcatgtcgggcgcggcccgggtgcgtgtgtcggcgcggtttccccggcagactatgccaagaacgtcaagcgtgtcgaacgttttttgtcgggccatcgcaaggacgtcgtcgacgagctgacatccgagatgacggaggccgccgaggcgctcgattttgagcgcgccgcccgcgtcaaacgtcgtttggaggtcatcaggggtctggacgatcgtcagcaagtcgtttttccctccagtgtcgatatcgatgtcatcggtttctatcgcgaggagaccatctccgccgcttgcgtcttcgtcgttcgcgagggtcgaacagttcgcacctgcgagttcattctcgacaagggtcttgatgttgacgaggaagagctccagtcgggctttcttaagcgctattacgacgagacggctgatattccagctgaggtcaacctttccgtcgagcttgaggatgcggaggcgctgggggagtggcttgcgggcaagcgtgagcgttcctgtcatctccataggccgcagcgtggcgaaaagcaccgtctgctcgatatggcatccaaaaatgcgcgccatgccctcatgcgctacatgatgcgaacggggtacgctgacgaccgcaccaatcaagcgctcctggagctcgaaagtgcgttggcgctgccatcgccgccgttgcgtatcgagtgcttcgatatctcgacgctgcatggcacctttacggtcgcctcgatggtggtgtttaccaacgggcgcgccgacaagagccagtatcgtcgttttaaaatccaggccgaattggacgaggcaaacgacttcgtgtcgatgtccgaggttttgggacgacgttatgctcccgagcgcatggccgacgagcgctttggctcgcgccccgatttgctcgttgtcgatggcggtaagccgcaattgaccgctgcgatcaagcaacttgaggctcttgggctcgatataccagtttgtggcttggcaaaggccgatgaggaggttttcgtgccttgggacgagactcccgtcgtgctgccgaccgggtccgcgtcgctctatctaattaaacaggtgcgcgatgaatcgcaccgttttgccatcacgttccatcgcgaattgcgcgataaagccatgacggtttcggtactcgatgacgttccaggcgtgggacccaccagaaaacgtgcccttatgcgccattttggctcgatgaagcgtttgcgcgcggcgagcgagcaagagatcgcggaagttcgaggcattcctgccgatgtcgccaaagcggttcacgaggcgctcgttgcatggaatgccgagcgcgccgaggcggcggcaaagcaatccgaaaactaaacacgcctctaaacaactgatatacatgattgcgtgattttcaatcatttatttcacggcgattaccagccgatttcgggtttaattaacgctaaaacgtttgactagccatggtgaacaaccctgctatcctgcgggttgacgaagactgatatctcacctcgtcgatacatactgtctggcgaatcgtttgtcaatgaattcggtgaacggtagtaaataccgttcaagcgtatgtatgtatcggtcgccgagcgcggcacctcagttgggctcgtcggtaggtaaggtatatatcgtccgcaagttgcgcgggggcacgtctaggtgctcccgggtaagattctctattgataggagaagacatggccatcatcaacaagggtatgtccaggcgttcgttcctcggcctcaccggcagcgtcgctgctgtcgcagggcttggtctcaccggctgcggtggcagctccagcgacgagggttccgcttccggttccaccgattccgccaaccgtggcggcggcgtgatcaccgctggttccgcttacgctccgtccagcttcgatcccgccagcaccggctccgctgtgggcctgggtgctaactggcacgtcgtcgagggcctctatggcatcgattaccacgactacagcaccttcaacgagctcgccaccgacgatcccaagtctgtggacgacaccactttcgaggtcaccatccgcaagggcgccaagttctccgatggcaccgaggtcaccgctgacgatgtcgttgcctcctacaccgcttgcgccgcttccgctacctatgctccgttcttccagcccttcgagtccatcgaggccaaggacgccagcaccgtaacggtcaagaccaaggtccccaacttctccctgctcaaggatcgtctggccatcgtccgcgttaccccggccacccagaccgaggaggatcgcgccaagcagccgatcggctccggcccctggatgtacgactctatctccgataccgagatcaccctggttcccaaccccgagtacaacggtgagtatgctgccgaggataagaagatccagtacagcatcctgaccgaccccaccgctcgcgttaccgctcagcaggagggctccacgctcgttatggagctcgttaccgctgacgccgtcgaccagctcgagagcgccggctgcaagatcgataacgttcagggtttcggcacccgcttcatcatgttcaacgtcgccaaggagccttggaacaacgtcaaggtccgtcaggctgtcatgtatgcgctcgacaccgagaagatggtcagcaacaccttcgccggccttgccaccgctgctagctgctacctgcccaagagcttcaccaactatcatgaggcttccacggtgtacaagaccgacgccaagaaggctaagaagctcatcgaggagtctggcatcaccccgggtgccatcaccctgcgcaccaccgacaacgagcagattaagggcatggccgcccaggtcaagaacgacctcgacgctctcggcttcgatgtgaccatccagaccgatacctcgccggccacctacgctgccatcgacggcggcgaggcctacgatatcctccttgcccctggcgatccttcctgcttcggcgccgaccccgacctgctgctcaactggtggtacggcgacaacgtctggatgcagacccgttgcccgtggaaggagtccgctgagtggcagaagctccacggtctcatggacgaggctcttgccgccgagggtgacgagcagcagaagaagtggaacgagtgcttcgacatcattgccgacaacgccgttctgtaccccgttgtccacgtcaagaccgtctccgcttcctgggacgatccgtccaccgcgcccaacggcgaggccctcgatggcttcaagggcatcggcacgacgagcatgtccttcaggggcgtcgcgaccgtcaaggcctaagactcgcttgagtcatatgtagggcgtcggtcgtaaggcaacgtcctcatagttgaaacaaagacccgggcggcaacgatgtcgctcgggtcttgtaatgagtatccgtactcatataccagttggtcctaccgacaaaagaaaggggagagaacgtgaacaacttgctacgtttgattggaaggcgtcttgtggcgctgccgatcatggcattgggcgtcaccgtcctggtgttcttccttatgtcgttctccaagaccgaccccgcctacacggcgttgggtgacggtgcctcgcccgaggcggttgccgagtaccatgagaagtatggtctggacgacccctggcccgtgcgctacgtgcgctatatgggcgatttgatccatggcgacatgggcacctatggtgctgctcgcaactccgttgccaagcgcatctccacggccctgcctgtcacgatgcagctgaccttcatcggccttgccatcggtgcggtcgtttcgtttttactcggcgtcatcgcggcactgtatcgcgacaaatggccggaccaagtgatccgcgtcttttccatcgccggcttggcaaccccgtcgttctggcttgccgttctgttgatcttactgttctcttcctaccttaaggtgcttccggcatcgggtgctctgcctcacttcaccacgaatccggctggctatctggggcgtatgatcatgcccgctatcgccttggcatttccgctgacgggccagatgactcgtatcgtgcgtaccgccatggtcgaggagctcgataaggattatgtccgtatggctcgcggcgccggcgttcccgagaaggtcgtcgtcggcatcaacgttcttcgcaatgcgctgatcaccccggtcaccaccctcggtcttaagatcggttacctcatgggcggcgccgtcgtcatcgaggttatcttcaacctccccggcatgggcaccgcgattctgcagggcgttcagggcaacgaggcgaacctggttcagggcgtcgttatcgtcgttgctcttgccttcatcatcatcaacatcgtggttgacatgctctacctgctcatcaacccgcgcatcaggacggtgtagattatggtaaagattcgagagaagcaaaccgagcagctcgagaaggctgcctccaaggggctcaagctcggtggctggaagaagatgacgctgtcttctaagattgccgccgtcgtgttggtgctggtcgccctgactgcgattctggcgccccttcttgccccctatagcccggtcgagatctttacggctcgccaggctcccggcaacggatttatcttcggtaccgacgataagggtcgcgacattctgtcgcgcatgctctacggtggtcgttactcgctgattatcggctttggcgccactgccatggctctggtctgcggctcggtcgtgggcgcccttgcggcggtttcgcgcaaggccgtttccgagacgatcatgcgtatcctggacatcatcatgtccatcccgggcatcgccctcgcggccgtcttcgtctccatcctgggcaactccgtgccgtcgatcatcttcgccatcggctttatgtacactccgcagattgcccgtatcgtgcgcgccaacatcgtgtccgagtacggcgaggactatgtccgcgcggtcatcgtttccggcgccaaggctccgtggattttgatcaagcatgttctgcgtaactgcatcgccccgatcatggtcttcaccgttaccctggtcgccgacgccatcatcttcgaggcctcgctgaccttcatcggcgctggtatccaggagcccaccgctacctggggcaacatcctcgccgacgcccgcggcggcgtgctcgccggccgttggtggcaggcgctgttcccgggcctggccatcatgatcacctgcctggcgctcaacatcctctccgagggcattaccgacgccatggccgctgctccctccgccgccctggatccgaccgattcctccaagcgtcgcgaggccgacctgctggtctccgaccccgttcgcgcctacaaggagcaggcccagtccctctccgctcgccttggcgccctgcgcgatgtcgagctcaagcgtgacgatcgccatgtgcccgacgagtctgtcgaaccgattctctcggtccgcgatttctgcatccagtttgagcatcacggcgatatcaacgtcgtcgaccatgtcaactttgacgtccgtcctggtcagaccatgggcctggtgggcgagtccggttgcggtaagtccatcaccacgctggccatcatgggcctgaccgacgatgacgagcacctttccggcgaggtcctctgggagggccgcgacctgctcaagatgagcaagaaggagtggttcggcctgcgcggtaccgatatcgctatggtctatcaggacgccctgtcctcgctcaacccctccatgctcatctctgcccagatgaagcagctcaccaagcgcggcggcacccgcagcgccgaggaactcttggagctcgtgggcctcgaccccaagcgtacgctcgagagctacccgcatgagctttccggtggccagcgtcagcgtgttctgatcgctatggcccttacccgcgaccccaagctggtcatctgcgacgagcccacgaccgctctggacgttaccgtccagaagcaggtcatcaagctgctcaacgaccttcaggccaaactcggctttgccatgatcttcgtctcgcatgacttggcgctggtcgccgaggtcgcccataacatcacggttatgtacgccggtcaggttatcgagcaggcgcccaccaaggagctgctcactaacccgatccacgagtacacccgcggtcttctgggctccgttctgtccatcgagagcggttctgtatcgccacacgcctgccaagtttcccgtcaatgccttgcccctgcttcttgggtcttcgagcttcgctatctcgtcaagctcgtcaaacacccgcgcggcaacgcccttatcgagcttgcgcatcgccttgtcggcgttcctcgtgaaatcaattcgccaggccacagtgcgcccttacctcgtcgatgctgtaggtctcaagcctgccagcacgatagtcctcgatatccttgagaatcccgtactcgtactcgaaacggtcgatagcttcttgcagggcttcgttaacgtagaagctcctcgacctgccagtctccttcgcaagacggctgtagcgctcgttcaactcggttggaatcctcattgatgtgaccgcggtagccatgtcgcacctccttgtcgtgtattacaggtactactataacacatcatctagcccgcccgcgatacgtcctctgcggtgcagcgtggtcgcggttccacgcatccgccgcccgctgcgcatcgcgcagcacgtcattaaggctctgttgccttggctgctccctgcgcatcagatattcgagcgggcgcgatattcggcttctaagctcttccactttgagcctaattcccgcaactcctgctctgatgcggctcgcgagtccatcgcactgagcagcgattctatcgaggattgcgccgcgctcagcttttcccgcagcttcccagccccgaacctcggcagcgatggagcgaagctctccaacgtctcgcgcaactccgtccgctcgttgccgaagacactccaatcggtcttgctcatcttcgatatcgagcttcacgtcctcgagctggctgtcaagctcggcaaggtcaccctccttgtcggcaatctcggtaacaagctctgccttacgcgcttcggcatcgtttagcaaagcggcggcttcttccctagccgccgcgacgattcgcgccgcttcgtcctcggcaggttgcacgaccgccctatcgaccgccccgcgtaccttgtcgatgtccacggacttgtccgtgtaaacgcgctgcgcccgcgtctcctcgtcaagctcgattgcagggcggtagcccatgcgcttctcgaggtagtccccaagctccttgtgcatcgactggtagaacgagcgcgggcacattttcttgtagttgaaacgcccatcgagaataggtgtgaacggcacgtgcatgtgatcgcgggcgggcgtgccgtccttcagcacctcgtccttgtggacgtatccgcccatcatgttgtcgatgccgaacttgttcgacaggtaccagtacgtgagacggaagaacctatcctcatcgcccttgcggacgttatcgggaagcgtcaccaccacgtcggccataaccaccgcgtccttgcgcgttgcgcgcttccctgcggccttctgggcctcgttcacgcgctctatgcgccgctccaccgtgccccagttcggctcgccctcacggggcaccacgcgccccacaacgagcttcccgtccttgttggtgtagtgggcaacgaccatgtcgttcttcacgcgcttcgggtcgatgttgtcgcgacccagactggactcgtcgcgcctgtagtgggcaagcatgtgaccgaccgaggttgccttgtacttcgctatgtgtgccatgtcggaaccgccttgcgtcagattttagtcgcctaaagtctagcacgttagaccttagctgcgctaaggacgtgccctgcggggcttctccgcaatcctcccagcggtcgagattgctgcgcgtcatcggtggcggcacctcttccttgcccgctcggctccgccgagatggaggggtaaaacccctccaaaccaccccgacgtatcggtatcggatatcggattcccatgggcgaggtcgtagtacctcgccccccctgtggtcatttgtcatttgtcatttgtcacattatttttcggacgtagttagcgaaaaataatgagccgcccgattctgcaggtctcatccagtcgagacacgggcaaggaaagggtcgatggagcagagcgtccatcgacccttaatcaagtctggtctattctacatgtacggatgaatatgggaggtgttcggatgaagttgatattcaagggcggagggaattgcggcagcgcgggcgcgaggggtgcggtttggccggcctcgcaagccatgccctccgcagtttgaactggtgcgcgatagctatgaggcaggcgatatcacccgtagccaggcagcaaagcgcttgggtgtgtgcgtggggacgttcgatcgctggatgcgcgaggcgggttaggagatggcagccctgtcgcttcttgttgcgattcaaattttgctacgacgacactgctatttagactacactcgctcatatttaaaaagacggaggttggcctttggcgcacacgaagaaaataatcgggtggatcgcgatcgctctgttcgccgcaacgctggcgggcatctgggtgctgacggagcaaaacgcggtgcagacgtcgctgctgagcgagtccaccgcgcgtgtggtggagggtcaggctacgggcgttcaggctgccggtgccatgggcgaagctcagacggagaacggaatgaccaggggcaccgattcggctgcctcgaatgtccggtctggtcgacttgcttccattcgcgtgtggataggcacaaacgtccgtcgcgtcgcccataccgtagagtttttcttcgtcggattgttcgcttcggtgatcgcggtttgcttttctaggcgtccgtggagtgtatgctcccgttgcgtgcccgtgttgctcttttgcgctgcctgctccgttggcgaccaggtgcataagatctttgttcccggcaggcatttcgacataatcgacttgggcttcgacgctgcgggctatgtcaccgcgatgctgctggtattgctggtcgccgcatgggtacaccacgtgacgcgtcccatcggcgcccatgcgaggcactagccggtaacaaacccgtttctgatagggccgattcgttgaatcattttgtgtcgcatgtatttccgagcggtcggatttgaggggcgagcggtagagcgctcgccctttgtgcgccacgatgcggcacaatgtaccgcaaaagaagttctaacacggtacgaatggttcgttggtctttaattcttctcaacggaggtgtttgagatggcaaacggattgcttttgcggcttcgagagcgagagctcagcgcgagcccggcggagcgcaatgtcatcgcatatgtgagcgctcatccgcacgaggtggtcgggctgtccgtccgcggtcttgccgatgccacgttctcctcaccctcgagcattttgcgtttttgcaaacgcttgggctttgcgggctataaggagttccagcgtgagctgattgccgagcttgcgctcttgggtgacaagaaagacgttgccctcgaggacatctccatggacgacagtgtcgagcgcatcgtggggaaggtgatgaaaagcaacgtacgaacgatcgaagcgacagcgcgaacgctcgattacaccgtccttgagcgatgcgcggcctatcttaagcgggcgcgcgcggtcaatctgttcggtatcggtgcctctcgtttggttgcgcacgatctggcgcaaaagctcatgcgtgtcgacaaagagtgccatctgtacgatgactggcacgaccaactcttgtgcgccaagaacatgcatgagggcgatattgcaatcgcctttagctattcgggcttgacgcaagaggtgctggactgcaccgcggaggctcaacgccataactgtcccgttgtggccgtaaccaaagtggatggctcgtccaagctcgccaccatggccgatgccgtgctcggcgtcgccgcaagtgagccgctggtccgcagcggtgccatggcttcgcgtatggcccagctcatggttgtcgacgctctgtacgccgcttacgttgcaagcgattacgaacgggcgacgcatgtcattaagcaaaactacatcgagaaacaggaaagatgaggtgaatggattgctcgatttaacgaagttcacgaccgaacagcgaaaccagcgaacgatggatctcgacacgatgacgtcgctgcagatcgtcacgacgatgaacgatgaggatcttcgtgccgtccagtcggtcacgaaagtgttaccccaggttgccacagcaatcgactgggctgctgaggcactcgagcgcggcgggcgcgtcttttacatgggcgcaggcaccagcggacgtctgggcgtgctcgacgcttcggagtgtccgcccacgtttggcgtatctcccgatctgattgtcgggctcattgctggaggcgagacggcgtttatcaaggctgtcgaaggtgccgaagacagcgaggagcttggcgcgagcgacctgcgggagcgtggactctcggacaaggatcttgtcgttggcctggcggcaagcggtcgtactccctatgtggtgggcggccttgcatatgccaagactgccgggtgcaagaccattgcaatcgcctgcaaccaaaggtcgaagattggggagggtgcagatcttgccatcgagcccgtgcccggccccgaggtgcttaccggctcaacgaggctcaaggcgggaacggttcaaaagctcattctcaatatgatttcgaccggtgccatggtcaagatcggcaaggtataccaaaacctgatggtcgatgtgcagcagacgaacgagaagttggtggtgcgcggccagaacatcgtgatggaggcgaccggctgcacgcgcgagcacgctgttcaggcgcttgcagatgccggcggccacgttaaaaccgctatcgtctcggtgctgctggattgtgatgccgagcaggctgcgacggctcttgaacgggcgcgcggccatgttcgcgctgcggtgagcggccatgagaagagcaatgccgatgcccaataggcgcacggcgtgagctgatatgacatccggacgagatattcaatacaaggaggagttatgacgaacaaagagctggctcaaaagctgctggaccttttgggcggtaaagataacgtgctggcaaacgcggcgtgcatgacacgcctgcgcgtgaccgtcaaagatgcgggcaacgtcgacacagagggtattaaagcgctcgatggcgtaatgggtctggtcgaggacgataccatgcagatcgtgctgggaccgggcaaggtgaataaggtgcttgaggagttctccaagctcaccggtcttgcgaaaggcgttgccgacgagagcgtggttgacgctgcggccacaaacaaggctgcgcagaaggccaagtacgagtccaagccggttcaggccttcctcaagaagatttccaatgtcttcgtcgctctgcttcccggtatcattgcggctggcctcatcaacggtatctgcaacgtcattaacgtctcgacggcaggcgcgcttgcaggcgagtagtggtaccagggcattcgttccatgggctgggccctgtttgcctatctgcccatcttggtgggctataacgcggcgcgcgagtttggtggctccgctgcgctgggcggcatcgccggcatgatgtgtatcgccaacagcgccatgcccctgcttgcgcctggcgcggctgatcctgccactgccattctgctgccgctcaccaatgcgcagtacaaccccgcagcgggcggcatgatcgcggctctcatcgctggcgcattttttgcctggatggagcgtcagattcgcaaggttatgcccaacgcactcgacacgttcttgtccccgctgctggtgctcatcatcggcgcctttgctctgatgctcgtcatccagccggttggcgcatggctgacgactgccatctttagcgttttgacctttatcttcgagaagctgggcgtcctgggcggctatatcctgtcggcaggcttcttgccgctggtgtccgtcggcctgcatcaggcgcttacgccgatccacgctatgctcaacgatcccgacggcgctaccaagggtatcaactacctgttgcccatccttatgatggccggtggcggccaggttggcgccggtctggcactgtactttaagaccaagaacgccaagctcaagaagtatgtcgccgagtccatccccgttggcatcctgggcgtgggtgagcctctgatgtatgccgttacgctgccgctcgttcgtccgtttgtgacggcctgcctgggtgccggatttggcggcgcgctcgcggcgctgcttcacatcggcacggtttctcagggcgtttccggtctgtttggcctgctgatcgtcgttcctggccagcagctcggctatgttgccgccgtgctgcttgcctatgccgccggctttgtcctgacatggctctttggcgtcgatgagcagaagatcaacgagttctttggcgagtagtttgatagcgcgagccgcgttgctcagggctcgcggcgcgcggcagatttgttgatgctatcgttgtgccggcggggctaactgctccgccggccttttttaaggagcgttgaagcgtgaaaacgggtatttcgatttatctttccagtcctgtgcaggatattgagcggacgattgagcgtggtgccgcggcgggtgcgcgctatgcatttacctcgctgcatattcccgaggacgggggagcggcgtatgccgataaagtccgtcaggtgctgtcgctgctttctgtccgcgacattgcgctcattgccgatgtgggaccacgcacgtgcgatttgctcgggcttgagcgcattgaggacctgcgcgatttgggactggaataccttcgtttggactatggctttagcgcccagcgggtcgcggagctgtctagggtgtttcgcattgtggttaatgcttcgacggtgagttctgacgaaatcgcatcgtggcgtgaggccggagccgatgtgacccgttttgccgcctgccacaatttttaccccaagccttataccggtttagctctggaggacattgctcgggtgaatcttcgtcttgcggcgcttggattcgaaatcatggcttttgtacctggtgatgctaacgttcgcgggccggtattcgagggactgccgacggtcgaggcgcagcgcggtcgcgcgtcaaaggttgcccttaacatgcttgagcttgcacatggcgccgattgcgacatcgtgctggtgggtgaccccgatctttccgatgcgggctggacacagtttgctcaggtttccgccggatatgtggacgtgcattgcgagttggagtccggctattcctatttgcgggggcagattcatcacgatcgtcctgattcgagtgttcacatctttagatctcaggagtcgaggacgacgcttaagccggatgccgtgccgtcggattccggcgccggcttgccgcgaaaggcggggtcgattgctgtgagcaatagcgggtacggacgctacgaaggtgagctcgagattgcacgggtcgatcttaccggcgatgagcgcatgaacgtcgcgggccacattacgcccgaggcaatggagctgctgccattcatcaagcgcggattcggggtacggttcgtttagcgcgtgacccgtgggctacaattggcccatcgtgcgaaggcgccccgtatggcgtgtgcctgtgttggccgatttgtattcggaggattcctatgactgtactgtttgttgaatatcccaagtgttcgacctgtaaaaaggccaaggcgtggttggacgaacatggggtcgagtatatcgaccgcgatatcgttacggacaatcctacggccgatgagcttgcgacctggattgctcgttcggggctgccggtgcggcgcttctttaattcgtcgggtatgaaatatcgagagctgggcctgaaggcgcgcctggacgcggggatgacggatcaggagtgctacgagctgttggcgaccgacggcatgctggtcaggcgtccgctgctggtgggcgacgactttgtgattcccggctttagggaagcggcttggaccgaggcgctgctgtagcggctgcggaaagtgcgacccgttttgagtgctcagagtgggacgcattttccgccgacgggcccgccctagtcagtcctccagctgtgcccactcgtgtgggtcgtagacctttacgtgtttgttgggcgtaccgctccagtactcctcgtccataaagggcagatatgcctgaacgccgggacagataaagggaatgcgttgctgctgcagtcgctcgcgctggcgctgctccaggtgcgtctcggatatgacggtcggcatgccggatagttcgaccaagcttgcctggatgcgcttgaggtcggggagccctgcgtgccatgacgttcgcatgatcaaaaacgaggcgcggcggtattttgcctgcatcacggtgatggcggggcgcagtgtggggtggattttgccccggtcgggccataggtcggccgttatctcgagtcctagggtttcccataggtaatccagctcttcgttcatggcgcctcgatatccgcattagaattgatagcctgattgtgtcctcagatgccgcaacttcgttgaggtaatctgccaacggtagatatgggacgcttgcggcctttcgtcttcgtgcgcgatcgagggcttcacaggtccttcacgggttgggccaatttaggccaatttgaccgaatttcaaaaaagtcaaaattggggcttgcgtcacggcgggacttcccgtatatttctttattgcgcaaaggcacagccgagcgcagcgatgcagtcattgggatgtcgtctaatggcaggacagcggattctggttccgtcaatgggggttcgactccctccatcccagccattgcatttgctacatatggcccgttcgtctagcggtttaggacgccgccctctcaaggcggagatcacctacatgtacggatgaatatgggaggtgttcggatgaagttgatattcaagggcggtaatttgaacttaaaacgtctgtttgtcttcttcgccttcgtatctgacatagatacctccaaagaactcgagactgcatcgcatctcgcttcaacgtttgcacaaggcaaacgttctatgacgttctatagattaccagcagcttttctcgtcatcaagataatttcaaactgattgccgcaacgcggttgaacggttgcgtttgtgccgtgaacggtatggaaacgcccggtgagatgatccaccgggcgtctccattcgcaatgtcctagatgtcaaaaacgtagcgagacccaacgatccgctgacgaccgatgataaacggccgactttgctcatcaaaaaagaaggcttccatataaaacaagggttcgccaatgggaaccgccaacagccgagcgacctcgggcgatgcgcacacgatctcgagcgtgcacgggtcagtaaacgcgggcgtgcggcccgtccggttgtgcacgaactcaaaaatggattggttagatagaggtgccgttgatagataggcgttgtcctcgtaaacatatatgttgttctcgagcatgacagggacgccatcggcagtacgcacgcgctcaacgcaaatcaagtcagatccaacgggaacaccaaagaactgtgcttcggtggaatccgccggcagtatctttctcgaaatgacacgcgcccccggttccattccgttaacgcggcatacgtccgaaaaactctggacgtcatccttctgacgaagcttgcgcttaagcttgggggcattgacaaacgtgcctttcccctgtcgcttcgttagatagccctgctggacgagctcctcaatagcgcgtcgcacggtaacgcggccaactttatagctctcagccaattcgaattcgttgggtatccgcgcgcccgccttgtaggcaccagagttgatttcgtttttaatgatatcaatagcctgttggtacagcggtatcgctgctttaccgtcagttagcccttcagtcggtagcatataccctctcccaacacaattaagtcaaaagcgggctcaagggcattcaacaagcccttgagcccgcattagcattaattatgattgctgccgcgccaaaatgtcgggtatttactcatcagacccgaaaaacgcgcaactaccgcgctcctaagaaagcgtgagcagctccggcagccggtcgataatcttgtccgcggcatcctggctaaagccaaagcgctcctcgcgcttggcaatgactgtcaggccggctcgcttgccggcagtgatgccaggcaccgaatcctcaacgcagcagcagcgattcgcgggcagccccagcaggtccagcgcatgcaggtagatgtcgggctcgggcttgctctccttaaactgttcgccgctcaccacatactcaaaggcatccgacagcccacacgcattgagcacttcctcgatgctatccatgggagacgaactggcaagcgccacgcgaacgccgcggcgcggcagctctcgaatcgtatccacggcgcctgggttaatcaaagcctgatagtcgcgcggacgtttatgcgcccactcatcccaacgggccaacgcttcctcgccagtaaaatgccccctaccggcacgctcaaaccaatcgaccagcatgcggagaaagaactgatgcgaggtaccgacctgcccgttcagctcctcttgggtcaggttcaacccaagttccttggcaaacgcggcagtctcgcccaggtagtaatactcggtatcgacaatgacgccgtccatgtcaaagataacggcgtcgaacggaaatgcggacacggcaccctccctaacaaaaaggcgcccgcaagcggacgcccgaaccatgcactatcggcgattctaacccagcagctggtcaagtgccaccgcaatgccatcttcgttgttgttggcggtcaccatctgcgccacagccttgacctcgtcgacggcgttacccatggcaacaccggtacccgcccactcaatcatggacttgtcattctggccgtcgccaaacgaaacgacctcgctggcatcgatgccgagcttgggcagggcaccctcgagcgcgtgggccttgtcgataccgggcgccgtgtactcaaagtaccagtcggccgtaaacatgcccgaaagcgtctgcttaaagggcgcatacatctcctcgtaatgcgcctgcaggtaggctggatcgcccgccgtcagcagcttatccacgggacaagtgtccacgacctcatgcaagctctcgacctcacggatcttaaggtcgcacgcatcgcgctcgtatttgacgatgtttttctgcgagccgtcaggcagcgtgatcatgcaatggtacgagtcctcgacgtgcaaatcgcgaccgagcgaaatcataggaatcacgtcgaaattgcgcagatgatcaatcagacggtgcagttcgtcagccggcatggcctgatcaaaaaggacctcatcggtctgagcgtcgaccacgtgcgcgccattaaaggcaactagcagaccatcatggttttgaaggtcgagctcctgcgccaaggcgtgcagcccccatgcgggacggcccgaagccaagatgagcttaatgcccgactcctgcgccgcgagcagcttctcgcgcgtacgcgggctgatgaccttttggtcgttggtgagtgtaccgtcgatatccattgcgatggctttgattgccatatatgcctccctatcattgaacaaccttgtctgagccatcatacagaacacccacggcggctctgtctgcaacgggtaaaaagtcatattgtcccgaacatgaacggcgcgccttcgacgattgcgatgcccgtcgaggcgcctcccgatacattccatcctatccaaatagcaagggcccgtatcccaacggatacgggcccctttcagccataagccaactcggccgtaaaaactacttgcggtgagcgcggtagaactcgatgagcgcctgggtcgaagcgtcctgctcggccttggcagcgtcgtcgtggaaggccggggtgatctgcttggcaagctgcttgcccagctcaacgccccactggtcgtaggagtcgatgccccagaccgtgccctcgacaaacgtgatgtgctcgtacagggcgatgagctcgccgagcgcaaacggggtcagcgtgtcaccgaagatcgaggtcgtcggacggttgccctcaaagcagcgggccgggacgatctgctcgggcgtgccctcggcgcgcacctcatcggccgtcttaccaaaggcgagcgccttggtctgggccaggaagttgcccaggaacagctcgtgcacgtcctgaccgctgtcggtcgcagggttggcggtattggcgaaggcaatgaaatcggccggaaccaccacggtgccctggtgcagcagctggtagaaggcgtgctgaccgttggtgccgggctcgccccagaagatctcaccggtatcggaggtcacagcgctgccgtcccagcggacgtgcttgccgttggactccatggtgagctgctgcaggtaggccgggaaacggtgcaggtactggcagtacggcagcacggcgtggctcttggaaccgaagaagttgacgtaccagacgttgagcaggcccatcagcgcgacggcgttgttctcgagcggcgtgttgcagaagtactcgtcgatggcgtggaagccctcgaggaactgctggaagcgctcggggccgagcacgacgatcagcgacaggcccacggcggagtcgacagagtagcggccaccgacccagttccagaaaccaaaagcgttagcggggtcgatgccgaaggcctcgaccttctcgagtgcggtggaaacggcgacaaagtgcttggccacggcctcggcgttctgctcatcggagccgtcgatggcgccctgagccttgagctgctcgagcatccaggtcttgacctcgcgggcgttggtgagggtctcgagcgtggtgaaggtcttagagacgatgatcacgagcgtggtctcgggatccagacccttgagcttctcggcctggtcgttgggatcgatgttggagatatagcggcaatcgataccggcgtcggcatagggacgcagggcctcgtaagccatgaccgggcccagatcggagccgccgatgccgatggacaccaggtgctcgatcttcttgccggtaacacccttccactcaccggagcgcacgcgctcggcgaaggcatacatgcggtcgagaacctcgtgcacgtcggcgacgacgtcctggccgtcgacgatgagctggcccttctcgcttgccgggcggcgcagcgcggtgtgcaggacggcgcggtcctcggtggtgttgatgtgctcgccggagaacatggcgtcgcggcgctcctcgagcttcacctcgcgggcaagatcgcacagcagcttgacggtctcatcagtcaccaggttcttggacaggtcgaagtgcaggtcaccggcgtcaaagctcagcttgttcacgcgctcggcatcggcggcgaaccaggccttgaggtcgataccctcggcctcgagcttctcctgatgggcctcgagcgccttccaagcggcagtcgacgtagcatcgataggtgcggcaacagttgccatagagtcctcctcagcatacgggcgcacgcctccatgcgcccggacattcagatgccactattctagcgcaggtcaagactataatcagcgagcgttgccaatcggcccccaaacggcaaccgaccaaaaagggacaggtttaatttggcaggtcaaacgctttaccaatcaaaaataacctatccctttatgccaaatattaggccgcagcgcagacgctaccgagcaactcacgcagaggagacccgatgccctccagcagttcgggcgcgatgatggcaaaaacgggaacctcgccggcccccacgacggcaggcactttgccctccgagacgatacatccataaggggcaaaaccgtcttcgccggcatcgagtacggccatgcgacgagcgagttcgcgcgcaaagcccgccgtatcggcatcgccgatcgccaggacaaagtccacgccctcatcggtcgccagggccacggcctcgtcgatcagctcgtctcccccgtcgccttcaaccgagccgcagcgaaaaagcacgcgttcgagcagagctcgatcaagcgagccgagtgctgccgagacgagctcatcgcgcgtatgcttgtcaccgcccagtacaaccagcgccttggtgccaccgtagtgagcgaccaatcgcccgcaccagcgagccacatctccatccgcaacaaggcgcgtcggcataccaaacccataattgaccatctttcccacaacccttccgtgcgtataggcggtatcgttcaataggctcatgctacgaagcgagcttttccgagctgtttcgcgctctttagggctgcgttaaaaacccgatgcaaccgcacgaccatacctgccaaatagggacaggttttgacggtgtccggtcgagcaggtattatcgaacaggtattcgataggaacatgtgtttgatgggaggcacggatggcgcacgagcagcacacctacatctgcatcgacctcaagacgttttacgccagtgtcgagtgcgtcgaccgcggactcgacccactcactacatgcctggtcgttgccgacgaatcgcgcgggcgcacgaccatctgcctcgccatcacacaggctatgaaggaccttgggatacacaaccgctgccgtctgttcgagattcccgacggcatcgactgcatcaaggccgtaccgcgcatgcagcactacatggaggtgtcggcgaaaatctacggcatctatctggaatacgtgagtccgcaagacattcacgtctactccatcgacgaatgctttatcgacgtgacgccctatctggacctctatcacaccgatgcggaagggttcgcctgcacgctgcgcgacgaggtcttggcgcgcaccggcatcacggcgacggtcggcatcggccccaacctattccaggccaaggtagcgctcgacattaccgccaagcacgtacccagccgcatcggcatactcgacgacgggacctttcgcaaggagatctggccccatcgccccatcaccgacatctggggcatcggccccggcgtggcggcccgtctcgagaaatacggcgtctacgacctgatgggcgtcgccgcactcgacgagaacctgctctacgacgaactcggcgtcaatgccgaatatctcatcgaccacgccttcgggcgcgagccgacaaccatcgccgatatccaagcctatcgcccgcaagcgacctcgaccaccacaggacaggtgctctcgaagggctatgcctacgagcaggcctacaccgtcttgcgcgaaatggtcgacaacgccgtgttggatctagtcgacaagcacgtggtgtgcgacagcatctcgctctttgtgggctatgcaagcgagcgcgccgacatacgccggctcaacgccagcggcacggcgcagtatatagacggctgcgggcacctgcgctcgagcacatcgagcatcgaacccaccgcaactgccggccccgagctcgcgccccgtgctcccaagcccgtccagcgcgatgacgaaaggcgtcgtctggtgcgcgaagcgcaggcaatcgatggcatctttgtgggcgaacacggcggcaaaccgcgtggtggctatgccgcgctctttgcgcactccaacgcctcgcgaaagctgcccgagcgcactaattcgtttaagaaaatcatggggtatttcgatgacctttgggcacaaacagtcgatcccaaacgaccggtcaagcgcatcaacctgggatttggcaacctcatgcccgaggaatttgccaccatcgatctgttcagcgatatcgaggccgatgagcgcgagcgcgacctggcgcgcgccgtcctggccgtgaaaggcaagtacggcaagaacgcgctcgtcaagggattaagctttaccgccggcgccaccgcgcgcgaacgcaacggccaagttggaggacatcgtgcctaaacccaagcagcagcccgtgcgcccgccgaccgccttcgagcgcctggcggaccccgagggcagacgccgcgccgccgaccccaagctcactgccaacggtgccgtgcgcgccaaccgcgccgcacagtttatgccctttgccgccctcacgggatactacgaactcgtgcgcaagcaggaaatcaccgtcgagccaaaacgtgagctcacggaagaaaaagccctcgcgctttctaaaaagctcgagggtctcaaacgtggcgacttgattcgtgtcacctattacgatacatacggctatcgcagccgcaccggcatcctcgacgaggcgctccccgccttcaagctcctcaaactccgagacatcgccatcgacttcgacgacatccaagacatcgaactgcgcggacgagcctagccaaggaagcgcatccagggcggcgcttacagagtcatgatgtagtagcccgcgtctttcacggccgtctcgaggacaccacgatcaaccggctgcttagagcgcacgcgtgccgtgtggtccgcatacgtcaccgttgcccacacgccatccagcgcattgagggcattggctacgttctgagcgcagccgtcacagttcatgccgccgatgagcagctcatcgctatagggatagtgtgacgcatcggtatccaccacaacaacctttttggccttcttgccgctcgtaccatcgctgcagcaactcttcccgtgtgtcgaagcggcaatgcgacgcagtccaaaaaacatgccaacggcaatgacggccagcacgatgagattcgcagggttgagcaagtcactcatgcgctcccctttcaagtagcactatctagatacccccatggggtgcccccatcttaacccaaaatcatgtctgttcggtcaattagtttccctcttcaaacttttttgttgaccatggcttactttcgtgtataagttttcctaggctaacagtttggatccgcaaggagcgacgtgactcgaaccatagacatcccaacgtttcaggcggcagtcgtgcgcaactgctctcccacgctcgcgggcatcaagccggcatcgctctttacctatccaggcacctacgcccacggggacggctcgaccacaaccgaaaccattgcagaacgccgagcacgcctgctcaacgttatcgcccagtgcaatcgcgagcttgacccgctcggcatccacctgagtgttttggtctggcggccctgcggagcgctcgtgtacgcgtaccgagccaaaagcctcaccacctatttcgcagaccctcgcgtccaaacggcgctcacctcggaaggctacgacacgagagacctttcggcatgccttgtgcatttggcatcacgcatcacgctcgcgagcaataacgtcgcggaatgcgcctgcagccagactcgatgcgcactaccccagcaagctagctgcagcaaagactgcacctgcgagtttccgcacgaaataggctacttccttggatatccctacgacgacgtgcacgagtttatcgtccagcgcggcgagaactacaaggtctttggggcctggaaggtctacacgaatgtcgagcaggcgcttgcgacgtttgatgcctaccgcgcctgcacccaatacttcacttttatctatcagcagggctgcagcctggcgcaacttgcccaggcaacccgatagaacgtacaagccgcggcaagcgccgcacgaccgaaaggacaaaacatgagcaagaccgccgtcgtctactggagtggcacgggcaataccgaggccatggcaaacctcgtcgtcgaaggcgccacgtccgcgggggccgaaactgaggtcatcccctgcgccgacttctctgccgacaaggccgccgaatatgatgccttcgccttcggctgccccgccatgggctccgaggagcttgagtatgacgagtttcagcctatgtgggacgaggtcaaggagaccctcggcgacaagaaggtcgtcctctttggctcctattcgtgggccgagggcgagtggatggacaactggaaggccgacgccgacgaggccggcgtcaacgtcgtcgattccgtcatttgctacgacgcccccgacgatgagggcgaggcggcctgccgcgcccttggagccgagctcgcgtaacgaaaccagacctccaaaagagcctgtatcacagcgcatccccatccctacaaaagagcgggggctggattcaagtccagcccccgctcttttgtaacggcagttacatcaaccggctacgagatatttcccaagaacgccttggtgcgctcgctcttggggtggtcgaagacctcgctcggcgtaccctcttccacaatgacgccgccgtccataaagacgacgcgatcggcgacatcgcgggcaaagcccatctcgtgcgtcacgacgatcatggtcatgccgtcgcgcgccaagtcgcgcatgacgcccaggacgtcgcgcacgagctcggggtcaagcgccgaggtggcctcgtcaaagagcatgacgtgcgggttcatcgacagggcgcgggcgatggcaacgcgctgctgctggccgcccgagagctggctcggcataaagtcgatacgctcggcaagaccgaccttggtcagctcctcgacggcaatcttctcggcctcttccttgctgcgcttgagcaccttctgctgcgcaagcatgacgttctttttgactgacaggtgcgggaacaaattgaactgctggaacaccatacccagatgcgtgcgcactttgttaaggtcgacgcccttggcgcacacgtccacaccctcaacgacaatcgagccactcgtgggatgctcaagacggttgatgcagcgaagcatcgtcgacttacccgagcccgagggacccagaactacgacgacctcgcccttatgcacatccagatcgatatctcgcagaacgacgttatcgccaaaggctttctggaggttcttgatactgacgacaacctcgttcgagttattggtttcgctcatgataggacctccttacagaccggcgatgtgatcggcgggcgtcgcgacaacctgtccggcgctcttggcgggacgcttcttcttggtctcggccgtgcctaaaagccttgcctcaagaccgctcaccaagcgagcgagcggcagggtgatgaccagatagaacagggcggcaaccacgtacggtgtaatggagcccgtcgtggccacgatggtgcgggcgttcatgacgatctcgaccacgcccacagccgcgagcagcgacgtatccttgtaaagcaggataaattcactggtcagcgtaggcaggacattacggaacgtctgcggaatcatgacatagaccagcgtctggaacgcgttcatgcccagcgaacgcgcagcctcgttctggcccttggggatcgactgaataccggcgcggaagatctcacacagatacgcagacgagttcatggccatgacgatgacgccgagcacgtagtcgtccaccttgacgccggccaacggcagaccgaagaacgcgatatagatctgcaggaacgccggcgtaccgcgaatgatattcacatagataccggcaaggcaacgcaggatgcgcgacttggagatgcgcatgagcgacagggcgaaaccaaagggaattgccagcggaaacgccacgagcacgatcgagagcgacatgaggaagcctttgaagacgatcggcaggctctggaccaaaatgaccgggttcaggaacaagcgaaggaacatgttggaattccatgcctcgacccacggctgctccttaaggtcggccaggaagttatcgaatgccgtcacgcccttgatctccaccgacggaatcttggagatcttcttggtcgaaccatcggccaaagtgtaggtgccgctaaaggcctcgtcgccgccctcgacggggaaggtcacgccgtagacctcgacacggaaataaccgccggcgggcgccgtctcaccaaaatcgatcttgagcgtctgaccatcgaccttgcacgtgggcttcatgggcgtacggtccataaggtcatcgcccgagagcatcgtcagacgcgtgtcgtccgcaccaaaggtcgtgccatcgacaaacgtcagcgaaagaccgctcagctcctcatcggcatcggcctggacctcccaggtgatacgagtctcggtgccaccgaccacgtcgctacccgaaccggtattgggtcgggcggtgatctttgcggtctcaagtgcctgagcggtcgagggcacgcaggcccccgcgcataccagggcgagcgccacagccagggcacaggccagcttttggagcatcaagggcagtggatggctcttgcccatggctccttggttcaatcgagacaaggtggctcctaacgtttaagttgccgacataacggggcgggatgacgcccattcaagaaacgcaaaggccctctccgccaaaacggaaagggcccgcttgcaatcaagtgactattctacttgatgttgtacttagccatgagggcgtcaacggtaccgtcgtcggtcaggtccttgatagcctggttgatgtcgtccttgagcttggtattgccctggttgatggcgatggcgtactcctcgccggtgctgatctgcttgatggtctggcaggtgttgaactgctcggcggtcagctggctggcaacggagcggttggtgactacggcgtcacccttatcggactgcaaggcgctgaagcactcggtagcatccttgtaggggacgatcttggccttggggaagttctcctgggcaaaggcctcggcggtcgagccagactggacgatgatggtagcgtcggcgttgttgagcttctcgctgtagttgtcagccgtgatgtcggcgttatcgaccttggtcacgatggcctgatcgtccatgtagtaggaatcggagaaagtgacttccttctcacgctcgggcgtgtcagtgatagccgcgatggagacgtcatacttggcacccgaagcgacgcccggaaccagcgtgtcaaagtcattgttgacgtactcgacatccaggcccagcttgtcgccgatagccttgataagctcaaggtcaaagccctgataatcgccgttgtcgtccttgtactcaaacggggcgtactcggcagaggtgccgacggtcagcgtgccgtccttgacgagtgcgtactccttggagccgtcgaccttctcgaccttagcgtcgtcagagctgctggaaccggcatcagaaccagaggtggcgttggacgagccgcagcccgtcagagcaagggcgagcgccatagcacccgtggcggcaaatgcgccaagcttcttgagcttcataatcagtctccttccggtgacctcgtttgattcagaggtctgcaaaaactgttggctattatgcacccggaattacgaatctgcaatgagaaaactgattgaaacaaacccataacgtgaatggaatactctactttgtgacagtcattactgctgcaacgaccttaatagtctaatttcagctgcataacctgcaagttcgttcggagtctccaaaataaacggcagcgaacgcaaacggccattcgatacaatattctgcataacctgcataccgccaccaaattcttcgctgccaaggtatcccttgccgatgcactcgtggcgatctttatgggcgccacaagggttcttcgagtcgttgatatgcacggcgcgcaagcgctcgatacccaccacgcggtcgaactcgtcgagtacgccgtcaagatcatggatgatgtcgtagccggcatcgctcacatggcaggtgtccaaacaaacgcccagcttatcggacagctctgggcacttggcggcaacgccctcgataatgcgcgccagttcttcaaagctacggcccacctcggtgcccttgcccgccatggtctcaagcaataccgtcgtctgctgtccctcaaacatcacctggcacagcgtgtcgacaatcatctgaatgccggcgtctgccccctgtcccacatgcgcaccgggatggaagttgtagtagttgccgggcagtgcttccagacgctgcaaatcttccgccatagcctccaaggcaaactcgcgcgctcgctccttagcggagcaggggttataggtatacggggcatgcgccaccagcggtccaaagtcgttttgcgccataagctcgcgcagagccgccacgtcatccatgtcaaggtcttttgccttgccaccgcgcgggttgcgcgtaaagaacgcaaaggtattggcaccaatggacaacgccgtctcccccattgcccgatagcccttcgtcgtcgaaagatggcacccaatcgtcagcatctccagctccccctcatcagttgcggtgaaatacggtctattggtgccttattttggcgcaaacagaccgtattccaccgcaagatataaaaggggcatcaggggcaaggtccgccgagcccccttgagcaccagcaccgcagcctagagcgtcaagcgaatcgcatcgataatctgcgcgcagcgctgcgtggcggcaagaggcataacggggctttcaagctctcccgtctggacgagctgcgtcgcatgctgaatttcgccgtagaaatcatcgacttcaaacggaacattaatttcgagcattcgtccgtcggagtacttcacatgggcgagctcggggcgatggaggcgctcgatttccaccgaaccccgttcgcaggcaatcgttaagcggctttcatatgctgctttgccgtcgcacaccatatgaatgggtataccgccgacactcatatggatctcatcggcccaatccacgcggccgcctaatacgtcacgccagcgaacttcacgagacgaaacatcgcacgcacccgcaagcagatcctcaaaccacccgaccgcatagcagcccatgtcatatagacagccaccctgcaacggatcgagcagataactcgaaggggactcaccataatcgagtttttgcacgctttcgatcgagacgatacagccgagctcgcccgacgcaagcaaacccttcacgcgagtatgcatcggacaaaaccgatttttcatcgcctccataaacggcacaccgcactcacgggaaacagaggcgatcgcatgggtctcttcttcattcaaaacggccggcttttcgcacagcacggcctttcccgcgcgcagtgcccgacaagcccaatgtgcatgcatgccatgtggaatagccaagtagattgcatcgacatcgggatcggcaatcaacgtatcataagccgcatcgccgctatcgccagccgtggcataactgtgcgcggcatcaatcgaaaacgctcgacaaaatttctcgacatgtgcaggagtgcggccggccgcagccaccagccgtgcctcgtcgaccttcttgagcgacgatgcaaatcgatgcgaaatgtgcccagcgcccaaaacgccccaacgaacctcacgcaaatcatcacatgaatcccgatagcccacgacagcccccttcagttgcggtggaatagttcctgtttaagccccattctgccgcaaacaggaactattccaccgcaagttataaaagggtcatgaggagcgcgttttgccgaaggccttgagcaccgccgtcacggggccaggctgaaaacggcggcgtacgtcgtccaagcgcccggggatatcgatgtgctgcgggcagtgacgtgcgcatttgccgcacttgacgcaattgctcaccagcttgggctcgttcgtccgcaccgcgctcgccgtaaagtattgagacagccccgtaaaccaactatgcgcgtaactcgcgttgtaggcggcaaagcagccgggaatattgatgcccttggggcatggcatgcagtagccgcaccccgtacagggtacgcgattcgatttctcaaactctcctagcacacgcgcgatggtatcgagctgctctgtcgtcatcgaatccggcagcgcgcgatccgccagcaccgcgttctcgtccacctgcgcggtatcggtcatgcccgaaagcagcatcgtgatttgaggatggttccacacccacgaaaggccccaagcagccggcgacttcaggtacggatcgcgtacgtcatcgagcacggcgcgggcccgcggaggcagcttgcccgccaggcgtccacccaaaagcggttccatcacaaacaccgcgagcccgcgctcggcggctgctataagtcccgccgtccccgcttggtagcgctctccagcgtagttgtactggatctggcaaaaatcccagtcatacgcgtcaagcatcgtgaggaagtccgccgcactgccgtggtacgaaaaacctatctggcgaatacgccccgcagccttttggtgcgcaatccagtcctcgatgcccaacgccaccacgcgctcccactgggcgggcgaggtgatgttgtgcataaggtagtagtcaatatggtcggtccgcaaacggtgcagctgctcgtcaaaaaagcggtcgaaatcctccgcacatttgcacgaagcgtgcggcaacttagtcgccagcaacacccggtcgcgcagccccaagcgctcaagtgaggcgcccacgcacacctcgttaccgggatagagatacgcggtatccagataattaatcccctgctccaccgcacgggaaatgatggcatcggatgtcttcgcatcggggtgtcccggcgcaccgggaaatctcatgcagcccagacccagagcggatattcggttaccacttttggggtcaacgcggtattgcacgccccctcctttcgccatcagcaccccggcaagacgaaacacaatggtcacgccatcgaaacacattggaatcgcaatcgagaacgtatcgtaacgtagcagaaatcgagctgtcacggcaccgctttaacatcagcaaaaagcccgatgaaaggagccgcccatgcccgcgctcgacctttggaacctcgcctcccagctcaaaagcaacgattatcgctgggtcgacctcacccacacgctctcatgcgacaccccgcactggtttggctttaagccatttgagtccaccaagctcttcgactacctgcccggcacgcccgaggacatgctcgcgcccatgcgttgcttccagtattcggtcgcctcgcagtacggcacccacgtcgacgcgccgcgccacttccatgtcgagggtcgttcccttggagagattgaacccatcgagtttatgcatccgctctgcgtgatcgacaagcatgaggagtgcgccgcgaatcccgactttatcctgaccatcgaggacctcaaagcctgggaggatgagcacggtcgcattcccaaggacgctttcgtcgccttccgctccgactggtccaagctcgccgacctcgagaacaaggacgaggacggccagccccactaccccggctgggacctcggcgccatcaagtggctcgttgaagagcgcgacatcggcgccatcggccacgagccggctgacaccgacccggcgagcgtgaccacgcgtgaggacgcctacccctaccccggcgaacagtacatcctctcggtcgaccgctatcagatcgaggtcatggaccatctagacgagcttcccgccacgggcgccgtcatcttctgcaccttccccaaggtgcgtgatagcgtcggatatcccgcacgtgtctttgcggtctgccccgcgtcataagttcccatgcgtttgttcttctaaatacggccatccggtgcacgcgacatggcccggcggcatacaatccatcaggcgccccatacgcgggcgcctttttatggggagatgattcacatgcagatcaacaaggtcgccttcatcggcaagggcggcgtgggcctgctctacggcagcatgatcgcccaagcgctcggcaacgacgccgtcgaatacgttatggacgacgcgcgctttgagcgccacgcgggtgatgcgctcaccgtcaacggcaagccctgcgcgctcaagtccgtccgcgcgagcgaggcgacgcccgtcgacctggtcatcctcacggtcaagacaaccgggctcgatgtggcgctcaaaaccctggaaagcgtcgtgggacccgacacgctgatcgcgtcgctgtgcaacggcatcacgagcgagcagaagattgccgagcgctttggctgggagcacaccgtccttggtatctgccagggcatggacgccgtgtttctcaacggcgcgctcacctttaccaatgcgggcgagatccgctttggtgcggccgccggcaccgaccccgcgaccgtcaccgctatcgacgggctctacacgcgctgcggcatcgcccacaccgtcgaggacgacatcgcccaccgcatgtgggcaaaacttatgctcaacgacggcatcaaccagacttgcatggcctacggcggcacgtacggaagtgccacggaacagggctccgagcagctccgcagttttgtctccgccatgcgcgagacgcttgcggtcgccaacgccgagggtatcgagctcaccgaggcagacctaacgcagatggtgcatctcatcgaggggctcgaccccgccggcatgccctcgatggcgcaggaccgcgtcgcgcagcgcaaaacagaggtcgaggagttcgcgggcaccgtccgccgcctcgcggccaagcacgatatccaggcgccgcagaacgaatggctctatcggcgcatccgtgatatcgaggcaagctggtaacgccgccgcaccgcatccaacagtctcaatagcaaaaaccgccgcaaagggcactccccttgtggcggttttcatgttcagccacggccaacagtcattttcgcaacagctagagatgcgactccggaacctcgtcctcatcgtcgcgacaaaggacaacaccggcgcttcccagcagtgtgaccgcgatcagcgcgccgaccacaataggagcagccccgcacgagccctgcatgcctgcgacaaacgcagctgtagggccaagacagccaagtaccaatgcgacggcggcgatagcgatatctcgagcgttcatgagaccacttcctccacgagaaagaccttatttctcatgaaccagtgtgccccgcatgcatacgcccagcgtaccgccacggtaagggctctgttaactcaaacgcacataaagaaagggcggctttacgttgcctaaaagctcagtaaagacgcccgcccatcatgtgcctattttgctctgatggcagattaccaaccggtgtagtagtcggtggttccggcggcgcagccggagtcatagaccttgcaatcacccttggagcccgtaaaggtcgagccctgggccatatcgcccgcggcaacaacgtaatagccgtcggaatcgcgccagaagccctcagaatcctgagtccattcgcccgtgcgatagtgataaagcacattgctgctgtaataggtctcgcggcgcccgttgtagttattgacacccgcagagcgcgtcaggcccgatccgttcgcgtaggacgcggcagacgcgtaggacggagtgtagccggcgttgtagtacgaagcctgggcggcctcggcagcctctgcctcggcggcagcggcctcgagcgcttcgcgcttggcattctcaagcgcagtgcgcagctcatcgagctcggtcgacttcgcgtcgacctcccccatcgtcaaaaggctgcccgcaccatcgatacaaccctgcagcacagcgcgctcgtcatcggtggcatagtcaccatacatgtttaggataatctgagcgcgcatctcaagggaatcgcgcttggcctccatcgaggcgttccactcctgcatggaaccataaccatcgccgcgataatcaacgggctgtaccagcgtcgtctcggacggcgtagatccaaccgtatcggacagtgttgccgcgtgggcatcagttgtgccggcgcccgccaaaagcgccacggtcagagcggcggaaagggcggcggctttcggttttcgtgaatcgatcctcatgtagctggaaacctccgtagtgcgtttttgctgcgtttgagctgcgtgtgattcgatcgcgctgcatagtacctcgagcaaatcgcgacctgcggttttactcaaaaggcgcacgtcaattgcgtaaaactcacatcctctcaacaggagttttccacaactcgaatgcataaagcatgccaaaaaccctgtaatagcgcccttcctatgcaaaaaaggcgcctgcgcaaccattgcttgcgcaggcgccttgagcaggcattttatgcagttatacctatcgagtcgcaaggggtccttgcacaagtcgccttactcgtccagcgcggcgaaggcctgcttcagatcccaaatgatgtcctcggcgttctcggtaccgatggaaagacggatcgtggagggcgtgatgttctgctcggcgagctcctcggcagagagctgggagtgcgtggtggtagccgggtgcacgacgagcgacttgacgtcggccacgttggcgagcagcgagaacacctgcagatgatcgatgaacttccaagctgcctcctggccacccttaatctcaaaggtgaagatcgacgcgccaccgttggggaagtacttctgatagagctcgtgatcggggtgctcagacaggctcgggtggttcaccttgacgacatggctgtcaccagccaggaactcaacgaccttcttggtgttctcgacatgacggtcgacgcgcagcgacagagtctcggtaccctggagcaagatccaggcgttgaacgggctgatgcaggcgccctcgtcgcgcagcaagatggcgcggacataggtcgcgaaggcagcgggaccggcagcctcggcaaacgagacgccatggtaggaggggttgggctcggcgatctgcgcatacttgccgctcgccttccagtcgaagttgccgccatcgacgatcacgccgcccagcgaagttccgtggccgccgatgaacttagttgcggagtggacaacgatgttggcgccatgctccagcggacggaacagatacggggtgccgaaagtgttgtcgacgacgaccggcaaactatgcctcttggcgatctcggagatggcgtcgatgttgggaatgtcggaattggggttgccgagcgtctcgaggtagatgaccgtggtgttgtccctgatggcaccctcaacctcttccaggttatgagcatcgacaaacgtggtctcgacgccaaactgggagagcgtatgctccagcaggttgtaggagccaccgtagatggtcttctgagccaccacgtggtcaccagcctgggcaagagcctgcagggtataggtgatggcagcggcaccggaggcgacggcaagaccggccacgccaccctcgagcgcggcgatacggtcctcaaagacgccctgggtggagttggtcagacggccgtagatgttaccggcgtcggcaagaccaaagcggtcggcggcgtgctgggagttgcggaacacatagctcgtggtctggtagataggcacggcgcgggagtcggatgcggggtcggcgctctcctggccaacatgaagctgcagggtatcgaaaccaaaggtgtgctcggggttgttgatgaactggctcatgatgatctccttgatcgaacgaaagtaaataaataagagaaaagtaagtcgctgtctcctgatcacgccaacgggcgcaaacaggagcccggcattcgtcttggcaagcagttcatatgcggtcctccttttgacatcccggttccgtggtcggcttaattacctacctcctttgtatgttttgaatagtacgagcattgtttcgctcggtcaatcacttaaaagcgctaacctgttatcggttttttagatagctatcgaaaggacgggcaccgatgaccctccagcagcttcgttttcttatcgccgtggcagagtccggctcaatcaacgccgcagctcagcgcctctataccgctcagtccaacatctcaaacgccatcaaaagcctagaacaagagctccatctggagatctttacgcgctccagccgcggcgtcacgctcaccaacgacggcaccgagcttttgggctatgcgcgccaggtcgtagagcaggccgacatgctcgaggcacgctacgaggacggtggcaccccgcaagcccgcctcgccatttccgcccagcactacgccttttcggtcgaggcctttgtcaacgtagtcgagcgctgccgcgacagcaagttcgagttcatcatgcgcgagaccaccacatcgcagatcatcgatgacgtccgtgcgtttcgcagcgatatcggcattctgtatctggatgactttaacgcccgcgttctgcagaaggccttcgccgatgctcgcgcaagcttccatcccctattcgacgcgacggtccacgtcttcgttagcgagcgccacccgctcgcacgccgcccgcagctgtcccttgccgacctcacgccctatacgcgctacagctttgagcagggaacctcaaactccttctattacgccgaggaaccttttagctatatcccttgcgaccgcaacatacgaatctcggaccgcggaacacttactaacttacttatcacgtcgaacggttacaccctgtcgaccggtgtcctctccaatgaaatgcaatggggcatggcatcgatcccgctagcagacgccccaacgatgcacgttggctacatcatgcacgacgagcgcaagccctctctcctcttgcagcaatacctcgacgagctcaaccgcatcatccatgccaactaacagtcggaagacggggtagaaatcgtagattgctggcccccggcgggcatggcgctacaatggtcactcacatgaaatgcactcaacgaaaggaagcccgtgaaggtcatcatctacaccgacggctcggcccgatcaaatccgggacgcggcggctacggcgccgtgctcaaatacaccaaccccgccggcaagaccttcacctccgagctttcgcgcggctacgccaagaccaccaacaaccgcatggaactcatggcggtcatcgtggcgctcgaggcgctcaaccgcccttgcgaggtcgaagtccattccgattcgcagtatgtcgtcaacgcctttaacaagcactggatcgacggctggaaaaagcgcggatggaaaaccgccaacaagcaacccgtcaagaaccgcgacctgtgggagcgcctactcaccgccaaaagcaagcacaaggttgagttcatctgggttaagggtcacgccggtcacgagctcaacgagcgctgcgatgagctcgccaccacggcggccgacggcagcaacctcgatatcgacgccggctttaacgagagcgacctgtaatagcgttttcgcgcagctttatatccccacgcgctacactcatcctgtagaccaaacaacgcaagggggacgtatgctgcgcatcgcgaccatcggcacatccatgatcaccgacgactttatccaagtcgtcaacgccaacgaccaagccgcgtttgtgggcacgctttcacgcgatgccaatcgcggtgccgcctttaccgccgagcgcggtggcgagcgaaactttacttcactcgatgagctcgcggcagccgccgacgtcgacgccgtctatatcggcagccctaacgcacttcactacgagcaggcccttgcctgcatcgccggtggcaagcacgtcatcgtcgagaagcccttctgcgccaccgaagcgcaggcgctggaagtcttccgcgctgccgaggcggcaggtgtcgtggccctcgaggccatgcgtcccctccacgaccccgccttccacgccatcgaggacgccctgggcgagatcgcccccatccgccgcgcctcattgcgctttggcaaatattcctcgcgctacaacgagattctcgcgggacgcgccaccaatatcttcgactgcaatatggcatcgggttccctcatggacattggcgtctacaccgtcgagcccatggtcgagattttcggcatgccctccggccttacgagcatggctactctgctcgaccccgccacgcgacagctcacgcacggccccatcgacggctgcggttccatcctcgccagctacggcggtggccgcatctccgtcgagctcgcgcactccaaaataacgaatgacctgctgccctcgcagatcgaaggcgagcgtggcactatccagatcgaccatctgtccacgccccgcaacgtccgcatcgactatcgcggcgatgtcgtacgcggctcggcgaccgaggcaccgcgcgaacagggcgacaacggccgcgtgctcgacctgcctaaatcgagcaacactatggaatacgaactcacagactttatcaccgccatcggcggcatcgataacgttaaggaagagatttgggagaccccggcgggacgtcacgaacttggccactaccgcgatgtcacgctcgtctcattgcgcatcatggatgccgtgcgccagcaggccggcattaccttcccgtccgacgcaggcaagcaggcctagcgatgggcttcttcgatgcgttcttctccagcgtcaccggcggcagtcgagagcctcaaaaaccatcaaacattgagttcgagttgcgccgcaggcttactgtgctcgcaagcgacgaggccactcaagacactcccctgcgctatttcctgcgttgggcggggcaagtccagggcgttggttttcgctttaccaacaccaacctcgcgcaggtacgcgcactcaccggctgggtgcgcaacatggaagacggctcggtcgagatggagatacagggagctccggcaaacgtcctatctcatctcgaggcgcttcatgcttcctacgagcgcatgggaacgcgttttcgcctcgtagaagcccagacccaagccccacttgccaatgaagacagtttcattcctcgttattagtattgtgtgctaaatacggtatcatttacctacgaccgttgatagaaaagaggcgaggcgcatggcggtgcaaagaaggaataccaagcagcgaaagctggttcttgacgccgtgcgccaaagttataaccatcccaccgccgacgaaatctacaacgtcgtgcgcgcgcaggatgacaaaatcagccgcggtacagtctaccgcaatctcaatctcttggccgacgccggcgagatcctctccatcaagacgccgggcggcagccgcttcgatcgcacgatcgagccgcatgcgcatatcatctgcacctcatgcagccgcgtcatcgacgtaccgctccccttcgatgcccagctcgacgccagggcgtccgagcaaatcggctggcacgtcacgtcgcactacaccatcttcgagggtctctgccccgactgccggtagatgtttgggacatgcctactcagcaagtagacgacgcagctcttcttcgaccgtgcgcacgtagcggacacggtcattgacaccgcgcatgctgggattgcagctctccatcagatagggatggcccaccacgttgagcatgtcgcgatcgttttcgttatctccaaacgccatcatttcgttaggtgagatccccagcgcacaaccataatcggcaagcgcggaccccttgcccgaatcaaagccgataaagtcggtccattcggttcccgacgtcatcacatcgacccggtcgctaaagcgacgcacaaaatactccagcgccgccggctgctccgcctcgggcgtctggaaggcaatcttaatgacatcctcgtcaatgtcttcgggacggtcgactaccgccacatcacaatggacctcataacgcaggtggtcaacaaacgcatcgttgctgctcatggtgtagaggtgtccctcgcacgaaagggtcacgtcggcatgggggtacgcaaccacggcattcgcgatatccatggccaggccacgctccatagaacgcttgaccacggcacgcccctcgctcatgaccagggctccgttttcgcatacataggcgagttcatcggccaccggggcaaacaggtagcgcaggctcgcgtattggcgaccgctcgccggcataaacacgataccgcgacgatgcagctcatcgataagctcaaaggccacggaacgcggctcgcgctcccccggatgcagcaacgtgccgtccaaatcgcatgcaatcagcttgattccctcaagacccatatgcttcccccaaagcctcctatcaacagcaagacggaccttgatcggtcacccctcaaagcccgtcttgcgcatacgcgcgcttagtcgcgcgtctttttaacgatggtaaagtccggagccatgctcacgacaacatcggccgcgctcgacgtaaagcgtcgacccgcatcgagctcgtgcgaaacaatcgagattcgagctccctcgacaccgcgaagcatacggcccaaaaccggctgcaccggcgtatacatgcgcacggtatgctcatccgagtcaccccggaagagcggcgcatgcatgttgccgatctcccagcacgcatgcgcgagcgcaatcggatccatgcggtcgacttcgaccaaataaacctcggcgctgcgcaggcgcacgacaaccgccacgggcaccatgcccgaacggtcaatggcgagcacgtcgccatcggcaagacgaccgccgtcggcagtatccaaccgaacatcgatcgtgcgccccagctccgtcacgcccacaaacgcgcatgcatcagcctggtcccaatcgagcagtagctcgtcaacttcaaagacaccgcccagctcccggcgaagcaggagttcataggacggatcgttgagatttcccaagcatgtcgtcgaaaccaagcgttcaggcatactctagtcctcgacctcgacgagctcgatatcaaagttgagatccttgccggcgagctcgtggttggcgtcgagcgtcacggcctcgggcgtcacgtctatgaccacggcggggacgggcatgccgctcggcgtggacaggaagagcttcatgcccttctcgatctgctcgatattggggacctgctcagccgggaaggtcaggaccatctcgggattgtgctcgccgtaggcatcggcagcgggaatgtgcacggtcttcttctcgcccacctgcatgtcgacaacagcggcgtcgaagcccttgatcatctgaccggcgccgcaggtgaactccagcggctcgccgcgatcgtaagagctatcgaactgcgtgccgtcgtcgagcatgccacgataatgggtcttgaccttcttgccctggttggacatggtaacctccgtgataagggcggcgcacaacgcgggccgccatgaacatatggcgctaactataccctagtcatacaatttgaagacagtttgcaaagaaacgctgcaaccggaggaactatggcatatcccatatttgacctacactgcgacaccgccgaccgcattggctgggccacactcgatctcgacttgcgcttcaccgccggcagcgacggttatttccccggcgacgagacgcatccgcaagacttcgacctcatcgagggcaacgcctgtgccatctcactcgcaaagatcggcaagaccccgtgggcgcagtgcttcgccacctatattccggacaagattcccgccgcccacgccgcgcgcttccaagcgcagatcatggcgcacatgagcggacaggccatgctcaaccacgaccgcatggtcaacgtgcaaagtgcctcagacattcgtcccgcgctcaaggacggcaaggtcgcctgcatccacaccatcgaaaacgccaccttctttgccgaggaccccgcgctcatcgaggtactcaagagcctgggcgtactcatgtcatcactcagctggaacgcgcagggaccgctcgcgagcggacacgacactcatgccggtctcaccgctgccggcatcgaggcactcacgcagatggagcacgccggcatggtactcgacgtctcccacctcaacgacgagtgctttgacgaggttgtcgcccatgcaacgcgccccttcgtcgccagccactccaactcccgcgcggtttgcggcgtcaagcgcaacctcaccgacgaccagttccgcaccattcgcgatatgggcggcatcgtcggcctcaactactgcagcgagttcctctctaacgaagcgacaaaagagaccgccgcagacgtcaccttcgaccagctggctgcacatatcgagcattggcttgacttggatggcgaggacgccatcgcactcggtggcgactgggacggcgccacggtacccgacttcctctccgatgccagcaagatgcctgagttccaaaacatgctctccaagcgctttggcaagaccgtgatgcaaaagctctgcagcgacaacgccctcgccttcttcgagcgttattaatttcacatcccttgagcgggccggcatgccggacggtcgacatgccggcccgttcacaatccaaaggaccgcttttgacgcagcagtttacgatttccgcatctcgaccggatggcacatccatccccgtcatcgtcaccaaaaagcgcgtcaagaactttaacctgcgcgtcacttcgagcggcgaggtccacgccagcgcaccgctcggcgccagccgcgagcgcatcgaggcattcgttcagcgtaacagcgtgtggattatcaaccgccttgctcggcgcgagcagcgccaggcgacaaccgacgaaccgctcagtccccgctcgaccattgcgctttgggacaaacccatcactgttcaggacgcactcgaccacaacttcgaatcgcccgcaccgcggcccaagcaagccacgttcgcaagctttatgggtgctagcgaaccggatggacgcccacaggcccggcaacatgcaaacttcgacggcttatcacccgaagagctccaagcccgcatcgatcaactctatacgtccgaagtcgccgcagcgctgcgcgacatggtgcacgcgtacgaaatcgccatgggcgtcaccgtggcccgcgtctcggtacgcagcatgaagacgcgctggggctcatgcacgcccaaaaccgccaccattcgcatcgcacgcgagcttgctgcctaccccatcgaatgcctcgacatggttgtcgcccacgagctcgtccacttgctcgagccgagccacaaccagcgctttcatgccctcctcgacacgtattgccccgacaacagagcactttcgcagcgactcaagcgaccgcccgccgacgatatctagcgtcgactagcgcacacgctcgatctcgacaccgcagcttgccaggggcaggccgacaggcgcccacggcttatcgagcttgatgcgcacaccaagcagcgaggggtaacggcgcagtaacatctgggctgtcccctcggctgccgcctcgatgagcttaaacgtatgctcgcgcagatagccgtcgacatcgtggcacactgagccgtagtcgatcgaggcgtccaagctatcgtgctcccccgccgcacgcaggtcggcatagagcacaagcgacacgacgaacttctgtcccagcgcgttctcctcgggatacacgccatggttggcaaagacctcaaggccgtcaatgacaatacggtcggcatggcgcaggtcgtcatagctcacatggggcaccgccgtcgcagtggagatatcgcccctgccgcgacgggcgagctcggccccctcagtcttggttgcattctcgggtagttttttattactcatcgcgatcgtctcctttacctaggaccccgatcgcgcataccgactacacgcgaatcgacaggttctttttatcatcgctccagttgcaagcattgcgcgcgggacatgcaaagcaggcacgcgatgctttgtcggccgcatagagcaggcgctcgagcggctggctgttcacgcgcagctttcgatggcccaagatagccgtcttaatggctgcggcgtcggctggcgcaaacgccacatcgtcgggcatgcctgtaagaattgcatcggcgacgcgctcgcttgcaacatcatgggatatacccgattcatactgttcatctttgccgatatcgtgaagaagcgccgtgacatagatgacttcgcggtcaaactcgagctcttcctcaagattcttgatccacataatgcgggcgacatccaacagatggtcaataccgtggcggcaaaagatgcgccccgattccaagcgcgcaatgttgcccagatggcgccggaacagaccattggcgcagatgtaatcaatgcgaggcatggcgccaaaaggagtcaagccagaagccataaaaccgcgacgcggcgttccctcatcggtgttcgatgcaaagtcgttaacgaccctcatagttagcggcccaacatcctaaagaaccgctcctcgagcgccggatcggtctcaaagacaccgcgacgagcaagcgtcacggtcttggtgccgggcttttgcacgccgcgcatggtcatgcacatatgctctgcctccatgagcacgatcgccccctggggggcaagatagtccataagggcatcggcaacctgcgcacacagctgctcctgcagctgcagacggcgggcatagacctccaccgtgcgggcaagcttggaaagcccggccacgcggccattggggatataaccgatcgctgccttgccataaaacggcagcaaatggtgctcgcacagcgaatagaacgtgatgtcgcgctcgataaccaaatcgttcgaagcaacggcaaaggttttggacaggtgctcctcagcgctctggtccataccgccggcaatctcaccatacatacgggcaacacgcgccggggtctccagcaggccctcacgagttgggtcctcgcctatgccctcaagcaacagcttaatggcggcctcgactttttcctgatcgaccatctgggcctcacttttccgatttcacgttcgcgctatggtaccacgccggcgcacagccgccaccagctacatagtatgggtcgaatagacaggatcgtcccgccaaagctccacagcgtcgcaaagcgcaacatcctcacgcgcagcacgggcgcgcgtggcgttcatatcgatcacacgctgattgctcgagcccctaaagcgcagcgtgatatcgtacaaatcctgaacaaacggaccgtccaccaacatatcgaggcaggtaaggatacggtccgtgacctcggtatggtggcaaccgcccggcataagctcctcgagcacatcgccggtaaagcaccaaatggtcttgcccgaccccacaggataggccgcacgcacgcgttctataaagtcaacaagccccgcctgattctcgggctccatgggctcgccacccagaatcgtcagaccgtcgttaaagggatggtcgaggctctcgataatcttgtcctcgacggcgcgatcgaacggctcacccgcagcaaaatcccacgcgacagagttaaagcagttcttgcacccacgacggcacccgctcacaaacagagaagtacgaacgccctccccatcggcaatgtcgaaatacttaatgttcgcgtagttcataagtgactctcccgggaggccgggacatatcatcccgtcctcaaacattctcggcctgcggcctgcgaaactgcgggcgggacgatatgtcccggcctcatgcaaagggtaactcaatgaacgaagcgaacatcgagtatagggttcgaggtccaataaaaaatgggctgcagctcaaccgccattgaaagcaaatcgccaccgcagatcaactcatttccgcttagaacttcgaggagtgagcagaccgcgtgctgcatctcagctacgtcaacttggctgcaccgtagcgagacgccggacctttgctcgatatgagttccgcacgaacaggaggcgccagtggcgcctccgtcgtgagtcaggactgtccgaaatagcgagcaaatgcccaagcggccctctcggttcagccccggagcggtattagagatgcagcacgcggtcgcggatctcctcggttcgaccctggttccagaactgggtaccgatgtagccgcacgtacgacgagcgacgttcatcttctcctggtcgcggttgccgcaattggggcactcccacaccagcttgccgtcatcctcgacaatcttgatctcgccgtcgtagccgcacacctggcagtagtcgctcttggtgttgagctcggcgtacatgatgttgtcgtagatgtactgcatcacgcgaatgacagccttgaggttgtcctgcatgttgggaacctcaacgtaggagatagcaccgcccggcgaaagctgctggaacatgccctcgaacttaagcttatcgaaggcatcgatctcctcggacacatggacgtgatagctgttggtaatgtagcccttgtccgtcacgcccgggataatgccaaaacggcgctgcaggcacttggcaaacttgtaggtcgtcgactcaagcggggtgccgtacagcgaaaagtcgatatcgctttcggccttccactcggcgcacttgtcgttcatgcgctgcatgacggccatggcaaacggcgtgccttccttctcggtgtggctgtggcccgtcatgtacttgacgcactcatacaggccggcatagcccaggctgatggtggagtatccgcccacgagaagcttgtcgatcgtctcgcccttcttcagacgagcgagggcgccatactgccacagaatcggtgcggcgtcagaaagcgtacccatcaggcgctcatgacggcacagcagggcacggtggcacagctcaaggcgctcgtcgaagatcttccagaacttgtccatgtcctgatgcgagctcagcgcgacatcgggcaggttaatggtcacaacgccctggttaaagcgaccatagtacttgggcttgttcgggtcgtagttcagcgcgttggcaacattgttaaagccgttgcccgagcggtcgggcgtcaagaagctgcggcaacccatgcaggtgtagcagtcgccgttgccggcggtctcgcccttcgacagcttgagctcgcgcatcttcttctcggagatgtaatcgggcaccatgcgcttggcggtgcacttggcagccagctgggtcaggtagaagtacggggaatcctcgtgaacgttatcgtcctcgagtacatagataagcttggggaatgccggggtaatccaaacgccggcctcgttcttaacgccctcgtagcgctggcgaagcgtctcctccacgatcatggcaaggtcgtgcttctcctgaggcgtacgggcctcgttaagatacataaagaccgtcacgaacggcgcctggccattggtggtcataagggtcacgacctgatactgaatcgtctggacgccacgacggatctcgtcacgcaggcgatcctcaacaacctcgcggaccttctcggcagatgcagagacgccgagctcctcaagctcgcgagcgacctcgccgcgaatcttttgacgactcacctcaacgaacggggcgagatgggtcagcgagatagactggccgccatactgggaggaagcaacctgggcgatgatctgcgtcgcgatattgcaggcagtcgagaagctgtgcggcttctcgattagcgtgcccgaaataacagtgccgttctggagcatgtcctccaggttcaccaggtcgcagttatgcatgtgctgagcaaagtaatccgaatcgtggaagtggatcaggccctcattgtgggcatccacgatctcctggggcagcagcacgcgctgggtcaggtccttggaaatctcgccggccatgtagtcgcgctgaacggaattgacggtcgggttcttgttggagttctcctgcttgacctcttcgttattgcactcgatcagcgacaggatcttgtcatcggtcgtgttcttctggcgcttcaggctctgaacgtagcgatagatgatgtagtggcgggcgacctcgtagcagtcgagacgcatgatctcgtcctcgaccaaatcctggatctcctcgaccgaaacggtgtggcccgcgttctcgcatgcctcggcgacgttttgcgccgcataaaccacctggcggtcggttagacgagagctctcctcgacctccaagttggcggcgcggatggcattgacgatcttatcgatgtcaaagacaacctcggtgccgctgcgcttgatgatcttcatcctcttgcctctttcgcgtcgtagcctcattgcgcttcagagccaaacgatgcccggcagggcttgcccctgtcttgcggcgccgtcgcgcaatctgtgttctcgataaaccataagtcctcatgcggacaatcctcgcggccgatcaagcggctcaaaggcgtgtccaaatggggcgaataaggtcttcgttctctgtccgccatctatcatacgacaaagatgcatctatatcctgtattctttttttaggtcaaacacaacatatagtgtttcagcaggtcaaagcaattagtcattttgcagacgcattataaatgaggggtatttgacaagtcggtaaaacgttaccaacacggctacctgcatggcagttataaaacccccttagtcaagccgctgacaaatcctaccaaaatcaagccgctcacgccaaaagaatccaaaagattatgcttgaccaacatgttgcggtcacgctcggtcaggacgcatgcaatcagccggcgcccctacgggatgcgaagaccatcgcgcacaaaccttggatcaatatttggtggcttatttggcggcgtacttggtgacaaaaaacagcccagaggacatagcctctgagctgcgaacatttggtgggcgttagaacctatgacgttctgattcgtagtcagaccctctatccagctgaggtaacgccgcagcgcaagacatataaaaccactttagcttattggagtcaagcacaatttcaaacttttttgtggaacgcagtcttgtcatgctgctccgcatataccgccattccccgtacgatcgattggcttttcgatcacgtcaaacttagcatcaagttccctcaggagcgatctcacccgctgggcacaatcataatcggcaaacgagatgctcaacatgcgagcaacctgattagatgtctggaccccatagaaatgctctagggccacaagcccctcgtgcgccacaaacgtctcaaccacatgaggcgactcctcgtagcaccattgcgtcaacggcccctcgctcgtctgtcgaaccaccaggccacccatgccagacggctcacacgtcacaagcaggtactccccgccctcgtcgctctcaaacaaaaccacccgatcatcaaacagctccatcgcgtcccctttctctcgctcttatttagcaaaagcatagcaggtagatggctgtatacagaacagttgttcgtgtgttttctattgagctgtccgcacggcatggtatggacctgcgcacgaaatagggcgcccccgaaggagcgcccttgcatatcgcctatgcagccaagttacgcgaccggctcgatcttctcgaggccgcccatgtagggacgcaggacctcggggatcgtgatggtgccgtcggcgttctggtagttctccagaatggcagccatggtacggccagccggcaggccggaaccgttaagggtgtgcaggtagcgcgaacccttgaagttctcggggtcgcgatacttgatgttggcgcggcgggcctggaagtcaccgcagttggagcaggagctgatctccttgtaggcgttgtagctcggcagccagacctcgatgtcgtaggtctgacgggcagagaagcccaagtcgccggtgcacaggctaatcacgcgatacggaaggcccagctgctgcagcaggtactcggcctcggcggtcatgctctcgagctcctcgtcggactcctccggcttagcgaacttgaccatctcgaccttgtcgaactcgtgctgacggatgatgccacgggtatcgcgaccggcggaaccggcctcctcgcggaagcagggggtgaaggcggtgtagcggcgcggcagggtgtcggcgtcgaggacctcaccggcgtgcaggttggtgagcacgacctcggcggtagggatcaggaagttgtcgcccgagacgtgataggcgtcgtcctcgaacttgggcagctggcccgtgccgaacatggtctgacgcttgacgacgatgggcggccaccactccttaaaaccacggctggtgtgcgtatcgaggaagaagttgatgagggcgcgctcaagacgggcgccggcgccaccgagaacggtgaagcggctgccggagagcttgttgccacgctcgaagtcgaggatgtccagatcggtgcccagatcccagtgtggcttaaagtcgaagtcgaactcgcgcggggtgccccaacgacggcgctcgatgttctcgtcctcgtccttgccgtacggcgtggcctcgcaaggaatgttgggcaggtgagccatgaagtcgtactgctcctgctcgagagcagtgcggcgctcggccagaccgtcaatcttctcgttgacggcgcgcacggcctccttggcggcctcggcctcgtccttcttgccctccttcatcagggcgccgatcttcttggactcggcattgcgcgtggcttgaagttcctcaacctcggtgatgacggcacgacgctcgtcgtcgagctcaaagaacttctcgcgatcccaagacgtctggcggttagccatggcgacatcgatggcatcggggttctcgcgaacaaacttgatatcaagcattagatcctccggcgatatacattccatttaggttgcaaccttgtacatgtatgggcaagtatatacttatgagcgtttacgacccaactcaactacgcaagaaggcacccaatggacgcagttttttcctttttgtttggcacccgcaccggttttgccatccttttcgccggcggcatcctgctgtttgcgattattgcctttgtaatggagaagcgcacccataagatgtatgtcgaccgcggccccaaatccgaggacgaagaagacagcttctgggactaacccgccaaaaagggacaggtttattttggtcggttttatccgggcaaacgcaagcgccccgcaactggaattgagccagttgcggggcacttttcgctaaaaggacaaaaccgcaggaaaaacctgccaacataaacctgtcccttttttggtcggttttactggagggttgcgtcgattgccttgaccagggcgctgcgcatgccggcgtcctcgagcgcaacgacgcccttgatggtggcgccgccgggcgagcacacagcatccttcatcgctgcgggatgctggccagttgcaagctgcagctttgccgtacccagcaccatctggctcacaatgcgataggcatcagcacgcggaataccgtgcttgaccgctgcatcgcccagggcctcgattgccatagcgacaaatgccggagcgcaaccacccaccgtgccgcccacgaacagcaggctcgtatcgagctcgaccaccgcaccgagcttgccaagcagatcaagcaccactgcgctctgctcatcactaagcgtggaagccttctcgcaagcgatgacgccctcgcccaccgaaaccggcgtgttgggcaccgtcgagatatgcgcgacgcccggcaggacctgctcccacttggcactgtcccaggtccaggcaaccgacagaacgacctttttggcaagagcatccttgagcggggcgaatatctcctcgatcatatacggtttgaccgcagcgaccacgatatcggatgcggcgacaacctcggcggcatcgtggcaggcgaccatgccgcgcgcctcgcagcgctcaaccagtgcgtcgtagcgacccgcgcaggcgcacatgtcgctcgcagctacaccggcagcgatccagccatcggccatagcgctcgccatattgccaaaaccgacaaatccaatcttcatatctcatagtcctttcagacacattcctcaaaacgaaaggtattgtcccacgccattgtttcgtattgccgacctatttgtgatacggctcgccacgactgatcttgcaggcacggtaaatctgctctagcagcaccacacgcgccaggttatgcggcaaagtaatgcgtccaaagctgagcatctcgtcggctcgtgcgcgcacgtcatcactcacgccgtccgaaccgccgattacaaaggcaatgtcgctgctgcctcgcagcataagatcgtcgagcctcgccgaaaactcctcgctcgaacgctccttgccctcgatagccagcaggatcacatgcgctcgagacggcaaggcagcaagaatcgccgccccctccttgtcacgcgcggcatccacaccgcccgccttggccgggtcgatatcggccacctcgcgcatatccaccttggcataggcgcccagacgcttcgtgtactcagcgcaggcatccttccaaaagcgctctttgagcttgccaacacaaacgacggtgtatttcacgcgtgcctactcctttgactcgttctgaaccttaccggcagccagcatctgctcgaacatagaggccgactgcgagaagtcactcggcaacacgaccgtcgagtttttgcccgtacgtgcgaactccgtcatcatctcggtccactgcgtaaacatgaacagctggttggcctcatcgttgccaacacccgtctcctggataatctcgagcgagtccttgatgcccagcgcgatcgccttgcgctggttggcgatgccctcgcccgccttttccatagcctcagcctcggcggtcgcctcggtgacgcgcttgatgcggtctgcctcggcgagctcctgtgccgcagcgcgcttgcgctgggcggcgttgatgtcgttcatggagttctcaacctcggtcggcagtgcgattttggtgatgagcgtcgacacgagggtgaagccgtaggcggccatctgctcggaaacggtagcgttgacatccttggcgatgtcatccttcttggcaaagacctcatcgagtgtgtagacggggatggaggagcgcagggcgtcggtgatgaagtcgcgcatctggtcgacgggctcctgcagcatgtagtagctcttgtagatgcccgaatctgccgggccggcgcccatgtcatagctcacgtggtactgagcggagacctcaaggccaatggtcacgttgtcctgggtcttaacgtcgatgccaaaaccatttttcatggtgcgcagactcaccgtggcggccttgcggtcaatcacgggcaccttcacgtggaagcccgcgttgacgatacgattgaacttacccaagcgctcgatgatcacagcgtgctgctgctcaacgacgtagcaggcgttggggagcagcaacaacaggatgatgatgggaatcaaaaggctggtaagggcggcgatgataccggaaaacagcatggtctctcctctgataggcacacgttgccattaggatacccgtccaaggagatcgtgcataacaaaaagctcccattgctgggagctctttcaatcaatggtgcgggcgaaaggacgtccgcgtatccgcttcgcggatccgcaccggcttcgcccgcctgccggcggactcgccagctcgctaaaaacgctccgcgttttctttacgctcgctccttcgcaggttcaagtccccgcggtgggcccataacaaaaaagcccccattgttgggagctctttcaatcaatggtgcgggcgaaaggacttgaaccttcatggggttgcccccatacggacctgaaccgtacgcgtctgccaattccgccacgcccgcgtgcaggaattagaataacggagcgccaccgcgaacgcaagaactatttttgaaaaagtttgcaggcattttcccaagcggcatgcgcgattgtttcggcgtcctcaccagtgcgatcgacacggtcgttaaccagcgcgtttgccgtaatggagatcattgcgggctcgcattcaagaccgcggatgggctccggagccatatacgggcaatccgtctcgaacaaaattcgatcgagtggggttgccgcaaatgcctcgcgcacgtcgtcgttgcgcttaaaggtggccgcaccaccataggcgatatagcagcccagctccacaaagcgctccatcgtggcgcggtcctcgccaaaacagtgcagcacacaaccggcctggggcacgcccacctcacgaagcacgttgtaggcgtccacgtgcgaggtacgctcctggtccatgtcctcgtgacgcagatgcagctccaccggcacgttacgacacacggcaagctcgagctggcgcgccatgcaatcaatctgcacgctgtggggcgccggcgtgatgtcgtcgtcgtaatccatgtggtagtccagaccgatttcgccaataccggcacacaaagggtcatcaagcgcagcaacaacctgcgcgtgaatgtcgtcggtatagtccggcgcgccatacggatgcacgccggcaagatacttgatctgcgggatatcctgcatcggcagaatttcgcgcacgagccagtcgctatagtccgtcacgctgcgcttgtcggcgatggggtcgaagaccgtcaccaacaggtcgatgcctgccgccttggcacgcacgagtgtctcgggcacatccttgccccagaacgaaagcagatgcgcatgtgtgtcggcaagcggtgccaagggcacgggacaagcaaccgtcttctttttcttggtaaacgtcacgcgttcggcattaagcgtcatgggaaagctcccgagccaggcacacaaagtcggcgacgccgagcgtctcggcgcgcgtggtaggtgcgataccgcaagcctcaaaggcgacatcgagcacgtccttggcaaagccgttggcgctcatggaattgcggatggtcttgcgacgctgagcaaatgcagcgtcaatcacgcgggccacaaattcgcgatcgagtccttcgggcaccacaccgtcaacacggtcgatacgcacgacggccgagtccacgtgtggcgccggcataaagcaacgcggcggcacctcaaagcgacccgttacctgcgcatacaggccaagctttgccgtatagccgccataggtcttgttgcccggcactgcggcaatgcgatcggcaacctccttttgcaccatgacgacggcgcgcttgagcgccggcatcgtctggaaaaattgcaaaatgatcgtcgccgccacgttataaggcaagttcgcgacaaataccgtcggctcaccgcccgcagcctgctcaatctgctccgggcccaccttaagcgcgtcgcccatgataaagcggaagttggcatagtcggcggcgtgggcgtcgagcaccggttcgagctcaggatcggcctcaatggacgtaacgcacgccgcttcctgcagcaacgcaagtgtcaacgtaccgcaacccggacccacctcgagtacgcgctcgtcacctgcaagctcggcaagctcgcagatacgctcgatcacatgattgtcgattagaaagttctggcccaggcgatgcttggtcgcaaggccaaactcctccagcagctcccttgttgccgtggggtttgccaaaggcgaagttgtcatagttgcctccttagcatgatggcggcgtcttgaaacgaaagggcatggaccgttgcggccatgcccttacatctaaacagcaaattgccgatatggcgctcgcgcggtctctacgccagacgcgggaacagcggatcgcccttctcgacgggctgaccaccagcaagcaggccccaagcgcaaatgcccttgaggtcgtcggtcgcggcctcgttctcgcaggacaggcggcgcagggcctcggcagaggtctgaggcatgagcggcatcagcaggtgagcggcaatgcggatggcctcgagcaggttgtagatcacaaacgccagctcgtcagccttggcctcgtccttggcaagtgcccagggctcggagtcctcgatgtagtggttggcggcgtggatgagctccatgacctcatccttggctccgccgtaatcgagcacgtccatcttggccatgtagcggtcgaccaggccatcggcgatctttgccagcgggttgtcgaacgcatcgaacgatgcgggcttggcgggcgcgcaaccgtcaaagtacttgccgctcatgttgagcgaacgcgagataaggttgccccagctgttggccaggtcggcgttgtagacctgctccatgcgatcgaagctgatggcgccgtcggtaccgggaacgacatcggtcataaagtagtagcgatagccctcgacgcccagcatgtcgataacgtcctgcggagcgatggcgttaccgcggctcttggacatcttctcggccttgccggtctcggcattgcgcacggtcaggaagccgtgggcaaagacgtgctcgggcagggcctcgccgatggccataagcatggcgggccaaatgacgcagtggaagcggatgatgtccttacccacgatgtggaactgcgcgggccagcgataggccagctcggcacgcgcctcgtcggtgtcgacaccgtagccgacggccgtcatatagttgagcagcgcgtcaaaccatacataggtcacatggccctcgtcaaacggaacctggatgccccagtcaaagctcgtgcgactcacggaaaggtcgttgaggccgccctcgacaaagctgcgaacctcgttcatgcggaacgcaggctcgacaaagtcggggtgctcgtcatagagcttgagaagcttgtcctggaaggcggaaagcttaaagaagtaggactcctcctggacgcgctcaagcggacggtggcagtcggggcatagatgctggccgacgctgccgtactcctcgtcgcccttctggacctgcgtatcggtgaagtaggtctcgtcaggcacgcaataccaaccgtcgtagctgcccttatacagatagccggactccttcatgcgctcccacaggtactgcacggcatgatgctggcgcggctcggtggtgcggatgaagtcgtcgttggagatctcgagcttgctccaaagctccttgaagtgcggagcctggctgtcggtccactcctgcggcgtcatgccatgcttggctgcggcctcggcgaccttctcgccgtgctcgtccatgccggtcaggaacttgacgttatagccggcggagcggcgatagcgagcctgaacgtcggcgatgatggtggaataagccgtgcccaggtgcggatcggcgttgacgtagtagatgggcgtcgtgataaagaacgaaggcttgctttgatccatggggtttgtcctccagaaaaacgttgcatacaggggatgattctagcgcaagggctggatatcctccatctattgcatatcgagcaccatggcatagacatcgcgcttgcggcgcgaatacttctgagacaggcgcttggccaccgcagaggcgggctccccctcctcgagcgcggtgcggatatcctcgcgcagggcatcgtcgggatccgctaccgcagcgccaaccggcgcgatgccggcctcctcgtcctcgctcggcggcgcgatgaccagcgcaatctcgccctttacctcgccgcgagcacgcagctcctcggcaagctggtcagcgggcccgcgcaagacctcctcgtgcagcttggtgagttcgcggcagacggcaagctcacgctggggaaagacctccgccacggcctcgagcgtcgccacgatgcgatgtggagactcgtagaagatgagtgcgccgggcaccacggcaaggcgctgcaaacggcgcacacggtcgccgtgctttcggcccaaaaagccctcgaagaaaaaatgctcgcagggaatgccggacgaaacgagtgccgtgacgcaagcagagggtccgggaataacttcgacaggcacatcggcctcacgcgccgcctcgaccagcgcctggccgggatcggacacgctcggcatgccggcgtccgaggcaaaggcgagggtctcccccgccagcagacggtcgaccaggccggcagcgcggctagcgatcacattctcgtcgcaacggacaagcggcttggaaatacccaggtgcatcagcagctttgacgtcacacgcgtgtcttcgcagcaaatggcatcggcggcggcaaaagcctcgccaacgcgcgaggacaggtcgcctaggttgccgatgggcgtgccgaccacatagagtttgcccgtatgggcgctgttttgcgtcatatcaacctattcaatcatgccgcgctcgagcgtaccgagcgccgcgcgggcgtcccatgctgcaatgcgcttctcggtcttccacgtttggaagaaccaaccggcagccggcgcaaacgaagccagctggttggcgataaacacgcgctcgtaggcattgcggccctcgggcgtaaccgacgagttagcaaagatcgccgcgcccgaccattcgcccaccagcacggggaacccagtcgaaatcgcctctttaagctcgcgcttgttacgcgaaatcgccgtcgtcagcccgcgggggctcgtgatgtcgagcgcatactcgtcgcggtaatggtacaggtgaaggtccatgtagacgttcttgtacttggcgccgcgcataaaatgcttccactcgctgggatgccccgacgacgagaagacgacgatcttatcctcgggcatatacgaacggacgagctcgtaggcatcgcgatagaaattgcgcaggtagtgagcaggaatgccatccgtcatggtgaagaggctcttgcgaacgctcatctgcggcgtgtccagcagctcaatgcccagcaggctctcggcctcgccatagcgatcggccaagcgctcgagcacgtcgagtgcgacatgacggccgttggtggacgaatgccactcggcaacagcctctggcgtggcgggcgaatcattggaatcgccctggccaccgggcacagttgctagatcaagcagcacgcggatgtcgtacttggcagcccactcaatcgcacggtcaatgtagtcgacaaccgagatgtaggacgcatcggactcctgcgagccaaaggcataccagggcaccggcagacgcacggcattgagaccgatctgcgccatgcgacggaaatcgtcctcgctcacaaacgtctcgtaatgacggcgcatgcgctcgttataggcggcggtgcccatggcctcctgcagctcggccgcgttggatgcaccggtcgccgcgtatagcgacggggtcacccaaggctcgggaataaaccagccagagagattaacgccgagtatcctctccatcactgcccccttcggatcgtgcaggccgagcctgcatcgtattgcataggaaaagtatcgttttgagtatacccgcgcgtgcggacagacgaccgaacggtctgtaaagtggcgcaaaagcgggaggaatatctgggcgggcccgagatggcgcgccgagatgtacatatgcgccggaagtaggcggccgaaaagcgcatcccgttctgagcgcgggatctgggacgcagtttccgccaaagaccgcaaaaggaaagcacatcccattctgacgccggattccgggtcgcgctttcccaagcggcctcaaagcggaaaacgcatcccactctgaagccaaattccgggacgcaatttccgcagagccctcaataaaagaaaaggacccctttgcagaggtcctagtcaattcaaggtggcggggaagggaatcgaacccctgacacgaggattttcagtcctctgctctaccaactgagctacccagccatttgaggtgtgccttgtttcaaggcttgattagtataaccaaggacgcgttccggtcaaccgagaattttaaaaaagtttttgggcacagcctcggttctataaatcggcacgtcagaggcatcagccggcagcaagaagtttttcactcagagccgcacgggcaaactcacttggcgtcatcccctcggcagccgcccgtcgacgaatggcctccttcattcccagaggaatcttgaccgacagcgttgccgtcccctcacctgagagcgggggccgtccatgcacgatcccaccaacggtgtgttcgccatccggaaactctccgcgctcgtacgactcgcaccacgcgtcaatcatttcatccgttacaacctgaccattagcggccgtatacgtcttgcccatcatcgacccctttgccgagcctgttcaatctcctgccaaaatttcttctggactggagacaaggcatgaatgataagccacccacggacaagctcgaccgcgacaagctccacgcttcgtccgtctgagagccatccaattgcaagccatctcggcggctcgtccttcggctcgcgacgaatgcactcagtaaccgcaagccaagcgctaagcacctgcttttccgtcaggtgctttttagcgttgggatggatctcaacatccatgcatcttctcctccatcttacccaatttcgtatgacgaaagtccactgtcgccaattcttaagccggcacgcgttggagagcaggagtcgaaacaatgattgaaggacgctctagtacggcccaggcgccgaggcaggagcacatgcgccaaggacgaacgttttcgtagcgcgcgaggatattgccgtcgcgatcgatgaaggcgatgtcgatgggataggccataaaacacgtatggaccgaagagcagcatggaaacgccatgacgagcgacaggccgttggcggcaaccggacgccgtcccagcatgccgcgcaggcgcacgacaaacgactccgccaccacaaactcggccggcgtccaacccagcctattgagtgcccgcgcgtaggcgatgtaggacgagaccgcggtcacatgaccacccccggatgccatggatcgaccgtcaccgcgcgctcgtgcgacaacgttgtcggcgcccccagcggaacgccagcgatgctgagagaagtcggccacggctcatagtgcatggtgcaggtgtaggtcctaaacgtaccggatagggagagcaggccaccatctgatgccttcgcgccttgctcgctcgacacttcgatctgcaagtcatagccttccatggcattcagaatttgagtctggaccgtcgccgaggcatcggcagagctttcgtcgccctccccctccgacgccacggcatgcgctagcacgatgtcgggcaccacgcggtcgaagcgcgcgacagcgccggcaaagatcatgacgttgtacacgatgagtgccagcaccagcaaaacgggcgtaaccactgccatctccaccgtcgcttgggcgcgctcctcgcgcagacgcatgcggatactcattacgacccaccgcccagagcgccaaccagcgtggcgacatcgacggtgagcgggatggaaccgccgccgggcagaggaatctccgcaagtgtgaacaccgtaccgctaatggtgcgttcgacttgatattccaacgcctcgcaaagcgccttgggatcggtcacgcccaacggaatacttcgcagtttgtcttgcgcttgagagagacccgcaatgtcagaccccggactcttaatgacgttggcagaatcggtcagcaccggctttcgcaggcgcaagtcgcacggctccaagcccagcgccgccacggacgccgaaacggtatcgccgagccacgatgcaatggagcccagcgcgccactgctccctcccaggccatcgatcatctcatccataagctcgtcggccgagccctgaatgtctccgtatcccacaagcagccgtccccaaacatccatgacgccatcgagtacgccggcaacgccacccgaacgctcctccagcgtcgagaaaaaccgcgagagaacgttgttctgcgccgtcgcgtcatcgggcgccagcaccgcagcagagatcgcgccgcgatcgccaagcctgactgtcgtgttaaacgaagagttgagctcatcggggctcgagatggcacccgaaaccgcaaaggcagccacgccgttgcgaccgggcggggcgatacgcggacgctcgcccgaaagcgctttaatggcctggtcaaacgcgttgcccgcacggtcagcctcgtcctcggtctggcgcatgagctcgagctctttgttgcggcattcgacgtagtcttccagagcgtctttaaacttgtcaaagtgatactcgaagccgttttcgatagaggttgaaggcgccgcaacagcaccaagcgacgaaacgccaaaatggcatttgctgcatttatcctgtccatcgtaatcggcaaccgaagcaaatccgctcggcgtccctttcttatagttagggcaggtcgtcccgtaatgcagatacgccttgtcatcgttcacgctcgtcggccacaccgcatcggtatagagttccgtcgcccgaacctcatcagagttgcgcggcagcagcggaataaaggaggaaaccctgtctccgttctcggttatatgtgcccgatcgacctccgcgctcgcatagatataaaacgccttacgcgccgcagactctgccttcatctcgacactcgagccgtggggcttctcatttgtcagacgccaatggtagtagtccttcgcgcgatcaagggcaacttggggctcccacgtaacgctcgatgagtaatgcggattttgaacaccggagagatccgttaggcttttcgcacgcccccacatgcaagaacagctgccgaccgagcccttgtcagacccaccacaatccgccagccaagcacgctctttagccttcgccgtgtcctcagaagccttccgcagctcctcggccgcacactctaaatcatctgatgtgtctttaatggcatcggtcgagatctcggacccctcgagcgcagcgaagtcagactcggatgtcctgggcacggcaagcgccgtaccggtataggtcacactatcggtatcctgcgccgacaccgcctgcgtggcacgcgcggcgatcagatacggcagagccgtctcgattttctgtaagccttccgatgcgcttttggcaaacttgttgcgcgttttaatgatctcaatcccggtgtcgaccatattgccggcaaccggctcggtacccgggatgaggatggcgaccaggcccgtcccgatcgtggcaaaccccgccagccccagactcaagatgctcgcatcaaccaccgtggcagccgtgtgataggacgacactacgttggcacccgccagcgcgccgctatcagccgccacctgggtatccccggcacgcgacatgctccatatcgccgcggtcgacgaaaacagcagcgtgagcaccaccaagatgaccaccgcagaggagagcgtggtgtaggcaccgtcttcgataaacaggtcgataccggctcgacccataaagccgcctcgtttgcggagagcgcctggtcgacggcgggccgcaaacccttgcgtcacccgcaacaggcagcgcctaatcccatgcagcaatccacgaatcataatctccctccagccattcgggacgcgattgatacgagacatcgaccttgagctcaacgtagccgccctcggcggtaccacccatagcctgcgcaaacgcaccgatcacaggcaacggcttgacctcgccggaaacggacacggacgagacgccacccgcaccggcccggccaagctcgatatcccacgacaacggcccgccggcatgaaagatcgaaacgttgggcactgcggcaagtcggcggcgggtgaactccttaagatcgtcgtcctccgccgtcgtcgtggtcatgagccgcgcggtctcggcggcggcagactccatgaccgcgcgcgtataaagcaggcacaccggttgcagtgcgagaaggatgagcgtcagaaacgtcggcagcaaaaaagcggcctcgaccgtagactgcgcccggtcctcacgcgcgatatcaatacaacgcgatgtccttagcacccgcagcggcgtcgataaccgacgtcgaggcaacgccatgggatgccgcccgctcaaccagcgccgccaagcgcccatcggtgccagcacgccaaagccccgcgatcgccagcacgatcgataacagcgccaccgtgacgatggcgtattccacagtcgcttgggcaacctcttcacgcagaacgccatgcatttcacgatccctcctttgaacttattgtttgcgggaccaagcgcacggcgcgcagacgacacgaagcatcgccagtatccgcggcaaccgtcaccatatcgacccagccgcgcccatcgcgcacgatggcgccccatacgttgcccttaatatcgagatagccgctcagggcgagctgggacgttggcacctcgcggtaggcgcgtaacatatccgccgctgcctcggtcatcggtcggtcctcggaccatgcaagccggaccgcaatcgcgttgtcctcaggcaaatccgtcgcagtgccagaccgcttgtcgagcgtccgcagaaaggtttgcgccgtgacagcgacatccgaatcgtccgcatctcgcatctcatctttttgagacgccaccgccgaatctgagcccgaatcgaaggcggccccaggacgctgctgccgcgcggcgttaagcccccaaagcaccgccgctatcgccacggtcaggcaagcaaacaccagcagcaccccgatggggcgctcgccctctacaggctgttgatgccctcgctgatcgcatcccatagctctttaaccttgcccttaaatgcgacgatggcgataatcgcgatcaccacgagcacgccgaccaagatggcatactcggtggtaccctgtgcactctcctcctgcagtagctccttggcgcgttgacgaacatgtgccgcccggcaaaacgcccagccctggaccttgccagcagcgtcagtcatcgtgttcatgtattcctccctacatcatcccgcctgctcccagcagcgggcccaatatggacagaagcaacgccggcaagatgagcgtgccggtgggaatcagcagcttgacgggcacacgctcgatctcgcgctcgaccgcagcgcgatgagccgcacggatctcgcgactttgagcggccagcgtctcggcaagtggggcacccagggcgagcgcctgccccaccgtgatggcaaaggtctcgagcgctcgcacgtccaggtcgcgcgcggcggccaacaactcgtcctcacgcgtgcccacgcccacctgccacgccatgcaggcccgctcaaggcgaagagccagcactgaccggcggttggcgcagaaaatctcaagcgccgcatcaaacgaaagaccggccgaaagacccaagcgcacaacatcgatcatctcggacacttcgccgagcgacactcgcgccgggccgcccactccaaccgcgcccttcactcgcgcggtcagggcatcgaccactgagcgacccgcggcagcgaccagcaccgcctcgcgcttgcaggcccctgcgatcttgcgtgcatccgcccgatccaaacccgtcgcgacaaatacactcagggcgcacaggcaagccgcaactgcaaccggggcgctcatagctccacccgcataatgcgtcggataaccaccagggcaacggcattgagggcaagacccagcaccacagcgcccacgccggcaggcgtcgcaagaccgcgacgaaaatctgccgaaagcagcgccaacaccgcgcacatgcccgccggcatcgccgcgaccatatgcgcagacatgcgagcctgcgacgtcttgacatccaggcggcgcttgagctcaatgcgctcccccaccatgctcgacgcctcggacagtaagtcggcaagcggagcaccggtgcgctgagacaccttaagcgccaaggtcacaagcgaaaggccgggagcgtcgatgcgcacgagcaagtcatcgagcgcgtcggtcgccgagataccgcaatcgatcgccgccgccacccgcaaaaactcggtatgcaccggttcttgcgcatgagcgcccacaaagcgcatgccctgggccagcgaatgtcccgaggcaagcgacatggaaagtgcggtaaacgcctcgggcattgcctcttctgcatcgtgttgctcgcgccggctctcaaagccatcccgagcggcgccagcggcaatcggagcaacaagtcccaaggcaaacccgaggggcgataacgacaccatcgttagtaaaacgcagcagacaccgctcgatagcagtagaaacgccaaacgccccgaagcatcttcgatcacgaggccaaggcgatgcgccggagccagcgatgtccacgaacgggcgatctttttcagcagatcgttttccaccagctcacgcggcagcctctctgccaccgtctcgagcgcctgacgcgccagctccgccggcggcacctgcggcacacgaggttccgccccgcacgccgtcgcaacagaaaaccctgccaaaccccctacgacgaggggcacagcgacctccattcgtccacctcctcttgtgtgagcgtccccgaccgcaggccttctgcgataaacggcggctcgcggtcaagcgtccaggtgcgctcggcggcatcgaaagtcacatagcgctcgagctctacgccgcccgacgcggcgcgacgcacccccgaatacgaggagacgaaacgcctgccatcggcgtggcgctcggacatcacgatgccgtcgagcgccatggcaatctgctcctcgatgagctcgctcggcagatcgatgccataacgtgcaagcaatgtcagacgcaccacggtctcctgttctgaacccgcatgaagtgtggtgagcgacccgtcgtggcccgtgttcatggcctgcaacatgtcgcagcactcggcaccacgcacctcgcccaccacgatgcggtcggggcgcatgcgcagggcattagttactaggtcgcgaatcgtcaccgcaccctcaccctcaattgaagcctcgcgcgcctctaggcgcaccacgtgcggatgatgcgcaaacttgagctcggcagagtcctcgatcgtcacgatgcgctcgccggtggaaatctcgcatgacaacgcgttgagcagggtggtcttaccagatcccgtgcctcccgcaaccgccaggtcctgtcgcagcgacaccgcgcacgacagcagctgcgcataccaaagcggcagcgaccccagccccacaagctcgtccagtgagcagatgcggtccgagaactttcggatggtgagaatcggtccgtcaatcgccacaggcggaatcaccgcgttgacgcgatagcccgttttgaggcgggcgttgacgatggggctgcgctcgtcgatacggcggccaagtggcgagataatgcggtcgataagcacacggatctgctcatcatcctcaaacgcatgctcgatggggtacaagacgccgccgcgttcaaagaaagccgagcggcagccgttgatcatgatctcggtaacggtgtcgtcctcgatgagcggctgcaacggccccaagcccaccacgtcatccaaaatctcgtcgatgatggtctcgcgctcgggcgtcgcgagatcggtcggctcctcaacattgagcgccgcctccaccgcaggacgcaattccgagcgggcaagtgccgggtcgatataggcgctgatacgcgccacttcgtcgtaacccatgcggtccatcacggcgcgcttggtgcgtcgtttcacggcgcggcgacgccccgcatctacaggcgctgccgccgccgcagcgccggcagccttaatcctcgtttgcaggctcatcgctgatcaccctcgcgcgaccagggaaggcggatacgcgggcgttcggtgcgcgttgcacggtcggcgaccatatcgctccaagggccgacggcgcaccccagttccacgagcatctcgcgcgtggcctcgcgcacgctagtcgcaaaagcgctggtctgccccactgcctcgtcagcgcgcccaaacgccatgagcgcggcgagatcctgcccgccatcggcgatacgaatcttggagcttaacgcacaggcaatctcaaagcgcatggcgacgtcctcgtctgccccgcgcgcaccgaaccggttgaacacggcgctcatgcgcgtgcgcggcacacctactcgacctgccagttcaatgacgcgcgatgccgatgccgcggacgacaccgccgcatcgccaacgaccaggcaacggtcgctcgccgccaccgcagccgccacggcgtcgccccaaaagaccgaggtatcgataaagaccacgtcggattcgcgacgcagaacatcaagcagtagctccaccggacgtgccatgagctcggcttgctcgggcgccgcgacgggaccccagagcgtaacgcccggcgccacgcgcatcgaagcggctacgatatccggctcggtgagcgtgcccgccgccgacggctcgataagtgccgccatatcgcgcggagcatcgacgcctaacaagtcgtaaaggtttccaaacatcaggtccaggtcgagcacggcggcacgcaagcccaacagcgacgatgcgtgtgccatggtggcaacgatcgtcgacttgccgcaaccgcccgaacccgaaatagcgcagatgactggagctcgatgcggcgaagcggcagcgtctgccggcggcatcggaggcggcggggcgggcgtcggtgacagcgtccctgtctcccccgccgcaaccacgtgctgcgtccaagccggcatggctgcttgttcggtctgcgaggcaggctcgttctgcgcaatctgctcatgctgcatcagcgacaactcgccgcacccggcaaggccctcaacttcgtcgagttcatccgccagattcacgccgtgcacgtatcccatatctactgccggggagtcgccagcatgctgcgccggccctccagcgtcatcgtatacaagggggttccgggggcgccgaccatgctcggcttccgcttttccataatcatcaacacgcgggcctcttgtagcgcgaggcgccccgggttccctatcaacaaaagcatcgggctcaatcgtcatgcgccgatcggaatcaaccgctccctcgcccgcgcgcccgttgccgcatatactgtgtgcagcgatgacctcggtcgcccccgcgcgaaacagcacctcgatatccgacggatcgagcgcttctatcaacacgaccacgcgactcacgcggccttcggccgtcaggcgcgcaacagtcttgcgcacatcttcggtatcaaacagagacgccgcgatgatggcagccccgcggcgcgacggaaacgcccgcgccatggaaaccagcccgtccaggtcacccacgcgaagcacctgtgcacccgcatcacggccctcgacttcccgctgcaacagcccgtaatcgccgcacgcgcagcacgcaagccagatcgccttcatcactcgtcgcctccgctctttttgccgcgcgccgtggcgggaatcgtcaagctgaccgttcccttgcccgaggctcccagcagttccttgacgtcttcggggtcagccgccagcgtcacccattcgatcttgccctcgcgcgtggcaccggaatcctcactggtatcgatcacgtacgcgccgcacagccgatcggtcacgccgtctttttgcacatacacatccacgtagctgcccacgcccgtagcaccgccgaccgagtgctcggcatcgaccgccaccgaaacggcgaccttgcccttaggcacctcgagcttgcggctctcgaccttggtgtagacattgcagatcacggcgtttttgggaatacgcgaagtcgtcacgtcgccgcgcacctggcgcagctcggtcgccgcgtcacgcggcagcagactcgtcagccacccctgggttatgacattggtctcatcgagggtctcgcccacatcgatatcgcgcgccgcgacgcatacctcgacgcgatcgccaccgtacttggccaaggtctcagcctggacctgttcggcttgtgagcggatcgatgagccgtaaaccatgcagagcagagcagcgagcacgcccgcgaccagactgatggcgatgcgcttgctcttgttcacggccgctcctctcatggcagtgccgggcgaatgcccgtaccaccattgtctgggcggtcagagtgcaaagcggcgcaatcgcaatcttggttttcgatgtcaaaccaatcgctgaccaaaagctgaccagcccgtcaagctcgtggcaaggttttggtcagcacgtcagcaaactgcatgtttcgaggcttttccgcagcaaaaagccgtctcccgaacagttgggaaacggctgtcataggaaaaatcaattacagatggacatcgggatcgagcatttgagcactcacgcgcatggatgacgccaggttttggaacgtttccagacgcaggctatcgatctgcccggcgtcctcggcctcgcgaacggcgcaacccggctcatgggtatgcgtgcaatcgccaaaccggcacgcgcgcgatgcctcgacaatctcggggaaagcgcgcgccagaccccgctcgtgacccacgagcggcaggctgcgcaggcccggggcatcggcgatcacgccggcgtcgcccggcagtgccaccatcacgcgcgcgacggtagtgtgacggccctgatcgtcgcgttcgcgcacaccgccggtcgccaacgtatcgtggcccagcagcgcattgagcagcgtcgacttgccggcacccgactcgcccagaatcatggcgcagctcccggcgggcacgcaggcacggatctcgtccaggccgcggccctcggcagaggacgtcacgatcacgcgcacgtccggacccaccaggcggcgcacgcggtccagatcgcgctcgagttcctcggcatcgcagcggtcagctttggtgagtaccaccaccggttcggcatcgcagtcgagcgccaacaccagcgagcgcgccacacggtcgagcagcacctcgccggcaccgagcgcctgcacgattagcacgctatccacgttggagcagagcacctgacgctccccgcgggcacggccgcgccaacgctcaaagctcgtacggcgcggcagcacgcactcaatcacgcccatatcgtgcccgggagcgcggcgcaccgccacacgatcgcccacggcaggcagcaggacctcgtcctcgccgcgtgacttggcaaaccccacagcatgctcggcacgaaacgtgtcatcggcagtcgccaccagtggaaacccgcgatccaagcgcaccacggcgccaagctgcatctgctcgggctcctcgacatgcgcgcagaaatcatcaaaggcagcctgctgggcttcatcgaccggcaggtcatcaaacgccggaacgtcccgcagcgcgtcaagccccggtacactcgccagcaactcctcagcagatgcgggagcctcggtcgcgagcttccgacgacgatcacgcttagcccgcgcccccgtcgtctttttcttcgctttagccttagccttgcccacagatgcctcccagcacaaaaccacacaactgagcaggtattttacccacaaaaaagagtcggtcgagcaaacgctcgaccgactcacatactttccctcagccaatggtcccgagaggttatccgaaggcccgcccgccgggaggggtttcttccgagcgatcccgcagcgcgaagcgcgaggaccagcgaggaagaaaccccgcaggcggtcgggccggtgggaaggatggcctttcgacctactccttctcgaccgcgcgcatgatcgccttgtagatctccatcagcgggatgatcaggaaggccaggcccagcgcggcaagaacacccttgagctcaagcgtcacggggccaaagaacatctcggcaagcgtcggctgcacggttacgatcaccgtcagcaccagcgccagcgcggcggaagcccacagccacttgttctgcttcttcatggtgaacagcgacgcacgacgactgcgcatattgaagcagtggaaaatttcgaccatgttgagcgtgatgaacgccatcatcacgccttcctcgtcggcattgccagcgatcatatcggcgatgtggatgtagcccatgtcaaagtacacgcccacaaagaagctcgccagcaccagcacggtgatgattaggccctggaccacacagtccaggcccatattgccggcaaagacgccgtccttggcgttgcgcggcttgcgcttcatgatgtcgccctcggcatcctccatgcccaacgcgagcgcggggaagcagtcggtaactaggttcacccacagcagctgcaccggctggaagatggtaaagccgatgagcgtggcgataaacaccgagaacacctcggcaaggttggccgaaagcaggaactggatgaccttgcggatgttgtcgtagatgcgacgaccctcttcgcaggcgccgatgatggtagcgaagttgtcgtcggcgagcaccatgtcggcgacgttcttggtgacgtcggtaccagtaatgcccatgcccacgccgatgtcggcgcgcttgatggacggggcgtcgttgacgccgtcgcccgtcatggccacgatctggtcgcgcgacttccaagcctcgacgatgcgtgtcttgtgctcgggttggacgcgggcgtacacgccgtagtcctcgatgtgcgcgtcgagttcctcgtcgctcatgcgatcgaggtcggcaccggtgatggcatggctgcgatcggtgacgatgcccagctgcttggcgatggccacggcggtgtcgatatggtcaccagtgatcatgacggtgcggataccggcgtcgtgggcctcgcggatggcgtcggcgacctcgggacgaaccgggtcgatcatgccggacaggccgcagaagaccaggtcgtgctcgagcgcggcgggactacagtcggccgggacctcggtgtaggtgcggcttgccagcgccagcacgcgcagggcctcgtcggccatggccttgttggcggccacgagctcggcacgacgctcctcggtcaggggtacgaccttatcgccctcgtagatatgggtgcacaggccgatcaccacgtcgggcgcgcccttggtgtactgctcatactcgccgtcaagggtctcgacgaccacggacatcatcttgcggcccgagtcaaacggggcctcgcccacgcgcgggtgctcggcagtcaggccagtgaggcccgccttgccggcgtcgttgacgagcgcgcactcagtcggctcacccacggcctcgcccagctcctcgtcccactgagcatcggagcacagcgccatgccggccaggaacttctccttgggcgcagcgagctcgtgcttgacgacggtcatcttgttctgggtaagggtaccggtcttgtcggagcagatggtctgtgtgcagccaagggtctcgacggcagagagcttgcggataatcgcctggcgcttggccatcttggtcacgccaagcgaaaggacgatggtcacgacggcaaccaggccctcggggatggcggcgacggcgagcgagacggcaaccataaaggtgtcgagcagggcagtcggatcggtaaggacgttgcccacgccgtggcggaggatgtcaacgccaaagatcacgacgcagatgacgatcaccatgatggtgaggatgcggctgagctcggcgagcttcacctgcagcggcgtgagctcttccttggcctcggccagggcgccggcgatcttgcccatctcggtgttcatgccggtgccgaccacgacggcgcgaccacggccgtacacgacggtggagcccatatagcacatgttcttacggtcgccgagcggcacgtcatcggtgcccgcggcgagctcgatcacgttggcgtgcttctctacgggcacggactcgccggtgagcgcggcctcttcgatcttcatcgtggcgctctcgagcacgcggcagtcggccgggacggagtcgcccgcctcgagcatgatcacgtcgccgggcacgagctcggcgctcggcaggtgcacgagcttgccgtcgcgcagcaccttggactgcgccgcgctcatctcctgcagggcctcgagggcctcctcgctcttggcttcctggaccacgcccagcaccgagttgacgataacgacgaacatgatgatggcaacatcggcaaagtcgggctcgcccttgaccatgcccgtgagcgcactgatgacggcggcaacgatcagcatgatgaccatggggtcggccatctgctcaaagaaacgcttccacagcggcgtcttctcggcttcctcgagcttgttagggcctgtcttggcgaggcgcgaagacgcctcgtcgttgctcaggccgaggttctcatcgacaccttggtcgctgagcacctccgccgcggcggacaggtattccttttgcatatagagtcccctcctgggattcgggccactcagcagattgatgcccgatcataattcccaggagaagggcaagggctcatcaaggctgccgtgctgagcggcagttgatagtggagctatggtaccccaaagcgacgcgtctagccaaaacaatcggtttggaaatatggtccgcacgcaacggtgcagaccgtgtgatgctcaacattggtaaaacgttttttcttcggcacatcgccaaactgacatatcgcccagatagcagcgcttggagtggttggtaaagatttttcatataccgtttttcccgcaaaaaatgaacttccatttcggcatacggtcgattttttggggtattcggtcggcatttcgttataatcatctcggttttatttcttatggtttatctatcagcgcaagacgatgtcagatggaggtctgaatgtacaagcgcactaagattgtatgcaccatgggtcccgcctgcgatagcgacgagaccatccgcgagatgatcaaggcgggcatgaacgtcgcccgttttaacttctcgcacggctcctacgacgagcaccacggtcgcatcgagcgcgtccgccgtatttccaaggagctcggtctgcctgtcggcatcctgctcgacaccaagggccccgaggtccgcaccggccttctggtcgacggcaagaaggttgccgtcaagaccggcgataagatcgtcgtcaccgctcagcccacgtccgaggatttccacggcaccgctgagcacatctccctcgactacctggctctgccttccgaggtcgagaagggctccctcatcctgatcgatgacggcctggttgccctcgaggtcgagtccgtcagtggccaggacatgacctgcgtcgttaagaacgacggcctgatcggcgagcgcaagggcgtcaacatgcccaacgtcaacatctcgctgcccgccatcaccgagcgcgatcgtcaggacatcctctttggcctgaccgagaacatcgactacatcgccgcttccttcatccgtgacggcgagtccgtccgcggcatccgcgagctttgccgcgagaacggcggcgagcacgtgacgatcttcccgaagatcgagtgcgccttgggcgtcgagaacttcgacgagattctcgaggcttccgacggcatcatggtcgctcgtggcgacctgggcatcgagatcaagcccgagctcgttccgcacatccagaaggagatcatcgccaagtgcaacgcggcctacaagcccgttatcaccgctacgcagatgctcgactccatgcagcagaacccgcgcccgacgcgcgccgaggttgccgacgttgctaacgccatttatgacggcaccgacgccgtcatgctgtccggcgagtccgctgccggtaagtacccggtcgaggccgtcaagatgcaggccagcattgctctcgagaccgagaagtacctcccggcccacgctccgctcgaggttccggccgatgctcacggcacccgcgtcgtcaacaacgttgtgggtatgtccgctgtgaacatggccaccaccgttggcgccaagtgcatcaccgtgccgacgaccaccggtcgtaccgctcgcctgatctcgcacttccgtcccaacatgccgatctgcgcgttctcccgccacgagtgggccgtccagcagatgatcatgtactggggcgttatcccgcaccaggccgagattacccagggcaccgtcaacggcacgatcgtcaaggcgatcgagaccgctaaggagctcggctacgtcgaggccggcgacctgaccgtcgctaccgccggcgatccccgcatgagcgtccagctcgaggacaaggtctcctcgaccaacgtcgcttacgtcgctcaggtgcgctaaatcgcacttgcaagcaggtttgcattgcaaagggcccggaaggctttgccttccgggccctttttctgtgcgtcgatgcctcccgcacggcatgacacgcaaccagctacttatggcatgctatgaaatgtgcagctcatttgccgtgtttacgccctgcgacgggagctgttggtcgattgggatgagctgttcactgccgggccggccagctagcagctagcgatcaggggcagagcaggaacaccgggtgatgcgacgcgggcggcaaatcccgcctcggtcagctcgatgacctcggtaaacgttacatcgaaaaactcctcggttagcaggcgatacggcggatgatcgggctcgccggggttttcgcgtacaatctcgtgcatgacgccgatagtcttgagcacatattctttatggatgggatactgcccaaaacgcgtcgcagcggtatagaggcgatcggtcgcacgcggaatggaaacgatgcccagcgtcttgccaaaccagtcaaaatcgccctgctttttaatgcggaattcctcgcacggcttgccgccgtgtgcttccagatactggttcacacgcgtgttccataccgtgtcggccaccagatgcgaccagacgcccagcgttaaatcgagcagcgactgcgccacatcttcggacgcaagcgagaactcacaggcgccgggaccgacaaccggctcggcatccctgtagcgctgaggatagtgcacgcggttcagtcgctcgcgctcctcgacaatcgaggtagcctcagcaggttcgcccgcgggtgcgcctttaagcagcggcgccacataggtatcccagaactcgtgctcgcgcggcttagggataggctcgggctttgcaaagtgcgtaatgcgatacggaatgggatcggcgatgccagggaccatatagcccacgaagatatccggaaccacgcagccaaacaaaaaggcattgcggtcgcgcacgctatcggcaagcacgctagcacgtgccagcaagcgctccgtttgagcgatatgaatgttccaacttggcatagccacccccataaaacctggttaactataccatcacggcagagtcgcacaggcggccatacataccctacgcagcaactattccgcagcaccgctttcggttccatacgacggcacgggcgcctcgaccacatggtgatatcgatcgatatagatggcacgggcctccaggcggcgcaccaaatcttgatggtgcgtactcatcaaaaccgtcttaccggcagcaacgtaggccagcaaaaagttgactacgatgtcgcacgagtcctcatcgagcccgttggtgggctcatcgagcactaggatatcggggttcatcgacaccaccgcagccagcgcaacgcgcttcttttgcccgcccgaaagctgatagggcgaggcatcgaccagatcggcaacctggaacagctccatggcatcgcggacgcggcgctcgagctcgtctgtcggcagccccatctgcgcggggccaaaagcaacttcctcgcccaccgtagcgcagaacagctgggcgtcggcattctggaacacaaagcccacgcgctgatgaaaacgctgagcggctgcggaatccttgagatatgccgcatcgatcacgtgcccgtcaaacagatacgcacccgcgtccgctagttcaagaccgttgataaggcgcataatcgtcgtcttaccgcagccgttgggaccgagtagggcaacgagttcaccacgatcgacctgcagcgacacaccatcgacaaccgtatgccccgcataggagaacagcacgtcgcgaaactcgatgagcggcacgctcttggcgccagtagcaccgctcgcgcccatcacgccattcgtatcgtttgccaaaacgtcgcccttccctatccacatcgacggctcggccgcccgcgctacagcaccgcgcacaacacggcgagcagcaccacgacgaccgcatagaccgcatcgcgccagccaaagccgctccgcgcgggagtcggatacgcaccggcaaagccacggcaaagcatagcctcgtccatcgcgcggctgcattccatcgccttgataaaggtcatgcccatgatacccgcgatcgaatcggtacgcgaaaaacccgcaggcgcacgacccacgctgcgcagcatgaccgattcggtcagatcgtgcgccgtgcgtcccagcacctcgatgtgcttgagcgccatatcaaacgtaaagatgacctcgtcgggcagctgtagcgtcttgagcgccgccgacatgcggctccaggtgagcgtccacgaaacgcccagcacgaacgacacgttaatgaacgtcttgagcgcgatcttgagcatggcgcccgcggcagaagcgcccagcagcagggcaggcagtgccagaaccaccgcaagccccgtggcgccgagcgccggtacaaaggtcgcacgcagcccgcgtacggggcgcacggcaacgagcaccagcgcgatggccgccatcaacatgaggtacagcgggctctgcgtcagacacacgcacagaacgcaaacgaacatccccaccaggcgcaccggagccgaaacgcaagaaagggcgcggtcgaccatcgacccgccctcgtgcgcgcctccacccaggcgaacccgctcaagcaggctcgccaggtgcaggacattcttttgcatcacacgatgccgagcccccgcgggctcgtaacgctcctcggccgcaagccaactaggcagctcggctattgccatgagcaccgctttccttgaccgtcagcgagaccaggcggaatgtgatggtgagcaccgccacgccaatcacgcccgaaagaatatacatcgcagcctggccggcaaagccaaggccctgctcctcggaataggcctgcagataatcgcccgtgggcagggcgtcggcaaaggtcggggtgtcgaggccgaccgaagcctgcaggctgtcgtcgccagcctcctgaacggcggtcgcggcgccctcggcgtcccactcaccccaggcgtcaccggtggcgagcaagccgagcggcgtagccacgacaagcacggcgaccagaatgagcgtgggaatcagggaagtcttcttggcggtaccatcggcggcaagctggccatcgacggcctcgggcccgacgataacgctcggcgccgtcttcttaatgaaaccgtagatggcggccgtcgccacgccctcgaccacgccagcaaccaacatatgcggaatcatcatggccggaatggcaacggacagcgggaaggggcagtacagtggagcgcccgaagcgttggtgaagagcatcggctgaataccgaactcgatcgccgcgcacagggccgccagacacaggccgacccaaccgctcacgatggcagaaaccgaggtgccccagctcttgtcgtgcagacggctgttgagcgcacggaacacgatagcagcggtaaacggcagcacaaaggccatgttaaagcagtttgcgccaaaggacagaacgccgccgtcgccaaacagcagcgcctgcagcgccagcgcgaccgaaaccgcgatggcagcggcctcgggacccagcagcagtgcgatgagcgcgccaccaacggcgtgaccagtggtgccaccggggagcggcacgttgaacatcatgagcaagaaggaaaatgcggcgcagatgcccaggaacgccatatgctcgcgatcgagcgtggcgcgtacctttttgatgcaatggacccaaacgggcaccatcgccaccgccatgacggcatcggtctgcggggacagatagttatcgggaatatgcatgagccctctcaatcagaacgttgcgtgttacgtttccaacaatccgtaacaccgactcagcatactaacaaaaaggcgcaccgcccacaacgcagcacgtccttgcaatacgtacgttattaacccaggtccacgcaccgcccaataaagggcccatgcactcccaactttccggtcacccggaagaaggtgcggtccgctcgcaacaaggttaacgcaggaacccgcccccgagaggggttttctaaggcaacatcccgcagccgcgaagcggcgaggacgttgccgtgaaaaccccgcagggggcgggttccgaacagcaaagattacgagcggacctcgccgtttacgcccttgcacaccttggtgacgatcttctggtgcgccttctcgacctcttcgctggtaagcgtgtggtcgtccgagcgatacgtgagcgcgaaggccatggacttcttgcccttgccgatgcggaccggatcgcggtagacatcgaacaggcgcacgccctcgagcagcttgccgccggcgctggtgatgcgacgctcaaggtcctcgcaagtcacggcgttgtcgaccacaatggcaagatcgtgctcaacagccgggtactgcgagaactcgcgatagttctcttggttgcgggcgcccttgatcagcttgtccaggtcaagctcaaaagcaacgacaacctcgtcgatgccgcaggcctcgcgcgcctcggggtggatctcgccgacccaacccagcacggtgccgccggacagaacctcggccgcacgacccggctgcaaaaaggcatagccctcgccctcgacgggacggaagcgaaccttctcgatgcgcagctgggcgagcagctcctcgacgatacccttgccaaagaagaaacgcagtttacggtacttcatgttccaagactgctcgctccactggcccgaaagcacgcccgcgacggacttggtctccttgggcaggctggcgttttcgcggccatggaacaggctgccgacctcgtacaggtgcacgttgggcgtaccgtgcgcctcgttgtaggccacggattgcagcaggcccggcagcagcgagcggcgcatctcggtctgctcggccaccagcgggttcatgagcaccacggggcagccgcgaccctcggcgggcatgccgatcttctccaggtcgcccggggcggcaaagccaaaggtcgtggtctcgttgaggccgcaggcgcgcaggatctcgccgaccttgcgggtaagcttctgctcgcgcgtcaggccgccgatgtggttcttggcagccggaatggtcgccgtgacgcgacccatgccccacaggcgcaggacctcctcgatcaggtcgatctcacgcggcaggtcgggacggaagctcggcggcgtgaccataaagtcctcgccgtcgcgctcgacggtgcagcccaggcgggtgagcgagcgctcgataaagtcgggctcgatgtcggcaccgcagatggcgtgcacacgggccaggcgcagcttaatgctgtcgatggtcttgggcgcggggaaaacgtcgacatagccgggagcaacctcgccgccggcgatctcttcgatgagcgcgcaggtaacgttggcgacatccacgcagccggtctcgtcaacctggcgctcaaagcgaatggaggcgtcggagatcagcgacaggtcacggctggtgtgcgaggtgcggccggcgttgaagcaggcgctctcgaccatcacgtcgacggtatcgtcctcaatctcggaatccatgccacccataacgccggccagcgccacgggacgctcgccgtcggtgataaggcccatgccggcgtcgagcacgcgctcctcgccatcgagggtcgtgaacttctcgtcctgctgggcggcacgaaccaccacgcgacggtggccatcgcgctcggcaaaggtagacaggtcaaaggcgtgcagcggctgaccggtgagcatcatcacatagttggtgatgtcgacgatattgttgtgcgggcgcacgcccagggcgttaaggcgcttgaccatccagtcgggcgaggggccgaccttcacgttacgtacgatgcgggcgacgtagcggtcgcacaggccctcgtcggcaatctcgacggaaagctcgtcgtcggtcgcgcggccggtctcggccttgatggcgggcagctcaacgtggaaatcgcggtcgaagatggcgccggtctcgcgggccatgccgatcatggacaggcagtcggggcggttgggcgtgatctcgcagtcgagcacagtgtcgctcgaacccacgtactcggcaaacggcatgccgcagggcgtatcctcgggcaggatcataatgccggagtggtcgccgcccaggccgagctcgcgtgcggagcagttcatgcccatggacacgacgccgcggagcttgctcttcttgattttgacgtcgccgggaagcacggcgccgatcatggccgtgacgatgtggtcgccagcctcgaagttctgcgcgccacagacgatctgcagcggagcggggttgccgtcggcgtcgagattcttgtcacccacgtcgaccgagcacacatacatatggtcgctatcggggtgcggggtcttggtgagcaccttggcagtcaccacgtggtcgaaggactcgcccacggtgtcgatcgcctcgacctcggtgccggtacggatatattcgtccgaaagggtcttgggatcctccggaatatcgatcatggtcttgagccagtcgtaagaaacacgcatctagctctcctttcatactgaaagcctgcgaagagatgcaggtggaaacttcaactttgtgaacattccttacaaagcgagggttgtccaagtgcggcaaatcggcccgaaagaggagcgcctcgtactatggtacgcaagcgacgaatgagcgccgaggtgccgtgcttgggcaagccgcagcctagaactgattcaggaaacgcatatcgcccgtcatgagcgttctgaggtcgggcaggtcgtagcgcagggccgcgacgcgctcggcgccaataccaaaggcgaagccggtgtacttctcggggtcgatgccgcagttgatcaggacgttggggtcgaccatgccgcagcccaagatctcgatccagccgctgtgcttgcagaagttgcagcccttgccgccgcacacgtggcagctcacgtccacctcgcagctgggctcggtgaaggggaagaagtgcgggcggtaacgcgtcttgcgatcctcgccaaacatgcacttaacaaagtagtcgagcgtgcccttcaggtcgccaaaggtgatgccctcgtcgacgaccaggccctcgatctggttgaactgcggcaggtggcaggcatcggccgtgtcgggacggtagacggtgcccgggcagatcatgtagatgggcggcttctgcgactccatagtgtggatctgcacgcccgaagtctgggtgcgcagcagcacgtcggactcgccgtgggcgtgagcctcggggtgcgcgacgctgccggggttgttgtcgaccacgtagaaggtatcgcgggccgagcggctcgggtgatccatgggagcgttgagcgcggtgaagttgtagtaggaggtgtcgaccatggggccggactcgacggtgtagccgatgccgcagaagatgtcctcggcctcctcgatgatttgcttgatcaggtgctggtggccgatctgcggacggatgcccggcagcgtgatgtcgacggcgtcgtgctccagtgcgcgcttgagggcggcggccttcatctcggtgttgcgctcgtcgagcatgccctcaatcagctggcgcatctcgttggctcgcttgcccatcacgggacgatcctcgggggcgagcttgcccatcatgcgcatcaggccggtgatgcggcccttgcggccgagcagctcaacgcgcgcagcctcgagcttggctgcgtcgtcggcgcctgcgacgagctccttggcctcttcctcgagtttgaccagatcatcaatcagactcatgtcttccctttcgtctctcgcgctctccgtttgccgaggcggctgccaccgtctggcgttgtgaaaacgcggcccggttcggtaataaaaaaaccgccctcgggcatgtgcattgcccaaggacggttgaattccgcggtaccaccttgtttgacccggcggatgtctggcccgccgcgcccactctgtgccccttgtcgcgaggctcacggcttccctactggggcttcgccaccgctggccgcgtgcccgttgaggtcgctgctcgggagtgaacgcttggcccttgtcaccgcaggaaggctcgcagcccatgaccttccctctcttgccggcgacgcggcgggcaaaaccctctccgtcaacgcattgggctataggataacacattctgcgtgtgcatcgccgcgttccgttttgttcgcactgggtacaaggcaggtagctgtgcaaactggccgcacgcccacccgtggcgctcgacctgcgagatcaaggatataggtatgggaaagaaactcgataagaaggccaaggcgggcaagagcatcaagaagctccgcaagctcgagggcaagctgtggactcgcgagtacctgctcaagattgccgagtttgacggcgcgaccattgctcccgccaacggcgccgcggcccgcgccgatgctatgggcacccttgctggcgagcatcacaagctgctgaccagcaaaaagtctgtcgaacttgtgcgctcgctggcacgagagaccgtcgcgggcggcaagatcgacgacccgcagctgctcgacgagatccgtgtgctcggccgcgaccagcgcgaggcaagcgtcatccccaccgaggaggccgaggcctggaccaggctcacctgcgaggccgatgccgtgtggcacaaggccaagacggccaatgactgggcgagctttgagccctatgtggatagaatcgtcgcccaacttaagcatcaggccgagctcatggaccccaagcgcgacccatacgacgtttggctcgaccagtacgagcgcggcctttccgccaagagcttcgatgcgttttgcgatgaggtcaaggccacggtcgtgccgctcgtgcacgccatcggcgagcgcggccagcagccggctgccgactttttgcacgcccacgtgcccgaggctgcccagcgcgccatgagcttcgacttgatgaagcttgtcggcctggacctggacgacaccacgcttgcctttaccgagcatccgtttagcgagggctttgccgtgggtgatgcgcgcatcgcgacgcacatctacgaggacgactgcatctccaacgtctacagcatcatccacgaggcggggcacaccatgtacgagctgggcgtcaatcctgcctatgcgcgcacctgcctggagggcggcacttccatgggcatccacgagagccagagccgctttttcgagaacaccgtaggtcgcagccgcgcctttatgggcccgctgctcgaggtgctgcgccgtcacgcgcccgaggtctatggcagtgtggacgaggatacgctctaccatgccgtgaacatcgcacagccgtcgctgatccgcaccgaggcggacgagctcacttatccgctgcacgttatggtgcgctacgagatcgagcacatgctgtttgccggcgaggccacggccaaggacatccccgcgctttggaatcgctttatggatgagtacctgggcattcccgttcccgacgacacgcacggctgcctgcaggatacgcactggagcggtggctcgtttggctacttccccacgtatgcgctgggtagcgcctacgacgctatgtttgtgccggccatgtgccgcgacggcgtcgaccttaccggtgcctgtgcgagcggcgatctggcgcccgtccgcacctggctgggcgagcacatttggcaatggggtcgcgccaaggacgcgccggagctcatcaagagcgcctgcggtatggcgtttgacgcccgctactactgcagctacctgcaggacaagttcaccacgctctacgagctgtaaggattgaccagcacgccatcgccaacgccaaccatgttgacgccaatgtcttggcaacgtcagcgaaaacgaccctaagcgagcaaggtgacgtgaaatgaaagggcgctgaccttctggtcgcgcccttgaaattgaacgtcagattgccgcttaggggcgtttgcagcgtcgagcagttacgcggtaagagaagaggcggggcatgccccgcctcttacaccacatctctgcgcgctacccacacgacgttttttggcaacaaaaccccagataaattgttggtaaaacagcggtctggttggcagttccagattttgccgcatacttccgaaaagagggggttagataagtctccagacgccgctttttgcctaataattctcgtcgaggaagtcgttgaccgtgttccagtagagctcggggtcgacctgtgcgctcttggcgtgggcggcgccgtggacggtgagcttttgcttgaccttgctggcgcacgcctcgtagttttggtcgagcatgctgtacggcacaaaggtgtcctggtcgccgtggataaagagcatggggaccgttgcgtgcttgagctgctccacgctgctcgctttatgaaagtcgtagcccgcgcgcacgttgcacaccaggttggctacatcgagcaagggaaaactaggcaggccgaacacgtctttaagctgcagggaaaactcgtcccagacactcgtatagccgcagtcctcgataatgcacttcacgtttgcgggcagagattcccctgccacgttcatggcggtcgccgcgcccatcgactcgccaaagaccaggatgcgcgcctcgggatctgcctgaacaatccgctcaatccatgcgacgacatcgagtcgctcgggccagcccatgccgatgtagtcgccgccggagcgctcgtgggcacgggcggcgggcgcgagcacgttcatgccgcggtcgtggaggcgcttgacgtatcgtgccatgccgatgggctcgttggtgtatccgtgcaggcagacagcataatcgtgagtgctctccggtgcagcgaaataccaagcggcaagctcggtcccgtcatccgcggtgaggctgctgctctcgcggttctctttaaaccacgcccgtgcctcggtctcctcggcatccatctgctcgccctttccggcgtcctttccgtcctgcatcatcttcatggtgtacggcgcttgggggttcagggcaaagtcgaacaagaagttgccggcaaaccccaatagggcgacaacgagcaccgcggcaacggccaggccgatcttgagccctcggtgggggcgtgtattatgagccataatcgctctcctataagatgtttatatgtcaacatttattgcaagcgcattatggatgttcgccgttgatgcgtcaacaagcaaagagtgggtaaacaaaaggtcacgtatagtgcaaatttcgcacgtacccagacgctttgatatagtgttgagaactatttatgttggaggatgtaaccggcatgtccgattcgagcgacagttccaagccgcgacctaaggccgcggccgttccgcagtacacggtgggcgaggagatcatgaactccgtcacccatggtgtcggctgcctgctgggcatcgcaggcctcgtacttttgatcgtattcgccgccctgcacggtggcggtccggcccacatggccgcggcgatcgtctacggcgtcagcatcatcctcgaatacctggcctccacgctctatcacgcgattcagcccgcaggtgccaagcgcgtattccgcatcatcgaccacagctgcatctatctgctcattgcgggcagctataccccgttttgcctcatcacgttggcaaacgacggcggtgccgcgccgttctttgccgtatgggccatcgccatcattggcatcgcgctcgagtgctttttgcgcgagcgtcagccgcactgggtaagcggcctggtctacctgctgatgggctggctcgtcgtctttaagctgcctgcgctcgtggcgctgctgaatcccgtcgcgttggcgctgctcgccgtcggcggcgtttgctacaccgtgggcgtgccgttctacatcgccaaaaacgtgcgctacctgcacagcgtgtttcacctgtgggtgctcgccggtagcatcttccagttcatggcggtgatcctcttcgtaatctaacgaccgagcctgtgcccgcggatccacccaggtggccgtcgggcgcaactgccctatccgccatctacgtctcctgccaacgtcccgaacttggaggttcgagaaactcccgatggacataaccatctctcttattaccacgctcgttttaacgctcatcaacggctacttctctatgtccgagatggcgctcaccacggccaagcgcgccgtgctggagcacgaggccgaggagggcgacaagcgcgccgagcgcgccattaagcttgccgccgattccgaccagctgctggccaccattcaggtcgccatcacgctcgtgggcttcgcctcgtctgccgtcgcctcgacgagcctgtccgacccgctcgccacgtggctcatgagctttggcatcgcgccgctctccgccatcgcgcgcggtctggcgccggtcatcattaccgtcgccgtcgccttcgtgtccatcgtgatcggcgagctcgtgcccaagcgcatcggcctggccaacgccgagggcgtgtccaagcaggtcgtggggccgctctccgtgttccaaaagattgcccgcccgcttgtgtggctgaccggcgcctgctccgacggcttggctcgcatcctgcgcatcaagagcgctgacgaccgccagaacgtctcggaggaagagatcaagtacatggtctcggagcaggacgacctgctcgacgaggaaaagcgcatgatccacgagatcttcgacctgggcgacaccgttgcccgcgaggtcatggtgccgcgtgtggacaccaccatgtgcgaggatgacgagacggtcgccgacgtgctgtccaccatgcgacagaccggctttagccgcatccccgtctaccacgaggatcccgacaacgtggtgggcatcgcgcacatcaaggatttgatccagcctgcgctcgacggcaagggcgaccagcccatcgccgactttttgcgtgacgccgcctttgtgcccgataccaaggacatcctgccgctgctgtccgagatgcagacctcgcacgaccagatcgtggtggtcgtggacgagtacggcggcacggccggcatcatcaccatcgaggacatcgtcgaagagatcgtgggcgagatcgaggacgagttcgaccccgataacaagtacctcacgcgcctctcgcgccgcgagtggctcgtcgatgggcgtttttcgtgcgatgatgcgattgagcttggatggccgctcgaggaaagcgatgattatgagaccatcgccggctggattttggagctttgcgactcggtgcccgacatcggagaggtgtttgaggttgcggggtacaagtttaaggtgcagtcgatgcgtggccagcgcatctcgctcattcgcgtgatcgctccggccgaaaccgataagaaggattccgagtccgcggcggacgagccgacggcgtcgggtgcggatgctgcgattccgcacgacggcgacgagtaggacaagggcgagtaggagagagttatggcaggcctgttcaacatcctgaaggtcaccgtcagcgaggacaagatttgcgcgcacgtgctggtgaaccccggcatgccgctcatgacctcggaggatatcgaggccacggcgcgcgtgtactatctggtgccggcgattgccaagcatctgtgtctgggcgattccggtcgcgagttccaggattgcatgggccagaccgagctctgccacctgctggagcacgtgtcggtcgagctcatgaacgagaccggccttgccggcaatatctcgtgcggccgcacccgcgtgagcgagcatgacgagcgtgtctttgagattgagctttcgtgtcccgacgatgcgctggccatcggtgcgctgtcgtctgccaccttcatgatggattgggcttacctgcacgccgaccagcccgcccccgacgtggacggcacggtcgcgggcctgcgcaacctggttttgggcatgcgcgccgaggccgagggcaaggatccgcacgaggccgtcgccgccgcgaacggtgaggacgtggccgacgatgcggccgaggacgacgttcctgccgacgccgacgtcgattccgttgtcgatgcggccgccgagccggcagctgagccccagggcgtccccaactttgaagacgagccccaggtagcgattgataccgagggcgcggttgtcgagaaccacgaggcctccgcggccgtcttcggcggcgcggcaacggctccgactgggtcggcgcatgaaagcgcgctgccgctcgtagacggtgccggcgaggatccggctgccactgttgccatgcccgccatgccgcaggagtaggtttgctcgctcaacaccatcatgtacctgcgcctttgccgtatgcagatgagcggggcggtaagtgttgcgctgcgggtataatggacagcattcaaacggtgggcgccgacgtgcccgcaggagaggaatgatcatgggtaagacttttagctttgtctccggtgcactctttggtgtcgccgccggcgctatcatcggcgttgctctggccccgcgctcgggtgccgagacccgcgccatggctgccgatatcgccaacgacgcttgggataacatgcgcgatacctacgagcacggtgccgaggaggcccgcgccgcggtcaacgacttcggcccgatggtcgatgccaagaccgatgacctgcgcgccaaggtcgatctggcccgcgagcgtatggatcagctgcgtgagcagctcaacgacgccatctcgggcggcaacgtgacgcccgctgccgacgtcgtggtcgagaacgccgccgaggccgacaccgaggctgcggagccctcgaccgaggcataatgcgcgccggggattttgtcggcgccaagatctatcgcaagcccaccgaggacaagcgcaccaaaaaggacggcacgccgcgcagccctaaaaagctcggaaagatacactttccggtctttactccgggcggtacgcgcgtggtgggctttatggttcgccagtccgacattgcgggcatgatcgagcgacccgaccgatttgtggcgctcgatgccatcggcgtctatgagggcgccatcgcggtggatgacgccaaggacacctacgatgccgctgcggccaagcgcctcgacattaacctggacgattgcatcatctgggttggtatggacgtgcgcacggaatcgggcgatgtcgtgggctattgttcggacgtggagttcaagccgcgctcgggcatcgtccagatgttctatgtgaccgccggtgccgcttcgagcgtgcttgtcggtgacacacaggtgccgccgacgatgctgcgcggctacgagaacggcgcgatgatcgtttcggacgaggtcaagacactcgggtattcgggcggcgcggccgccaaggctgccgaggccagtgccgtggtgggcgataaggtcaaaaagggcgccaaggtgctcgatgacaagggatcggtcgccgtggacaagggcagtcgcgcgctgggcaagcagctcggcaagacgcgcggcatgttcagggcctttaaggacgaataccaaaaggcgagcggtggctcgtcaaaagctagcaaatagcgacgtaccaaatgatggggggcgagccggagacatgttgctccggctcgctgtgtttatgggggagggcacatgcgccaaaacggatccaacttaaacgggcactccggtgcgcgtccgacggcgcgccgcgacctgggacagctgcccagcggccagcgcaaacgccgccgtaagcccggcgcgatgtacctcaaccatagccgcggttttagcgaccgcagcgcgcgcattggcaacgggcgctcgccccgccgtccatcccgtctgccctatgcgctcatcgccgtgggctgcgcgctcgtgctgtttatcgctgccgtcgtgggctacgtcaaccgcagcgtggacgtggagctcaacggacaaaagaccgcggtgcgcgtgggttctacgctgcaaaatcttatcgatgaccaggagttgaccgacacctatgacgcgggcgacttgttggccgtcgacgacagcgtgctcaagcgccacgggggcgaaaagctgtcggtgaaggttgacggcaagcgtgtaaagcagggcaaatgggacagccgcgagcttaccggcggcgagaaggtgacggtcaaagacggccgcaacatctatgagaagcacgaggtgcaggccacgaccatcgagcccaaactgaaggtcgagggcacgggcgccatcgagtatgtgcagacatggggcgtccagggtcgctccgaggtgtgggtcggcgagcaatcgggcaagacgcaggaccgtggcgaggttgtgcccgcgaccgattgcgtggttgcctgcgccagcgtggcgcccaagggcaacgaaaagtacgtggcgctgacgtttgatgaggggccgagcggcgccaccaagcagattttgcaggtgctcaaggagaagggcgtgagcgccacgttcttcctttcgggcgatgccgccgaggcctcgcccgccacggctaaggcgattgtcgacgccgggtgcgaagtcggctccaatagctatagcgatgattcgctcaagggcgaggatcgcgagacggtgcgcaagcagatctcgaagggcaccgatgccattaagtctgcgaccggtgtaaagacgatgctgctgcgcgctccctacgccgcttttgacgagcaaaattggattgactcgatggacttggtgtctgccgtggtctcgtggaatatcgactcgggcgactggttgctcaatggtgccgacgaacaggtctcgacggtgctcgactcggtgacgccgggcaatatcgtgctgcttaccgatagcgatgagtgcgccgagcagacgctcgaggcactgccgcagattatcgacggcctcgttgcagacggctacaagatcgtgacgctgagcgacttggtcaagacggacacgtcgctcagcaaaaagctcacctcgctgacgaaggtcacgatgcccaagaacgccgtgttcccccaactcgccgaggacgacgacaccacggagtagtccccaacgactatgtcacggatacgttagcgtttggtatgcctgcaatgtgcagcgcataaactcggtgccgcagcacgatgctgatgctatagttactgcggttaatgagggtcaagagaaaggttgcaggtgaaatccaaacctcgaccatacagtcgatgaccccatgcaggtgctttttgcgcatgcacggggtgtaagcgtcgagcggcgtgccgcccgcgcatgcgtatacatatccagaagtccacggatggcgcgccgcccggccgcggtccgcaggaataatgatggggagcaccagtgaattatctgagtgagatgctcaaattgccggttctggacgtcgatggcgagaagctcggcgtggtgaacgattttggcattgctaccggcgaagtttttccgcacgtgacgtcgctcgcgtttcgcggtcccggcaagacgccgtttatgatcagctggcgcaagtgggtcgaccgtatcgacgagacgggcgtgtacctcaatacgtctgccactaatatccgcttttcctacctgcagccgaccgagctgctgctcgcgcgtgacgtgctcaacaaacagatcgtcgatacgcagggcatgaaggtcgtgcgcgtaaacgacatcaagttctccatgtcgggcgaaaaccagctacgtctgctgggtgccgaggtcggtgcccgcggcctgctgcgcgcgattagccccgcgctcgagcatgtcgtcgagggctttatgaagcatctgggcaagccgctcagcgaggacatcatcgcctggtcctacatggacctgcttgaccgctcgaccaagaacattcagctctcggtgtcgcacaagacgctcggcgagctacaccccgccgacatcgccgacattatcgagcagctcgacccgcgtctgcgcgcacaggtgttcgcgcagctcgacaccgcccaggccgccgaggccatctcggagttcgatgacgacgagcttatgaccgagatgctcgaaggcctgtccgacacggacgcatcgtcgatgctggccatgatggacccggacgacgctgccgacctgatcgacgagctcagctacgagaaggccgaaaagcttctgcgcctgatgggcgtcaaggaggagaaggcgattcgaaacctgctgggctacgaggacaacaccgccggccgcatcatgacctcggagtttgtctcgctgcccgccacggcgacggtcggcgacgccatcgaggcgattcgcaaactcgacgaggacttcgagagcgtctactacgtctacaccgaggatccgagcggtatgctgacgggcgtgctttcgctgcgcacgctgattgtggccgaccgcgacgccacgctggggcagctcgcctatcgcgacctggtctatgtgtcgcccgacgaggaccaggaagacgtaacggacgagatgaccaagtacgacctggtcgccattcccgtctgcgacgagaaccgtcatatcctgggcatcgtgaccttcgacgacgccatggacgttatcgccgaggagcatcaggaagacctgcagatcgccggcatcggctcgggcgacagcgcatcggacgactcgacgaacgtgctcagctggtttgtgcatcgccagtactgggttgtcgtgtggggcattgcctcgtgcatcatggcaacggtactggggacggcgctcggctccgcgcacctggtggtgtttcccatgtgcgccatgccgctcgtgctgctggccgcctcgcgcatggtgtcgttcgtcaagaactacttcctcgagtacgacggccacgacgatgagcccaaaccgtacctgggattcttcttccagagcacggggatgggcctgatcctgtcgctcgtgacctacctgtgcgcgcagctggtgcgcaccgccgctttccccgatgctcccatgttcgaggagctgctctttaccggatgctttaacattgcggctattatctgcctggttagcaacatgagtgccgtgatttatctgatggtgctgttctggcgcgatgagcatgacctcaacacgtcgggcaccgccatgaacgttattgccgtcatgatctcgtgcgtagcgtactgcgccgctgcggtgctgctcaccatgtcggtcatgggataggtggtcgcgtgcaaaacacgaagcaaaagccgagcaccaagcaaaagctgaccattgccgccatctttggcgctatgggccctggtctgctggcggcgctttcgggcaatgacgctggcggcatcgccacgtattccagcgcgggcgccagctatggctacaagatgctctggatgctccccgtcatgaccgtgctgcttatcgtgacgcaggagactgcggcgcgttgcggttgtgtcacgggtaagggcctggcttcgctcatccgcgagcgcttcggcgtgcgcaagagcgtgctggccatggcggcgctgttgatcgccaacacggccgtgactatctcggagtttgcgggaattgcgagcggtcttgccctctttggcgttccggcgagcatctcggtgccgctcgtggcgctgctggtgtggatgcttaccatgtcgggcagtttccagcgtatcgagaagattttgctgctggtgagctgcgtgtttgtgacctacattgtcgccgcgtttatggctggccccaattggggcgaggtcgcggtcgacttggtcgtccccaacattcaaaatgatcccaactacgtgtcgctcgtggttgcaacgattggtactaccattgcgccgtggatgatcttcctggcgcagaataacgtggtcgataagaatgcgggcgaggacgatatcgtgctgcagcgtatcgataccgtaagcggctcgatcgctgccgatatcatcgccggcttcattatcatcacgaccggcacggtgctgttcccggcgggtatccagattagcgacgctgccgacgccgcccgtgcgctggaacctatcgcgggtcagtggtccacggtgctgttcgcctcgggcctggtcgccgcgagcttcttggctgcctgcgtgctgccgggcgttacgtccagcgccatctgcgaggcttttggttgggagcgcggcgccgaccgcagctgggacgaggctccggtctaccgtggtatcattacagccattatcggtatctcggccgtgctggtgcttatgcccggtgtcgacttgttccagattatgatgacctcgcaggttatcaatggtgtgctactgcccgtggttttggtgttccaggtggttattgccgccgaccgtcacattatgggcgccaaccgcaacggccgcgtgtggaacgtgctcacgtgggcgaccatcggcgtgattacggtgctgacggtcgtcatgtttgtgctgcaggcgatgggttacagcgcctaacttccttttagcttcctagcaggccgcagcaatgagttgcggcttgttttttgcttgctatagggggttagttatatggcagtgggcaaaaaatgccaaatatgagtactgttgctaagcgaatagcgtttatgtgcaagaagataatgtacataatctagagtgtgtacattaaaattcgccccagcaggctctaatccagctgagttggccgctttggtggttggcaggggtagcgcgcagagatgtggtgtaagaggcggggcatgccccgcctcttctaagagaagaggcggggcatgccccgcctcttacaccacatctctgcgcgctacccgatgctttttctcaaaatcgagaaaaacgtcgaatgttgggacggtttgaggcggggtgaggagcatggagggccaaagcaccgtgcccgaacgggttaatccagctcttttaagccgtgcgccagctgccagtactcgccgtgctgggcgagcaactcttcgtgggtgccgcgttcgatgatgcggccgtgttcgaggaccatgatcgcgtcggcgtcgcggacggtggacaggcggtgcgcgatcataaacgtggtacggccgcgcatgatgcggtccatgccgcgctcgatgagcttttcggtacgcgtgtcaatggagctcgtagcctcgtccagaatgagtaccggcggatcggccacggccacacgcgcgatggcgagcagctggcgttggccctgtgacaggttggcgccgtccgccgtgaccggcgtgtcgtagccttgtggcaggcggcggataaacgagtcggcgcaggcggcctcggcggcagcacgaacctcctcgtcggtcgcgtcgagcttgccaaagcggatattctgcgcaatggtgccgctaaacaggtgcgtatcctgcagcacaatgccgagcgacccgcgcaggctggccttggcgatatgcttgacgtcgatgccgtcgtacgtgatctcgccgtcatcgacctcgtagaagcggttgataaggttggtgatggtcgtctttccggcgcccgtcgaacccacaaaggcgatcttttgccccggcttggcaaacagattgaggtccgtgagcacgcgcgtgcccagcacataggaaaagtccacggcatggaagcgtacgtcgccggcaagcggcaccaacccggtcacaagttcggtgccgtcggcagccaccgcgcgacccgcatcgtcgaccgaggccacgtcgtgcagatgcccgtacgcgcccacgccacggccctcgggaatcttccacgcccacgcggactcgcccgtctgcaccagctccacgcagccctcgtccacctcgggctcaaggtccatcgcggcaaacaggcgctcggcaccggccagcgcgttgagcaagaagttgcccagctgcgtaaactggttgatgggcatggccgcctggcgcacaaagaccaggtagctcgcgagcgctcccacgtcggccaggccgttgatgcagagcatgccgcccgccaccgcaacgatggcgtagttggcatacccgatcaccacggtcatgggcaccatcgagttggcgtaggcctgcgcggcgccaccggtgcggcgcagctcatggttgcgcgcgtcaaaaccggcaacgttggcctgctcgtggttgaagaccttgatgaccttttgacccgacaccatctcctcgacatatccgtctaggtcgccgagcgatgcctgctgggcggcaaagaaacgcttggatcgaatacccgagtagcgcgcatacagcacgatggccgcatcgcacacgagcgtgatgatcgtgagctgccaattgaggatgatgagcatagccgtggtgccgatcacctggattgtcgcctggatcacgttggcaaagctgttgttgagcgcctcggagaccgtgtcgacgtcgttggtgaaaaagctcatgatgtcgcccgagcgcgtgccgtcgaagtagctgagcggcagcgtctggatgtgcgcgaacaggtcgcggcgaatgtcggacaccacgcactgggctgcgcgcaccatgatctgcgagtagcccagggccgacagcacgcccgcggcatagatggcagccgtaaagagaacctgcttggcgagcagctcctccccgcccgtagccaggccgttgacgatggggcgcaccatataggtgccggcaaggctcgcgatggcggcgatagaagcgagcacacctaccgcaagcagcgagaacttggcgtggcccatatagctgagcaggcggcggagcgtctgccctagattggccgggcgggcctgagcggatgttttaggcatggcgctcacccccttctcgggccagggcatctgcggtcgtatcccccgcgaactccatctgcgaggcataaatctcctggtagatgttgtcacccgccagcagttcctcatgcgtgcccacaccgtgaacacgcccgtcgtccagaaccacaatgcgatcagcgtccatcacgctcgcgatgcgctgggcgatgatgatcacggtcgtatcgggaatctgcgcgatatgctcgcggatcttggcgtcggtcgccatatcgaccgcactggtcgagtcgtcaaaaatgagcacgcgcggatgcttgagcagcgtgcgcgcgatgcacaggcgctgcttctgcccgcccgaaacaccggcgccgccctggcccagctcgccgtcgagcccgccgatgcggtccaggaactcgtctacacacgccgcacggcaggcacgtagcagctcctcgtcggtggcatcgggcgcgccccactgcaggttctcgcgcacggtgcccgtaaacagcacgttcttttgcagcacaatgcccacggcatcgcgcagggcggccaggtcgtagtcacgcacgtcgcgcccgcccacgagcacgtcaccctcggtcgcgtcgtacagacgcgcgatgagctgcacgagcgagctcttgcccgagcccgtgccgccgagcacgcccaccgtggagcccgactcgatgcgaaggtcgatatgctcgagcacgtcctcggcagcatccgcgcggtacttaaacgacacgtcgcggaactcaatgcttccgtcggcggcctcgcgcacagccacgtctgccgcgggcgcctggatgagcgactgctcgtcgatcacccgcgagatgcgctccacgctggcaagcgcgcgcgtgagcagcaaaaacacgttggaaatcatcatgagcgagttcatgatcagcagcacgtagctcataaagcccgtgagcgagcccacacctagctcaccggcaataatcatgcgcccgccgatccacaggatggagatggcggccacgtacatcgacagctgaaacaccggcaggttgagcacggcattgccgaaagtcttcgtcgccgtgtgcgcgagctcggtattgacggtatcgaacttggcttcctcgtgctcggcgcgcacatacgccttgacggcgcgcacggcagtgaggtcctcctgcaccacaccgttgaggtgatccatcgaggtctgcagctggcggtagagcggactcacacggtaggtgataacacccagcacaatcgccagtacaggcaggataatcgcgaagaccgtggcgagcgggcgcgacagtaccagggcatagaccaggccgacgatgagcgtcaccggtccacgcaccatggggcggaagccgttgccgatggcgttttggataacggtgatgtcggtggtcatgcgcgtgacgagcgagctggcgtcgtagttgtccagattgccaaaagcgagcgtctgaatcttacgatactcggcctcgcgcaggttggcgcccagacccgaggccacgcgagcggacgtgcgggcataacccaggcccagtaccagcgaaaacgccgcgcacaccagcatgcacgcgccttgcagcagcatgtagttgacgtcgcccgcgggcacgcccacgtcgatgatgttggccatgatgactgggataaacagctcgagcgccgtctcggccgtaacaaagagcacgccgagcatggcgtcgcgacggtattcccccaagtaggaaaacaggattttgagattgcgcacgcaggttcatcccccatcaaacgttgttcgcaaacgcacgtattattgcgcgccgagcgatggtgtcaagtgttccgaaatcgatttctataaggccggcgcaggcgctaagcccgcgcggcgcgcgaccgtattcaaatggaaatgattgtgggcgagaaattttctccctactggcacatgaaccttgactctacaatcgttgtagggttttcactacactggtacgtaaacgaaccaagccagaaagtgcccgcccatggaacacgacctcacacgcggtaatgtcctcaagaccatcgcggtcttcgccctgccttatatgctctcgtactttttgcagatgctctacggcatggccgacctgtactttatcggacagtttagcggtgccgccggcatcaccgccgtgggcaacggcgcgcagacgctttacatcattaccgtgacgctcgtaggcctggccatgggaacgaccgtcatcgtcggccacgccgtgggctcgcgacgcttcgaccgcgccgaggccgccatcggcaacaccatcacgctttttatgggcgtctcggtggtactggccgcgcttctgctcgcactgtgcccgcagatcgtggcactcatcggcacgccggccgaagcggtcgaaggcactgccgcctacctgcgcatctgctttatcggcataccgtgtatcgccgcatacaacatcctttcggccatcttccgcggcctgggcgattcgcgctcgcccatgtacgtgatcggcgtggcgtgcgtcatcaacatcgcgctcgattttctgtttattggccacatggggctcggccccgtgggcgcggcgctcggcacggtgatcgcgcagacggcaagcgtggccctcgcgctcgtctggctcaagagccgccgcacaaacatccacgttaaacgtagcgacctgcgtccgcagcccgaggtgctcagcagcatccttaagattggcgtgcccgtggccgtgcaggacggctgcatccaggtggcgtttatgttcatcaccgttatcgccaaccaccgcggactggtcgacgccgccgccgtgggcctggtcgagaagatgatcagctttttgttcattgtgccgagctccatgggcgccaccgtcagcgcgctcacggcgcaaaacgccggtgcgggcaagggcgaccgcgcgcgtcaggtgctcaaggacgccatgaccatctcggtggtgtacggctgcctgatcacagccctcatgtggctggtggcaccagcgtttctcggcttttttgccaaggacgccgcagtggtcgccgccggcaccggctatatgcgcagttacattttcgacgcgatcttcgccggcatccacatttgctttagcggctttttcgctgcgtacggcaagagctacatcggctttgcgcacaacgtgctggccgtcgcgctcattcgcgtgccgggcgcatggttgttgtcgaacgcctattccgacacgctgtttcccatgggcatcgcctcgccgtgcgggtcgattctttcggcagccatttgtgtggtggcgtttacggcactcaaccgacgtggcacttttgacaagctggtggcgtagcggggcgacgcaagcctagcaaccctgtcccgctttctgccgaaaggagcgatcccgtgactgacacgtccaacgaacataccgacggcctgctccgcattggcgaggtggcgcgcctgtttaacctgagtgtgggcacgctacgccattacgagcagatgggcttgctggagccggcgcatatcgaccccgcaagcggctatcgatactatggagcgcgacagctctccaccctcaacaccatcagcaacctgcgcgttcttgacttgccattggcgcagatacgcgagtttgtcgccacgcgcgacgtgaatctgatgcagcggcaactggcccagcagcaggagctcatcgagcgcaagcgccgcgaactcgaacgcgtgtcgcgcaagatcgatgaccggcttgtcttgttgcgagacgctttgaatgccgagctcgacaccatccgcgagaccgaggcacccgagcttcgatgcgccgtactacgtgaacgcgtcaaccctaccgacgcctatgcgctggagtggcagatccgtcagctgcaaaaagggcagcacgagaccttcgtctttcccggcaacttgggcgtgggcatcgcgcccgagcgccttgccgccggcgacttcgatggctacgacgaggtctttctgctgctggatgacacggacgattacctgggggacgtcgaggttcggtccgccgcacgctgtttgaccattagcttccgcggcacgcacgggcaggcggcgctgcgctacgagcgcttgctcgattacatgcgcgagcgtaacctatcccccgccggtccctcgcgcgagatcgccctcatcgacgacatcatcagcgacgacccggcgacctacgtcacgcagatcacggtgcctgtgtcgctaggctagaccgagcttcgcttctagctcggccaacgcctcaaatgcatcgcgagatatgcctgccgcgcgctcgcactcggcaacgcgaattcgcgccatcaggtgctcttttgcctgcgtttgggagcgcctcgtgcgcccttccgcctgcgagtaattgtggttctcgatatccattacgcctctggcacctcaccagtcgcaaggatctgctcgagtgcgtcctcgtccagcacgggcacgccgagctgctcggccttggtgagcttggaacctgccttgggaccggcgaccaggtagctcgtcttcttcgatacactgcccgaaaccttggcgccgagcaccttaagcgcggcacccgcctcgtcgcgcgtgcgattgacgagcgtaccggtcagcacaaacgtcaggcccgcaagcggctgcgcgtcggcgagctcgcctgctacgccggcatcggctgcagcctgcgcatgtgcggcgcccaagtcaacctcgagtgacaggcccgcttgacgcaggcgttccagcacggcaaggttctcggacacagccaggaaccgcttgacgctcgctgcgattttgggaccgataccctcgcactcggcgatgtcctcttcgctcgccaagatgagcttgtcaatcgacaagaatcgctcagcgatgagctcacccacgctcttgcccacgtggcggatacccagggcaaacagcacgcgaccgagcggctggctcttggacttgttaagctcggcaataatcttctcggccgtcttgagaccaaccggaatgggatcgcccttcttaacgccctttttgctgttggagctcgcgtacacgcggcccgtgtccaggccggcaatgtcgtcgaccgtgagctggtaaaagtcggcgacgtcatggatcagaccggcggcgatcatcttgtcgacaatctcgtcacccaggccgtccacgtccatgcagccgcggctcacccagtggagcaggcgttccttgagctgcgcggggcagtcgatggagacgcagcggtaggcgacctcgccgtcctcatgcacgaccggactgccgcacacggggcagacctcgggcatatgccagtcgaccgaatcggccgggcgcttgtcgagcaccgagcccacaacctcggggatcacgtcgcccgccttatgaacgatgatggtgtcgccctcgcgcacgtttttgcggcgaatctcgtcgatgttgtgcagcgtagcgcgcgcgatggtggagccggcgaccgttaccggatcgaactccgcgaccggcgtgagcacaccggtgcgacccacttggatgcgaatctcgcgcagaatggtctgcttctcctcgggcgggaacttaaaggcgatggcccagcgcggcgcgcgggcggtaaagcccaggtcgagctgctgttggaagctgtcgaccttaacgaccacgccgtcgatgtcgtagtccagatcgccgcgatgctcgagcgcctgagcgcagaactcgtggacctcagccggcgtggcgcaacgggccacgttagggttgacgctaaagccggcgttgcgcagccagtcaaggaactcgcgctggctatggacgtgcagcggatcggtatcggcgatggcgtagataaaggtggccaagtcgcggcgcgccgtaaccttgggatccttttggcgcagggatccggcagcggcgttgcgcgggttggcgaaggggtcgcggccctcggcatcggcctcatcgttcaggcgcacaaagctgcccttgggcatgtagacctcgccgcggacctcgattgtacgctcgcgatcggcacccatgtgagcgagcgccggctcggacaggtgcatgggcacgtccttgatggtacgtacgttgagcgacacgtcctcgcccgtggtgccgtcgccgcgcgtggccgcgcgcacgaaggtgccattctgataggtaagcgccacgcccaggccgtcgatcttaagctcgcaggtataggtgacgctaccggcaccgagcgcatcctcggtgcgttggagccacgcgtcgagctcgtccagatccatggcatcgtccatggaatacatgcgtgccatgtgcgtgaccggcgtaaactgttcgctcacgtagccgcccacgcgctgggtatagctgtcgggcgtcaccagatcgggatagaccgcctcgatttcctgcagctcaacgagcattttgtcgaaggcggcgtccgtaatctcgggagcatcgagcatgtagtagcggtaggcatggtagtcgagctcgtggcgcaactcggccgcgcgcgctgctgccttggcgcgggcatcggtcggtgcggtggcatccgcgcgcgcgggcgtttcggtatcgatgtccacgccgtcaccaaacaggctcgattgctccatagcggcactccttcgctcgatttcaaacggatacaagagtaccaccggtcgcaacggggccgaatagcggtctcaaaccgcaccgaatcggcagccgtcggatcggggtggacagttagttcagatacgtataaatctgcgaaccgaatcgagctcaaatggcgccatttcgctcaattcgatcgtcccggagcggcacgatcggcttatttctccttccgagcacccatccgagcctcatttccatcccaaaacagctccaaacacatcccagactgccccagatttatacgtatctgaactaactgtccaggcccttccgaacaaagctgctcgccagctcaaaatgatccgttttcctccgtccccgggggatcattatgaaaagaggggctgtcccgcgctggcggaacagccccctctggcattggtatgtgcgaaacggttcgttagtaaccctggccgtaaccctgaccctggccccgctggcccagcagctcctccagatactggcgtagttgctcgtcggtgatgctaccgttgccggtgtcggtcgcgctgtcgtcctgctgctggctctgcagctcctcgtcggagcccagctcgacggtgaccttcttctcgtccttgccgcgcacgagcgtgatctcgaccttctcgcccacctcgtggctacgcagcgcgatgatcaggccgtcggcgctcgtgatctcgtcatcgcccagcttggtaatgacatcgccctcctggataccggccttggcagcgggaccgtcctcgacaacgctcgccacatacgcaccgctatcggtgctcagcttgttggtacgggcgttgagtgcgttgacgctcgaaagcgtggcgcccaggtacggatgaaccggcgtcttgccgtcgataatctggtcggcgatattcttggcgtagttgaccggaatggcaaagccaacgcccgagctagagcccgagtagctctcgatgagcgagttgatacccacgagttcgccgttatcgttgacgagcgcgccgccggagttacccgggttgatggcggcatcggtctgaatcatgttggcatagatggtgttgccgctggtagagctcatggccgtggagcggtagagcgctgacacaatacccgtggagacggactgctcgttgccgaacggcgagccgatcgccatgacccactcacctacgttgagcttagaggagtcaccgatctcgatcggggtgagcttggaggagtcggcgtccttgagcttgatgaccgccaggtcgctcgaagcatcgttgcccacgaactcggcctcgtaggtggtgccgtcgtccatggtcaccacgtactggtcgtagccgtcgaccacgtggttattggtgaggatatggccctcggtatcgagcaccacgcccgagccgacgctacccgagctatccgactcgtcagcggactgcgaaagcgaaccactctggctgccgctcgaagtagcggtaatggaaaccacggagggcagtgccttggcagagacggcctcggccagcgtagtgtcctcggagtcgatcgtgatcttttgcgtcgacgatcccgaagcacccgccgtcacggcattcttgccgccaccgatatcgagtgtgccgctcatgataagcgcgatgaccagcagggcgccgcacgcgcagccggcgagtgccgtaatgaagatcggcagctttttggtcttggtcttgaccaccgtgtgcttgttcacgacctgctggccgcccagcggctggccggtctgcgtgtcgtaggcctgcacatagggaatgttgttgccaccggcaggcgtcgactccacctgcacgcgcggctgctgctgggtctcgccggcgttgcccgcatcctggggacgctgggaatcgtactcgctcatagctgcgatcctttcgtctaataaccaaaggcccgccaaacatgtggcgggccatcattgttcacgttgagttgtaccccaatatgcgggcgcacgtgtatgaaaacgcaatcttttaggaaggcttaagttctgttgcaaacccgaaagggacccgcacctgcggtaaaaccaccacaaaggtgcctgtcccctttgtggtggaaatctagtccttaaacaggtagcccacgccgcggacggtggtgatgtgcgccgcaatctgcgggcccaccttggagcggatacgacggatgtgcacgtcgacggtacgcgtgccgccgcaatactcaaagccccacacgcggtgcagcagcacctcgcggctgtaggcgcggttggggtgcgttgccaaaaagctcagcagcgagtactccatcagcgtcagatcgatgggctcatcgtcgagcgtcacctggtaggtagccaggttgatctcgaggttatcgatgttgagcacgtcatcggcggtgacggtctcctcctcgcccatcaggcgctgcgcacgagccttgagctcgttgggcgtcgccgtggggcatacgaagtcggcatgcgcgtgattcggcaggcgcagggtgccgagcgcctcgtcgtcgacaatcaccagcatgggaacgccgccgcgatcgtcgagccacttggcaatctgatcgatacggtcgctgcggatgccgtcggaatcgaggatcagcaggtcaaagtcgtgcgccgcagtcggcgaatcgggggtggcaaggctcacctcgacacccagggtggtcgtcaggctgcgggcaaactcgtggaagcgcgtcgtgcgcgccatgaacagggcactcttttcggacatatcggcctccaaggaaatgagctcaatcgtactggaacaagtcagcgcgattaggagttcgccaggtagtgcttgatctcccattcggtgatcgtagactcaaacttatgccactcgtcgcgcttctttttgaggaagaagctgtggatgtgctcgccgagggcatccttcataaactgcgagtcctcaaacacgtcgagcgcctctttgagcgagcgcggcagcggcgtgtagccggcctcgaccatctgacggtcggtaagcttgagcgtctcggccgtggcctcgggcgggagctccagcttgcgctcaatgccgtccagaccagccgccagcgtgacggcgttgaccagatacgggttagccatgggatcgggactgcgcagctcgatgcgcgtggacagctgcttgccgggcttgtagaccgggatgcggaccatgctcgcgcggttgcgcaggccccacgtggcgtactgcggcacggagtcgccaccggtggtgatgcgcttgtacgagttgacggtggggttggtgatggcgctgatctcgcgcgcgtgcgccaggatgccggccatgtagtgtttggcgacgtcggagagatggtacttatcgtcgtcctcgccccaaaagacgttgttgccgtcgtggtcgaacagcgattggtgcaggaacatggcgctgccgtcctcgcccgccagcggcttgggcataaaggaggcgtggcaaccgctctcgtaggcctgctgcttaatgatgagcttggccgtggtgatggcgtcggacatgctcagggcctcggcgtggcgcaggctcatgccgtgctgcgagcggccggcggcgtggaaggtgtactccacgggcacggacatcttctcgagcgtaaggaccgtgttgcggcgcaggtcgcgggcggcgtcgctcaccgaaaggtcaaagtagccaacgttgtcgagcggctcgggcgtgcgctcgtcggggaagtagtaatactccagctcggcgcccacgttgagcaggtagccggccttctcggccttgtggaacatgcggcgcagggcatcgcgcgggtcgccggcgaaaggcttgcgatcgggagtgcacacgtcgcagaacacgcgggcgacgccgttgtggctcgggcgccacggcaggatctggaaggtcgaggcatcggggaacgcgagcatgtcggcttcctcaggcgtggcaaagccctcgatggccgagccgtcaaagccaatgccctcctcaaaagcgacctcgaggtcctcgggactgatggcaaagttcttgaggcgaccgagaatgtcgacaaaccacagacgaacaaagcggatgtcacgttgctctacggagcggagtacgtaatcgatgttctgctggttcatgtcgctcccctttctttcgggcgggtttcgactgttctatatcgcagatactatcgcagaaaaatgtttccgcagggttaaagcgtgtccggcgctcaaaaaacgtgcgcgagcaggcgagtgcgggtcggtggcctagcgcgaagtggaggctcgggactcgatgtggccggggatctcgatgtgtttgggcgcgagccttgcggcttcgcctaccgtggtggtgacgatgtcgatgcgctcggataggcgctcgaccacgcgctcggcgatcgccagagtgtcctgcgcggctgtggtcacaccgccaaagagcacgtggttccagggatagtcatcgaacgtcgcgatcttaaggcctgccggcagcgaggggccaagctgggccagcgcctcggtcaggcgcaagaagaccaggccgttgacggcgataaggccgagctttttacccgcatagccgcggatggtctcgtccaggcgactgacaccctcgacaccaccgtccgccaaggtgacgacctcgccggccaggccgcggcgcgagagctcatcggcaaacgcctcggcgcgttcgcgacgcacggggctgtcgtcgcttgcctcggtgagcaggcacaggcgctcgctgcccgcagaggccaaggcgtctaccaggccggcgaccagctcacggttgttggaggtcaccagatcgacaccgccgtcggcaacatcgcggtcgagcaacacgaccggtaggcgacccgcagccgcggcgatcgccgcgtcgttgccgccgcaggtgttgacgaccaagccgtccacgcccgcatcgatgagcctggtgagcgactcgccctccttggcagggtcgttgccgctgatggccgtcataagcgagcagccgcgtgcggcggcgctggcggaaaggccctcgagcatggcgctcgagaacgggttggcgatgtcggccaggatcacgccgatgaggttggtgcgcgagctgcgcaggttgcgcgcggcggcacggggacgatagccggtgcgctcgataacctcggcgatgcgggcgcgagtctcctcggtcatctgcccagggcggttgttgagatagcgcgaaacggtggccgggctcacgcccgcctcggcagcaatgtccttgattctcatatgcgccatagcgcccctcgtttcccacttaacggcaatccttagccatttaagcattttttaaaaatctcggttgcaaaacgttgtaggtgagtatactacaagctgaaacgaaaccgatttcgtaaaccgatttcggtaagcgttggcacggaggtgcaaagatgcaccctaccgtcttggcacctccgtgccaacgccatatcaaaggtgtacgcacagacaaaaggagctacgcgaccatgggtaaaacggttcttaccttcggcgagatcatgatgaggctctcgcccaaagatcacctgcgtattgagcaggccaccgagttcgacgtccgctacggcggcgccgaggccaacaccgcgctttccctggcctatcagggcgacaaggccgcttacgtttccgtcgttccggccaaccgcctgggcgagtgcgccctgcgctcgctgaaggtctacgacgtcgacaccacgcgcgtcgtgcgtcagggcgaccgtcttggctcctatgtgtttgaggtcggtgcctcgcagcgcggcaacggctgcgtctacgaccgcaagtactccgccatcaacatggccaagcgcgacgtctttgactgggacgagatcctcaagggcatcgacgtcttctacttctctggcgtgacgcccgccgtctccgacgagatggctgccgcctgcaaggacgctctcaccgcttgccgcgccaagggcatcaccaccgtgtgcgacgttaactaccgcggcaagatgtggtcgcccgagaagtcgcaggcaaccatgaaggagctccttccgctcgtcgacatctgcatcgccaacgacgaggacgcacctgccggcctcggtatgacctgcgtctccggctcccttgcccacggcatcgaggagcgcgacacctacgtcgagatggcccgtcagatctgcgccgagtacggctgcaagaaggtcgcctcggtcgtccgcaacatctcctgcgtcgagcgctccatctggatgggcatgctctatgacgccgagagcggcgagcactggttctcccctgctcacgacgtgcacgtgctcgagggcgttgccgccggcgacgctttcaacgccggcctcgtccatgccctcatcaacgacttcgacccgcaggatgccgtcaactacgccatcgcggcctcgatcctcaagctcaccatcaagggtgattccaacctggtgaccgccgacgagatcgctgccgtggccaacgccgccgacggtggcacccgcgtcgcccgttaattcgttccccattccgcgggctgcagtttcccatacccatacctctgcagcccgctccccgatttctccggccaggtagaaccacttagtcccattccggctctgcctggcattccttcacgactggcctcgtagccggttccgaaattgcttgtgacccaagcagtgcctccgataaccaatccggaaccggctcatggccaatcttctttagcaattacgcgcactcgcgcgccgcacatcgaaaggaacatcatgttcgatcagttctacaccacgcttgagtccctgggcatcgtgccggtcgtcgtgctcgacaaggtcgaggacgccgctccgctcgctcacgccctgatggccgccggcatgaagtccgccgaggtcaccttccgcaccgcttgcgctgccgagtgcatcgccgctatggccgaggccgagcccgagatgtgcgtgggcgccggcaccgtcctgaccgtcgagcaggttgagcaggcccgtgccgccggcgctaagttcatcgtctccccgggctacaacgaggacgtcgtcaagcactgcatcgacatcgacctgcctgtgctgcccggcaccgtgaccccctccgaggtcaccgccgccgtcaacctgggcctcaaggtcaccaagttcttcccggcagccctgtacggcggcctcaacaccatcaaggccctcgccgccccgtttgtcggtcaccgctttatgcccaccggcggcgtgagcaccgctaacgtcgaggagtacctgagctcctccgccatcatcgcttgcggtggcacttggatggtcaagccggccctgttcgccgacggcgacttctccaaggtcgagcagatcgcccgcgaggccatggacgtcgtcaagaaggtccgcggctagggttagctctctatcgtgaaagggggcgtgtcctagacctcgccccctttcttttaaagcggctcggaagcgcgccgtttccgtcacgagcaagaaccaaaaccgtcttgcatgctgatagaacgtgacggaagcgacacgcccccgagccgctttgtctactcggctggcagtcgcgctcagctgagccacctcgacaaaagccagtccaccaaaacagctgcggcgccgtctggaggaatggacccttgcttccggtcttttcctccaagcggcgccgcagcttttcatgccccgattgcacccccgcacttgcggtgaaatacggactgtttacgccaccagagccgcaaaacagtccgtatttcaccgcaactaagtaagggaacgagttagattgccgagtctttggacagctcaaagtagtcgggatgcaaggcgataaccgggccctgctcctcgggcattagatgcaggtgcgtctctgccaggtagctcgccgtgtcggtatcgcccttcttaatggcctcaagaatccggcgatgttgcccacggatcggctcccagtccagatcctgcgacaccatacgcaaccagttgtatcgctcgaaatgcgtgttgacgctcttcatccaatcccacaacatgtggcggccggcaatctcaaaacatgtctcatgaaacaggttgtccaggtcaaaaaagcgacgcgtttcgctgtggtcgagcgactcggactcggcaagaatctgctcgagccgatgcttttgctcgggcgtggcggcagagcagcatttaatgagcacacttctctcgagtttctcgcgcaagaaacaggcgttctcggcgcgctccatgctgatttttgagacataggtgccgcttttgggacgcgtttccaccagctcttgctcgcgcaggcgcacaaaggactcgcgaatgggcgtgcgcccgattcccgtctccttttccagaccaatcgccgaaaggcgcgtgccgggcttgagctcggcatagatgatcttggagcgcaatgcgttgtatgcctgatcttgcaggctctgataatgctggtgctgttccataaagccctcgaatgaagcccacggtttgtcgaatctcatcacgtaatactatcgcatcccccatccccacagttgcggtgaaatagttcctgctcgcagccttcagcagcaaaaccaggcagtctttttgggacggggctcttttagctaccctggccctcagatcggcccccttgccacaaaaggggccgatctactacgttaacgcggatagccccgaccatgccgaaaaatgagaaaacaaaaccgacgctcctataagttgtcaagaggcagtttgcgggagcgctcccttcaattcgcacaggagctcgtaatacctcctctccagtttcgtcgaccgccgtttcccccgctccaagtgcccgagtgtggctgcggacaggccgagctccgcggcggcctgcttctgagtcacccgcatcgccttgcgcatcttcgcgagctcgggcccttccggcgcggcgccgtcggggttcgggtccatgagcacgcggtacacctcccgcgctatgtagcgcttcaggcagcggaccgcctcccgccgggacttcccctcggaggtccgcctcgccacgtacctcctcgtcctctcgtcgtacgccatgcgcttgatcgcgatctcgtagagcgcccagttcgcctgccggttgccgccgcggttgagcctgtgccgttccgtcttcccgctcgacgcggggatcggggagacgccgcacagcatcgagaacgccgcctcgcccttcagcctgccggggttgtcgccggcggccacgaccagggcggcggcggtcgtcgtgccgcagccctcgacgccgagcagcgcgggcgcgttcgcctccagcagcgcgcggatgcgctcgtcgaggaactcgacctggctgcgggcctccttccagaccgtcgcgacggaccgcagcgaggccagcacgctctcctcgagcgcgctggccgccttcctcccgcgcgcgagcagcggcatgaggtccttcggccgctcgcggcccctgaaccgctccctcagggcgctcggggccgtcgtgagcatcgacttcgcgcaggccacgcaggacgtggacgtcgcgacggccagcctgcgcgcgacgtagagctggcgcaccgcctcgacccagccgtcctgcgacttcggcacggagcagcccctcccggacgccgccttgcgcgccgcgcgctcggcgtccagcgggtcgctcttcccctcgccgggcctcaccttgtccctcttgggcctgagcacctcgaccacgttgtacccgagctccacgagcctcctcgtcagcccggccccgtacgacgccgtgccctcgacgccgacgaccacgcagctccccgggtcgcctatcgcctccgccagcctgtcgtagccctcggggtcggccccgaagctcccgctccggatcttcctcccgaggccgtcgagcaggcacaggacatgcacgtccttgtgcgtgtcgacgcccgcgatgaccgtttcgccttccattttcgctcccctcggtctgccgcctgctccgcgcccgggtctcccagacattgcactgacgggagcgctacaatccaattggcttgtccgattgtccgcgctcatgctcctattaggtcatggcaggactccgggacgcggatgccggggcgagacaggtcggatttgaggacggccgaagaggcgtcagcaggtcagtgggtcatcgtcccggcattcagcatcagggtagcgctgcgacgcggaaatcgcgcgccgttgccgcgccccgcagtgcccgcttcccccgagaacaattatcagtgccgcgccccgcagtgcccgcttcccccgagaacaattatcagtgcaggtagacggcttgccgattttcaaaaaagccggctatggttgacccctacggcttaaacgtagtagatagcccattttcgtggcacagcactattccatcccaaattggcgccccgggccaactataatttgcggtgaaatagggactgatggcgccgctggagccgcttaacagtccgtatttcaccgcaacttatgagggactaagggttttacaagttggcgatgattgcctgggcgacctcgtcgtactgagccggctcgagcgtgacgcgaccgggattcatggcgaacacatcgccaaactcaaacgggtcatccttgtacttggggacgatatgcacatgcaggtgatgcatggtgtcgccataagcaccaaagttgatcttgtcggggttgaacgccttgtgcagcgcggcggcgacgtggcggacatcggccataaaggcggcggcgtcctcctcggacatgcaggagatgtcgtcgacgtgctgcttggaggccacgattacgcgacccttgtggctctgctccttaaacaagatgagcttgctggcgggcaggtcgagcatggggacgccaaaggcatcgacgagcgtgttgtcggtcccgcacatgcagtacgagcaatcggtgtgctgttccatggtggtcctttcgatccgggtgaaagcgttcgccgcaatgcgaccgacgggcgcaaccaagctggccggcagtccacgacgaacacacgatgcgctctccaaccgttgcgaaatcggtttcgagtatgtccttgccatgataccgccaacgagttgttgcaattaggtgaacgttcacctttttattatttttctctttgcaaaaggaatcccatgcgtatactaaggctcaaacgaaaccgatttcgttaagcatgggcaataggatgctaagacgcaccctaccatcttggcatcctattgcccacgtcctgtcattcacttttctcccgtctcgttggccctttagtcccattccggcacagcgagacactttctagacgactgaccgtggggccggcttttctgcttttacagcagtgcctccgataaccctcttttgccggcccaggtcagcccaattccttacaaccgaaaggacggcagcaacatgcgaccgctcatcatcatgaatggcgagaagatcgactggtgccataccgtcatcagaatgctgatgtatttagcaggtgtcgcgacgctcgccctcggcatgagcatccagaccgcatcgggcctgggcgttgccgcacttacctgttttgccacgacgctgtccatgctcaccggcaagacactcggcttttggatcaccgcgacctacgtcgcatacatcgccgcacaggcagccatcttgcgccgcgagttccagccgcgcattttgctcgagctctttttctcaacactgatcggtggctttaccgacttctttatggacgtcaaccctctgcaccccaccgcgttgccggcacaggttgcgaccatgctgctctcgcttgccatcactgcgtctggtgtaagcctcgtcgtcaacatgggagtcgttcccaacgcgcccgacggtctggtgcaggtcattgccgaaaaactcaaacgccgctttggcgatgtgaaggtcgtattcgattgctcgcatgtcgccgcctcgctcgcactgtcgctggtttttatgcacaacctgggcggctttggcgtcacgaccgccatctcggcattattcctgggccatgtcatcaacatcgccaacaagctgttcgcccagcgctttatccgcgcggcattcggaaaatagcaccaccgcaagaacccgcgagcagcgctatacgttgctatatctcactatacgttgctatatcttgctatactttgctataacttgctatatcttgagcaaaggtggctcacatgcaaacaaacccttttaagcccacggcaggcaaaacacctcccacgattatcggccgcgaagatgtactcgaggaattcaatgaaggcctcgtcaacgggcctggtgccccggggcgccttatgcgcatagccggcgtccgcggaacgggcaagacagtcctccttgacgagtgctcacgtttggcgcaaagccatggttggacggtcataagagaggtcgcaactgaggggctttgccagcgcattctcgaacagctgcagcccaaattccaggccaaacacgccagatttgagcccaccgtagctggcatatccatcggcagcatagacattgagcgaatcggtccatcgctgcgcgacgccatgaggcaggctatatccaaggatggaaatggcctgctcatcaccctcgacgaggttcaagacgcagagctcgaagaggtccgaacactctccattgcgattcagcaggttatcggcgaagaccttgatatcgcctttgtttttgcggggctgccttcgatgatcgaaagtgtcatcaacggaaagacacttacgtttttgcgccgcgccctcccctttgacctgaaggctgtggcagtaaccgaagtgtcgtactccctcgaggaaaccattgaagcgtctggcatggagctacagccaggtattgccgggcagcttgccgaggcaacgcagggctatcctttcatgatccaactcgttggatattacgcatggcagctggcaagacgcgcccatacaactgttattggagaggaagaggcaaggcgaggcatcgcaacagcgcgcgaacgcttctgcgccatggtgattgagcccgcgctgcagcgcattccacccacgtgcatcgcttatctgctgagcatggcatctttggggcagacgagctcgaccagcatggttgccgatgacttaaacaagacgcctcagcaggtgagctccgtccgtagccgactgctcagagagtcgattatcgaggcaccttcgtacggcaagatatcgtttgccatcccctacatgcgcgactacctcaacgaacacaaagccgaactggaagttgaactgtagaagcggcaaccgccctgcaagacgaaaaccgtttgcgtacggtttttaaccagacgcaaacggttttcgtcttatttgcgtacggaaatgagacgcaaatttcgatttcgtctgattattcgccagacgtaacacactttcgtccggcaatacgtccgcaatccagacgaaaagagccccgagctcgtatgaactcggggctctttgtgctacgcatctatgagaggagaaattcgatgcgtacgggcgctactccatgtagccaccctgaatggcggaaactgcatgctcggtaaagaacttgagcgtgccggaggtatagcggttagccttgggcttccaagcggcgcggcgctcggccaggacggcatcgacctcggccggctccatctccttgccggcgatgcccacaacggacagcgagcgctcgggaatgttgaactggataaggtcgccctcctcgatcagggcaatcggaccacccacggcgctacaaccgcaacatgatcacggaaggcgcacagacgaaaagcaaataactggcatcgcaacaaccaatttcaaccgttcgccttttaaaagtgaacgttcacctatttttaaggaaataggggcgttagttcctccgcttctcctatactgagcttgtatcagaagcaagacttatatagatgaacgtttcttttgaaaggatcgctatgtctgatcttatggacagcttccgcctggatggcaaggtcgcactcgtgaccggcgccacctatggcattggcatggccattgccgaggcgctcggcgaggccggcgccaagatcgcctttaacgcacgtcacgccgacaaggtcgccgaggccgagaagcactatcgcgagctgggctttgaagctcacggctacgtggccgatgttaccgacgaggccgttgtcgccgagcttgtcgccaagatcgaggccgactttggcaccacgcccgatatcctggtcaacaacgccggcgttatccagcgcacccccatgctcgacatgagtgccgaggacttccgtcgcgtcgtcgacatcgaccttaacgccccgttcatcgtctccaaggcctgcctgcccggcatgatcgctaagggtcacggcaagatcatcaacatctgctcgatgatgagcgagcttggccgcgagaccatcgccggctacgccgccgccaagggcggtctgaagatgctcaccaagaacatctgctccgagtttggcgaggccaacatccagtgcaacggcattgggcctggttatatcgccacgccgcagaccgcaccgctgcgcgagacgcaacccgatggcagccgtcacccgtttgaccagttcatcatcgccaagaccccggccgcccgttggggcacgcccgaggacctgaaaggccccgccgtgttcctggcctccgacgcttccaacttcgtcaacggccacatcctctacgtcgacggcggcattctcgcctacattggaaagcagccccagtaggctgcggccgcgtgagccacgccatctcgctcaccgcgctcccacatttaggttcatttagtagttgcggtgaaatagttcctgtataggccatctatcaggatgaataggaactatttcaccgcaggttagaaataggaaggtatttcgcaatgaagatcgctctcatcaacgagaactctcagaactccaagaaccccatgatcgaggctgcccttaagaaggtcgtcgagcccatgggccacaccgtctttaactacggtatgtatgccgacgccgactccaagccgctcacctacgttcagaacggcatccttgccgccgtgctgctcaactccggcgctgccgactacgtcgtgaccggctgtggcaccggcgagggcgccatgctcgcctgtaactccttccctggcgtgctttgcggccatgtcgccgatcctctggatgcctacacctttgcccaggtcaacgacggcaacgccgtcgccatgcccttcgccctcaagaacggctggggccaggagctcaacctcgagtacaccttcgagaagctcttcggctttggttcgggcaacggctacccggctgagcgcgtcgagcccgagcagcgcaacaagaagattctcgacggcgtccgcgctgtgaccatgcgtccgctcgtcgacgtcctgggcaagatcgaccaggacctggtcaagggcgccctggctggtgagcacttccaggagtacttcttcgccaacgccaccgacgaggccatcatcgccaaggtcaaggagctcctgggtctctaatcgcgacccatcgcatctaacgcaagcggcggccgccccaaacacgggacggccgccgctttttgctatcgactggtgcaatggggtcaggtttgcatgcaccaaaaccgcaagggcagcccgtttaagattcctcgataatctgccggcatgccgctgcaagagtgggaaactctgatgtcaccgcgtcccaaaccacggcgcgatcgacgttgccgtaatcatgggcaagatagttacgcatcccgatgataccgcgccactcaatctcgggatgcagtcgctgcgccttctcggacagcttacccgcctcctccgtcaccctaagggcacacataaggagagaatcggcgagcgtcctggccttgatgtcatccgcatggaggaactcgtcttccgtcacaccgaacgctttgattctctcggtcgtctcatcaatcgcctcgagaatctcctgagcgcgcaacgcatctgatttacgggcgaacatacagcaccacgccctccctctcgatagcctgcgcaatatcttctcgcaagtgttcgctcgaaacgacgtcgacctgcttgcctgtggcctctttgatctcatccgcgaacgaagaaagagcgaataacccaaatgtcacatcgggatcgacctctatacgcaggtcgatatcactatcggcatttgcgtcacgccgggcatacgagccgaacaacgtgaccgaccgaatcgcctttcgagtacccgccgcgcgaataacggcatccttgatttcgccaacggtcaaaacgtcggtcttacccccgcccctttcgactgaaagagaaggggtgaatggaagcgaccgctcccgcagcatctgtcgcatgaacatgttgaccgccacggaagacgtcatgccgagctcctcgcagagctcggcaaacgattccttaattgatgcatcaacacggacgctcaaaactgaagcactcatcttagcctcctgtatgacagtagctatacaatatcatacagagaagcaagatgactggtgcaaaggggtcaggtttgtatgcaccagattggtgcaaagtaacctgacccccatgcaccaaggggttgactagagttcgcaggcaaccttgtagccatcgccgatggcatcgcggatgttgccgcacttgttggcatcgcccagcacgtgggtggcaacgccggcagcggcaaggtcgtcggccagcttggtattgggacgataacccatggcaagcaccagcgtatcggcaccggtgatggtgtggacctcgccgtccttctcgtagctgatagtatcctcggtgatctcggtcaccttggcctcggtcagcacgtgaacgcccttggagagcatgcgcgtgatgagcaccgcgcggccggcgccgccctcgttggcggcaagggtcttggtcatctcgatgacggtgacgtcgcggttggccggcgacaggtcgttgaccagcggagccagatagtcggccgtctcgcagccgacggtgccgccgcccacaatgacgatcttcttgcccgggaaggcattgccgcccagcaggtcgtcagccgtcatgacctgcttaaagccctgcataaaggccggagcgataggctcggcgccataggccaggacaacctcgtacccggcgtagtcgcgctgaatgtcctcggccgaaagctcggtaccaaagacgcacttcacgccggcctcggccagacgacgatactggtacttaatcacgcgggtgagctcctgctttgccggcgggacggccgcgatgcgcatctcaccacccggctcgtcctgcttgtccacgagcaccacgttgtgtccgcgcttggcggcaatgaatgccgcctccatgccagcgggaccggcgcccacaacgagcacgttcttggcctcggcggtaggctcgtaaccggcctcgtcgcgctcgacatcggggttaacggtgcaggagatgcgcttgccaaacatgatgccgttcaggcagcgcaggcagccgatgcaggggcgaatctcgtcggcgttgccggcagccgccttgttgcagaactcggcatcgcacaggttggcgcgacccatcatgcagatgtcggcggcaccgtcctcgatcagctcctcggcaatccatgcctcgttaatgcggccgaccgtggcgacgggaatgttcacgtgctttttgatctcacgcgagcaggcggcgtgcgaggcctgctgggtaccggcggcgggaatcgcggagccgcgcttgatggtggtgccgcccgacacgtggatcatgtcgacgccggccttctccaagcgacgcgagacgtagatcatgtcgttgagggtcaggccgccgtcggtgtactcgtcgcccgagatgcggacgtcgatgatgaagtccttgccgcagcgctcgcgaatctcggcgatgacctcgagcaggaaacgcatgcgagcatcgagcgaaccgccgtactcgtcggtacgcttgttgtagagcggggtcaagaagccaccgagcatgccgtgggcgtgggcagcatggacctcgacgccatcgacgccggccttctgcatacgcacggcagcgtcgccaaactggtgcgtgagctcatggatctcatcaaccgtaatggggcgcggtgcctcgcgggcataggacgggcccacgaaggacggggcgatcaggcgcggcgtgcccgggatattaaaggccatgtaggcggggtggaagagctgcggcatgatcttgcagccgtactcgtgcacggcggcggcgagcttttcccaaccgggaatgaacgtgtcgtcatagcagcacatgtcgcccggcaggtaggtataggtgggctcgaccgtcacgacctcggtaatgatgaggcccacgccgcccttggcgcgagcgcggtagtggtcgaccaggtcgtcggtcacatagccatggtcggccaggttagtggataccggcggcataaagacacggttcttaacctcggtcgtaccaaccttgatggggctaaagagcatcggataggcggaggactccatgcaggcttcctttcgtttgggccgcgcaaggcggcatttgctaactcacctatcgtatcagcatccgcccggcgcacggccgcacgcactcccccggctttcgctcgacgcacaaaaagttgcggtggaatacggagcaattgaggcttttgacagcaaaaacagtccgtatttcaccgcaaccaataagggtgggatgggttagaggcccaggtaggatgtcatgccttcgacggcgagtttggcgccggccacggcatggaccacggtaagcgggccgttgaccacgtcgccggcggcaaagacgcccggcacagtggtcatgccgtgctcatcgaccgaaagcaggccgcgatggtcggtctccaggccgcccgtcgtaagcacgagcttgtccttgggcacctgcgaggccgcgatgacgatggtatcggccgcggcatggtcgagctcttcctcgtagcccaccacgttgttgtcctcgtcaaagatagccgtctcgaacacggggccgttatcgtcgatagcgcagatggccttgccgcacacgatctcggcaccgtcgagctcggtcagctcgacctcgtcgtcaattgccgagatgtggcgtgagcgggcatacacggtaaccttacgagcgcccgagcgcagtgcggtacgggcaacatccatagcgacgttaccggcgccgataaccgccacgttctgtccgatcgccacacttgtggggtcgaccagatagtcgatgccaaacagcacgttgccgcgcgactcaccgggaatccccagcttgcgagcacgccaagtgccggtacccacaaagaccgcgtcataaccgtcgcgcagtagatcgtcgatatgcagtgcgccgccgatagtcgtcgaggggcgcacgcgcacgccgagcgagcacatcacgtggcggtacttttgcaccagcgaacgcggcagtcggaactcggggatgccgtactccagcacgccgccgatctcggggcgctgctcaaacacggtgaccgcgcagcccagctgggccatcttgatggccacggtaataccggcaggacccgagccgaccacggcgacctgtttgccgcacgacggcgcaggcttccactccttgcgatcgaggtaggccgtggagatatagttctcgatgctcgagaaatgcaccggcgtacccttgcggccttgaacgcacgaaccctcgcactggcccgaatggttgcacaccatggagcagaccgcgctcatcgggttgttctggaacagcagctcgcccgcttcctccagacgacgctgcttaaacagatcgatgacctgcggaatgggcgtctgcaccgggcagcccttgatctggcagaacgcctttttacaacccagacaacgatttgcttcctcgacaatgtggatagccacgcgattcccctctgatttgcatcaacacaatagcgggcagttccagatgctgcccagtaccgtctagccgtccgcccgtagcgaccgtcggccacgctacatctcccgatgcgcgccttcgcaacgggcagacatacgctcgagcgtcgtcagacaaccagctgctgtcgccggcacgctattctcgaccacacacggaatgcccgggcaggcagcggcagcccaggcaacgacaggctcaaagtcgtaacgacccgtctcgcccacgccgtggcacaccagacgcgagcccgtgccatcgcaccagccagcctcatcctcgttatccacgacctcgtagtccttggcatgtagcacgcgaaccttgctgccgcacagatagagcatgtccgatgtaatctcctgtgcctcgccgacaacgctcggatgcagcagcgacaccgggtcgtaaatcacgccgagtgccgagctcggcacgcgctcaagcacctcgcggcaacgctggggcgtgttgaccgtctcgttccagccgggctcaatcaaaatctgaccgcccgttgcctcggcacgaccacagacatacttgagaccctcaacaaacgcatcgagcgcctcgtcggtcatgcgatcgtccgccacgttattctgcacgttggggcgaccggtctcggtgcccaccgggcagccgccgagcatcttggcaaagttcaggcatgcctcgtactcggcaaagttatccatgagctgttgacgatcgggggtcgccaggtttttatagcagccgaacacggcgaccgaaacgtctgcctcgtcgagcacctcgcacaggtggtcggcgagctcgcgggtcagaccgcatcgatcgattcccattgatgcgtagagcaccttgctcggcagctgaatgcacgaaaagcccagctctcctgccatgcgaatgcgttcctcgacggtcccctgcggaaggtcgtgtaaacgcacgcccggagtaatggcccccacgctattcacgccccttatgagcattgatgcccggggtgtatccgccaaacgggtcgtcgatggagcacacgcccgaaggggcaagcggatcgcgcttaccggcaagcttgtcatgatgcatggtctcgatataggcaagcaccagcggcgccacgcccttcgcgtcgtttttgacaacgggctcgctcatgtagtagccaaacgtgccctcgcggtgcgtggtgttgccaaggcccgccaccaggcagatgttgtcgagcgccagctgtccgtcgcgctcggacaggcacgtgtcgcagatgccgtcaaacgcacggcggccgtactggtagtaacgctcgcccagcacgcccagacgcacacccttcatgatggcattggcaaaaatcgcgctgcccgactcctccagatagttgggggcgatattgggcaggttgatgacctggtgccacatgccggtcttctcatcctgatacggcagcatagcgtcaatcaggtcgtggaacatcttgcgaatctcgtccttttccgccgacatcgagggcggcatgagctcccaggtatcgatgagcgccatggcaaaccagccctcggcgcgcaaccagaagttggccgaaaggccggtgacgggatcgcaccaaaactgcttgcggctcgcgtcgtaagcgtgatagtacagaccgttgagggggttgcgcatcaggtcgtgcaccacttggaacatatggaagctatccgagcaggcacggcggttgtggaagctcagctcgtactgcatgtagaacggctgcgccatgtacatgccgtcgagccagatctggttgggatagacggccttgtgccaaaacacaccctctttggtacgcggctgggtctcgagctggcgatagatcgtgtccatggcggcacggtacttgggcttgcccaccaggtcatagagtttgtagagggttttgcccgcgttgacgttgtcgaggttgtactcctcggggttgtaatgcttgatggtgccgtcatcctggacaaagaagtcgatatagtcgtcggcgaaggtcaggtaacgctgctcgccggtgatctcgtacagctcgatgagtgccttgatcatgcagccgtcaatgtaattccaggtgttctccttgccggcgcgaagcttttcgatattccaggccggcgcctgcggcgtcgatgtctcgatcaactgctcgatgtagctatccagaatctgattgcaacccattgctgtcccctctgacgttggtgatgggtgaacgtttcccctagtgtaacgcgaacggggattatagggtgaacgttaaccctataatccccgtgaacggcaaacttttaacggcaaacggcggtgaggcccgcagcgatgcgatgcgccaggcgctcatagccggcagggctgtaatgcagaccgtccggcatgtagagctcgcggtgctccggcaaaaacgggctgatgccgctttgcgcatacaggtcgatcaccggcaccgagtagcgatcgcagacctccagcatcgcgcgcacataggcgtcttgcgtcaggcccagatggttggcctcgttgcttgccggaatatccttctcgtgtttgccgctcgtcttgcacggcgtcataaacatcagctttgcctgaggcgagcgcgccgtgatggtgcggatcaggtagtcgagcgcaccgtagaactcgtgcacgtccgtgctgcccagctctcccagcggcacgttacggctaaagtcgttaacgccgccaaagacgatgcagatatctgccgtgtgatcgatgccgtccaagcgctcaacaaacgaatcgctacggtcggccttgacggcaatacgcgaacccttaataccaaagttctcgatcgtagcgccgcccagcagcgcacccaggtgcgaggtccaagagatgtcgttgcctcccccgccgcatccgttatcgccccaggtggtcgaatcgccaaagcagcagacggtcgattcgctcaagtttttcgtttccatattcttctcctcacccgcacaccggcggtcatacaggtacataccgttcattcacaacataccgagggactatgcgtgggcgtattccgcaacttgcgaatcgagccattcgatatcctcggcaagatgcgccacgcccaggtggtgtccacccgggcagacctcgtgcagaaggttttcgtccttgcccagcagcgcgtaggcgtcgcgaacgatatcgagctgctcgtctacgttcgcaagcccgcgggcgccgttgagatggtctttctcgcagctctgaaccaagagcggccgtggcgcgacaagcgatgcaatgtcgcccatgtcgagcagacgccagagtccaggcgtgtaattgcagctgcaattgccgttgaggtgcagtagcgaatcatcaacgccgtacagatagcccgagacaaacgccttgcgcacgcgcgggtcgagcgcggacaggtacaacgtcatgtaaccgccgcccgaaaaaccaaagcagcccaggtcgtccatggcaatgtcaccgcgtgtctccaagtaatcaatcaagcgcatgttgtcccatgcgttgaggcccgcgaccgtaagacccagcggctcggccatacgtgcttgattcagacacgtaccgcgcaggtagctgttctcgtcgtcgccctgacccttccagtcacgacggtatccccaaccacgcgcatcggggcagacggtcacataacccatgcgcgccaaacgcagaccgtagtcgtaattgaacttacgcacggcatcgtcgaccgccggcacgcccgcaacgccggctatgcttgcagcacccgccccctggtgaccatgcgggcagatatagcagcgcttgagtccccgctcgtcaagcttggggcgggacggctccaacaggtaaaacggcatccacacatcgtgctcaacctgcagcaccgcatgagtacgcacgatgctgccggcaacccgcacgcgattgagctcacgaatctcaatcggggcgcggtccataagcgaaagacccaaaatatcgtacagacgagtcctggtcgcagccttccatgcctcaaagtctgtgggagtcttgcccgtaaatgcggccgagcgcccctcgcgcttcagtcgggcgcgcagcgcaggttcgtcctcgtagtacgtctcgatgtgcacggtgcggccattggcagatagcccggccgtctctaccgcatcaccgtcgccgccctcgggatcccaaccatccgtgccggcaagcactcggtcacgcgcatagcgttcggaatcctgaccggtcaggcaatgcgcccacggcacccaagcggcagtatcacccgccgggccaaacagggcaccgccggcatacagggtgccgtcatgtgccgctggcttattccaatcccaccaaccctcgagtgaaatatgggggcccagccagcattcgagcaaaacggtctgggcccactcgcgccatggacgacccagatagaccgatccgggggcaatgccctcatcggctgtaaacgaacagccatgaaacacaaatccgtacggctcgccctggggcgtggaggctgccgttacatacccgttgacatccatatcgcggttgagcgagcgaatctcacacccctcaaagtaggcacgcgcgccgccaaagataaagtcgacatcgccctcgatccggcaacgtcgaaaatactgccgccccacgcggcgcggggcgaactgcttggggcctataaagccgcccggcttggtctcgcgcggcggcagcggccccaaaaagagcgtgtcctggtgtcccttaatgcagcaggcatcgacaaccaggcggtcaccatcggcatacagggcaatcgcctggccgacctcgcgcccatcaccggcgttgttttcgattgttagacccgcaagcgtcacgtcgtcggcatcgaccagcaccgtgtacgtacggaaggtgccgagtcttccatcctggccgctaccatcttccgaaggcatcttggcacccaggcctcccacgatacgcacgctgtcggccgtctcgccctcgagcgtcacatgcggacgacgaatttcgacctgctcgcgatactcgcccggctccaccagcacacgcaccggcacggtcgtatcggacacgcaccgctccgccgcctcgagcgccgccgaaatgctgcgatacgcgccttcgcgttcgagcgatacctcaaagagctgctctttaccactcatctgtcattacgctttctgtcacagaacacccaccatgcaatgccggcacctatagattgcgtgcgacagccgggcagacccgaccgtcgcacgcctcaacatgccgtattcacttgtgcaggagcactaccctacgcgcggataaccttgtcgacgttttgcagctgcagctcgtcgccatcctgaccctcgatgcgcacgttctgcaggtcgaggactttcacgttctgcgcgatgatgccctggcgcaccatgggctccacgccgcaggccatggccggcacaaagggctcggcatcggcggcaaaggtcacatggacatcctggaacgtcagacgcgtcaccttgctctcgggcaggcccgtaatgtaggccgcagcggcatggcagttggtggcctcgatatcgcagaacgtcgtggcgccaaagccgggcgtgcggtcgtcgacgggcagtgcctcgcggttctggacgtaatcggtcttgccgtccttgtcgcagaagtagaacgagttgaccacgaagggcgtaagcaccttgtccatgcgaatgtgctcgaaggtgatgccctcgttgacggcgtccttaccgcgaccgcgacgggtcttgacgcgcagaccgcggtcggtgcgctcgaacaggcacttgctcacggtgaggtccttgatgccgccggccgcctcggaacccaagaccacggcgccgtggccatcgtgcatgtagcagtgcgagatcagcacgtcgtgcgttgcggggcggagctcgggctcaatacccagcttgccgctcttgatggcgatgcagtcgtcgcccaccgagaactggcagcccaggatacggacaaagccgcagctctcggggtcgaagccatcggtgttgtgggagttcttgggaccctcgatggacaggcagagcgcatcgacgtgctcgcacaggatggggtggatgttccatgccgggctgttgcggacggtaaagccgaccagactcacgttctcgcactcggacaggaagatcatgcgcggacgggcgacctcgcggccctcctcgggacggaagatgttcttaaagtccttgttccaccagttgtcctcagcaaaatcggtctggccatcgatcgcgccgcggccatagatgcacacgtcgtgcacgcttaagccggtaaaggtggagcaataggtcgagaagctctcgccctcccagcggcccagcggggtcatgtcggtaccggcgtaaccggcaccctcgtcgcccttgaccgtaccggggatgtaggcaagcgccgcgcggtcgtgacgggccagcagcacggcaccctcggcaagctcgatgttgatattgctcttgaggaagagcgacttgatgcggtagttgccggcggggatcagcacgcggccacccttggggcaggccatgatggcagcctggatgttggtggtgtcgtcgtgctcggcatcgcccttggcgccgcagtcgcgaacgttaatggtgaaaggctctgccggcgtagtgacgcccacgctcagctcgcgctcgctgcaaacaaagcggatcaggttgcgcttgccgggaaccagaccgtcgacataggtctcgaccgtgttcgtggtgccggcgggctcgtcgttgacaaagatctcccacgtatcggcgcaagtaaagtagccgccgtcgtcgagctcgatcacggccgcgcgggcgttgcgccagataacgttcgtctccatgggtttctccctcaaaaagattctctaaaagttaattgtacgctgttgtaaaaaagggccgtacctgccggcggatatccggtggcacggccctgtgatgtggacgatgcgcttgccttactcggcgggcgtcacgctgccgtcctggaagccaacgttattgtgagcgaagcagtcctcatacttgaagccggagagctcctcgcagagcgccttgacctcgggctggacgtcggccatcttgccgccctccttgacgcgcttgatctcgtcgcagaggatgtcgcactgctccttgtcgatcttgatgccgcgggcaaggacagccgcgagcaggaagaagccggcgcagccgatgagcatgtagccgcagatgtacagaggcacggtagcgggctgggtcacagcgtcgctgttgccggcggtctgaatgaagccggaggcagcgaggacgatagcccatgcgttgacggcgacagcctgggcgatctgctggcagagctgctgagcggagctgtagattccctcgcgacgacgcagggtgatgagctcatcgacatcggggatgtagttgagcagaacatcgggcagatactggaagccaacgtagaagaacttccagatggcgaagatgatggggtaggcgatcatggcaatggcgaccgtagaggtgccgttgatctgaccaaaggcgaagtagttgtacgcaatgatgcacgcagcgcaaccgacgttggccaggtaccaagacttgtggaagcccttcttggccatgagggcaacccagatagcggtgcagacgatagcgacgaccttgccgggcatctccatcacggactcgtaggacttaggaatctgcaggcagtagacgatgaagaaggacaggcaggcagaccagcaggcagcagcgagcttcgtggagacctgtgcgtacagaaccttacggaaggacttgttgcggaaggtggaaacaacgtcgatgaagaacttcttgatgccctcgccgacgctctcgatcttctcctgggcaacctcctcgggggtgtgctcccaagtggacaggtacacgcagagcagcgagattgccatgaccgaagcgttaatcgtagcgatgatgaagtagctgaacgggttggtctcgccgaaagtaccaaagccgaagccgacgagtgcagccatcaggaagccggcagcgttaccaaagaggtgcttgtagccggtgaggtacgtacgctccttgaagtcgtcggtcatctcgatggtcagcggcgacaggttggcggtgcagaacgtgtacgcgacgttgtagatcaggtacagcgcgaagtagtacgggaagccaaacggcgtagccacgaagatgagcggctcggcgaccatcatcgggatagccagcagaatccagaaacggcgacgaccgaagatacggccgaccttggtggcgtagaagttatcggccacgaagcccatcagcgggcaaaggatggcgttgaggtaaatggcgaacgagctgatcagagcagcctcgcctgcggacaggccacactccgtggacaggaacagcaccatgtagctgtgcgtaaagctcagggcaccggagttgagcatgccgcccataccaaagcccaggcgcgtccagaatgtgatcttgcgctttttaccgatcttgttagtcatcgagctccctctcttttctcgattgtcttgtaacaagacattggagtccataccgatgtctgtctgcatatcgcccactcgtagggtgaacgtttagctagattatgcgcgattgcatatgataggtgaacgttcacttgtatattatccttgaacggtcgttttttgccgttaaacggatatctgacttgaaaaaaatcacgattacataggtattgagtgggtttaaatttgaggtcgattaggtgaacgtttattgttttcgccgctcccgtaccctcaggaagacacgcccgaacagacagaacaaacatggccccgccgggaacactcccgacggggccatggtcaatagcgccctatgcgaacccatttaccgctacaggcagacgccatccttccaaatgctgatctcgtggcagccgcgacgctcggcactcgtaagcttgccgctcgccgtgtccagcaccatctgatacaggtcgtcggcagcctcatcgagcgtgcgctcgcccgtagccaccacgccggcgttaaagtccatccagttggccttgtggtcgcacagacgctggttggtgaacaccttgagtgtaggcgccggtgcgccaaacggcgtgccgcggccggtcgagaacaggattacgtggcagccggcagccgtcagggccgtggtggataccatgtcgttgcccggaccgcacagcatgttcaggccatgcttggtagcctgaccggcatacggcagcacgtcgacgatgggggcagatccgcccttttgcacgcagccgcagctcttgtcctcgagcgtggtaatgccgccgtccttgttgccggggctcgggttctcatagacgacctcgccgtggctgataaagtagtccttaaagccgttgagcatgtcggaggcggcattgaagacgtcctggctctcacagcgatcgagcagaatgctctccgcgccaaacatctcgggaacctcggtgagcaccgacgtgccgccgcgggcgacaaccatatcgctcacgcgaccgatcgtggggttggcggtaatgcccgaaagaccgtcagagccgccgcacttaaggccaatgaccagctcggaggcaggaatgggctcacgcttggcctgcttggccaggtcggcaagctcggacaggatcttgtgaccctcgacctgctcgtcggctacatcctggcaggcgaggaatcgaacgcgctcgcgatcaaagtcaccgagctcgtcgagtacctgctggtgcgtgcagttttcgcaaccgagggacaggaacagcacacccgcagcgtttgcgtgacgcgagagcgccaccagcagacggcgcgtctgggcatggtcggcaccggtctgcgagcagccaaagggatgcgggaagtagtaaacgccctccagcgagccctcgaccagatcctgagcctgctcgcacatggcacgtgcgacctcgttgacgcagccgaccgtggggatgatccacagctcgttgcgcgtggcggcgcggccatcggcgcgacggaagcccataaaggtctcgggctcaaccggctcaacgaccggatgcgtcgggttgtaagcgtactcgacctcgcccgaaaggttggtcttgacgttatgcgtatgaagccactgaccgggctggatgtcgcccgtcacgtgaccgataggaagaccgtacttgacgacgtcctcccccgccgcaatggcacgcacggccatcttgtggccctgcggaatatcctccgcggcaacgacctcgcccaccccgggaaccgcgacggcggtgcccttggcaagcggcgacagcgcgacgatcacgttgtcggccggattgatctggatagtattcattacaaagagtcctaaccctacaggttgagcagaagtcagcgggcgcccgccagttgcccggcgggcgcacagaaggatttaggcctgggcgttggcaaatgcctgcttggcgccctcggcgcgcacaacggcaagcgcgttgacgacaaactcctcaaggccggcgatctgcgtaaggtcctcgccccacatctgctcgttgctgagcacgtcgtgcaccagctcggcatcgtctgcaccggcgtgggcggcgtagaaatcgagcacgaaggcatcgtcctgagcggtgtactcggtgccgtcggcgcggcgcaggtgcaggccatcgccctcgcgagcaacgagctcctgcgtatagaaggcaatgagcgtagcgaggctcgtcgccaggcacttgggcaggttgccggtctcggcaacatagtccttgagcgtgggcaggtcgcgagcacgccatttggcggttgagttgaggcaaatggagagcagcgcgtggtcgataaacgggttgtcgaagcggttctcgacggcggcggcaaaggccttgcagtcctcgacatcaagatcggcggcaagcgtcgggatgacctcgtcgtagagcatggtgttcatgaagccgcgaacggtctcgtcatgcatgcaatcgcgcacgatgtcaaagccggcaacccaggaacccggaacaaaggcagtgtgggcgccgttgaggatgcgaaccttgcgcttcttgtacggggtgacatcgggggtcacaaagacgcccggcaggccggccttcacgaagggcagacgctccttgagcgactcatcgccctggataccccacatctggaagggctcgcgcacggccaggaagggatcctcgtagcccaggcgctcggccacggcagcggcctccttggggtcgcggatacggccggggacgatagtgtcgacgagcgtggtgcagacggtgcagtcgttggccatccactgcgcaaactcgtcctcccagccccagtcgctcacgtactggttcatgatgcgcagcagctcctcgccgttgtgatcgatgagctcacaggcgagcacgatgacgcccggcttgccggcggcccagcgggtgtggagcacctgggcaagcttggcggggaagctcgcgggcggcatgtcgtcggccttgcaggacggatcgtaggcgataccggcctcggtggtgttggagacgataatctccaaatcgtcggagacggcgacctccatcatggcgcggtagtcgtcctcgcgatacggattgaggcagcggctgcaggcgctgatcacacgggactcgtcgaccgtgttgccgctctccttgccgcgcaccagcacggtgtacaggtcatcctgagcgttaatgccgtcggcaaagccaaaggcaccgctgatgggctggaccatgacaaccttgccgttccagccggttgcctcgttgcccatgtcaaagaagcggtcgacaaaggcgcgcaggaaattgccctcgccaaactgcagaaccttctcgggcgcgtccttgggcagcaggtagcccttgtagccgatcttctcgagcgtctcgtagctgatgttctccatcgatgtctctccttagattgctgttagcgtgcaggcaaaacgggggcgccgcgtgtggcaacggcgctcccgagttcggtgtgattcgatgcgggtttaggcctcgacggtatccaggtcaaagccaaagtagcggaccgcgttgttgtagctaatgtcgcgcacgatggctcccagcagctccatgtcgaccggatacttgccctgctcgacccactcgccgatcacgccgcacagcacgcgacggaagtactcatgacgcgggtaggacaggaaggagcgggaatcggtaagcatgcccacaaagttgcccagcacgccctcgttagccagagccgtgagctgctcgcgcataccgatctcgttgtcgttgaaccaccaggcagagccgttctggatcttaccggcggtcggagcctcctggaagcagcccatcacggtatcgatcatggtgttgtcgatggggttcaggctgtacagaatggtcttgggcagacccgtggcctcctggatggagttgaggaaatcggccagctggtcggacggcgtgtagttggagatgcagtcgtagccggtgtcgggaccgagcttggcgaacatagcgcggttgttgtcacgcttgcagccaaagtgcagctgcatggcccagccaaggcggacatactcgccggcgacgaactgcataaaggccgtcttgtacttgaggacctcgtcctcggcaagcggctcggcggcaaggcccttggcaaagatagtctcgatctcgtcggcggtagccggaacgtacataacgtagtcgagcgcgtggtcggaagcgcggcagcccagctcgtgggcaacgtcgtagcgcttggagatggcagccttcatgccctcgaagtcgctgatctcaacgccagcaacctcggagagatgcttgcagtagtcggcgaactcctggccacgctcgatgcgcagggcggcatcggggcgcatggcgggaacgacctgaacgtcaaaactgtcgtcggcggcaatcttcttgtgccactcaaagctgtcggcggggtcgtcggtagtgcagatcatgcggacgttggactgcttgatcaggttgcggcaggtaaagctggcctcagcgagcttggcgttggcaaggtcccagacctcctgagcggttttgccgttcaggacgccctcgtagccaaagtaacgcttaagctccaggtggctccactcaaagacggggttgcccacacaacggcccaaggtctcggcccacttctggaacttctcgcgagcaggggcatcgccggtaatgaagcgctcgtcgacgccgttggcacgcatcaggcgccacttgtagtggtcaccgcccagccaaacctcggtgatgttctcaaaacgcttgtcgtcccagatctccttgggagaaatgtggcagtggtagtcaacgatgggcatgccctcggcaaagttgtggaacagctcctcaccggttttggtgctcagcaggaaatcctgatcgtccatgaagtttttcatcaaacaacccctctgttggcggagcgggcgcatcgcgcgctcgttatcctctaggtgaacgttcactatagtagtgcaaaatggcgcgttaggtgaacgttcacctaaccatcacggggtgaacggtaggttttgggcgtttaacggttgtcacaaggatcgcgccgcacatattgcggcccacaaagccatccgactatgggctcatagcgccttccgtcagggtgggtccccatgcgacgtgcatttttgagagtattctgcagcgcagggtcccaaatacagcccgaagcaccttatttgccccatgcaccgtgcttgattggcacaaagaagggcctttgatggcaaaactcgccaccaaaggccctcaaaacagtcgttatgcccctctccgggacccaacgttgctgaatactctcaaaaatgcacgtcgctggcgggggtacccgcccagaccggctagatgcccgcgagcttgcagtaacgatcgacgttgctggcaaacaccatctccacggcgcccttttgcacgggatccgcaggcgctttaccccacagcaggtaatcccccagcgtcttggcaccgcgataggccaaaccgaccgggtccttgtagacgatattggtaaagatgccgtggtgcagggcaagcacgctctcggggaacaggtcgttgccgatcaccatgacctcccccgccttgccggccgaaacgagtgcatcggccaccagctcggagcccacggcgaacacgctgcagatcagctcgggggcatccggaccgttaaggcggttcttgagctcgcgctcgagctgcttgacctgggcatgagcgccggtaagatcctcgacctgccaggggacgttgtgctcgcgcaggtaattatggaaggcgcgggcggttaggtagtgcgaatcggtataggggtcgcccgctagcaggagcacacgggcatcggcgccggcggcatgtactaggttggccgcttgctcggccatcaggctgcccgccgttgaataatcggccaagctggcgcccaagcggtcgaggtgtggacggtcgccatcgacgagctcaatcgccacgcccgcctcggcaatttgctccagtagatgggtcgcacggtcgtcacccgggacgtaggcaagcaagccgtcgatcttctcgcccacttgcaggcgctcatcgatttgctcgagcgcatcggcataaccgcccacgccaaattcaacgcgctcaacggtaataccttgatcgatgacctcctgctcaaagcgattgcatccttcccacaggtagcgatagaagtaagcgccctcgcgcgatgcgcacggcaggcaaaacaccaggttgatatccttgcgacgcagactcgaagcactcgtgttgcggtgatagcccatctcctcggccttatcgttgactttggcgcggacggactcgctcacaccggccttacccgtcagggctttgtgcacggtattgatggaaacgccgagctcggcggctatatccttcatggttacgcgagcgctcatagagttactccagtatcggtaggccgttaattaacaatacggttaacgataccccataatcacccgtttactctccatgcctgtccccaaatgcgaaaaacgccccgcgaacggatgctcgcggggcgtttgagcctgggttttattactgaacgccgcgacccagatcctcggcgatcttgtccacacctttaagtgcagcgcaagtctttttgttggagcaatgccccgtgcaagcgccaccctgggcgcagtcggcgcaagtgcccttacggtaaatacgcacgcacacggcgacaaacgcaacgccgatcacagccagaacaacaatatcgataggtgccatagcaagcctcctttagttaaccatcacttactttacaccatcccccacctgccaaaaagggacaggtttattttggtcggttttatctgcggaaacgccacatctcccccatcaactaagttgcggtgagatagttcctggattcgccatccacgccctcaaacaggaactattccaccgcaacttagttggtgcaatggggtcaggtttctttacaccaacctggtgcagactaacctgacccccttgcaccaaaaagcccgggtatcgcggggatacccgggctcgtggaaaggggcttattcccagttggacttaggcggaaacagcggcggaggcggtgttagtctcgtcctcgtcggtccaagcgtgcttgggcatgggacggaagatctggaagagcatcgcaaccagcagcacgatggccacaaccgtccagataccaaactgcccaaggacaagcaggttatagaactggttgatgaacaggccgatgacccaagcgaaagcgcactcgtagccgatggcaatagcggtccacttgccggagtccatctggttgcggatggtgccaatggcggcaaagcacggagcgcacagcaggttgaacgcgccaaaggcaacgcaagcgcccatggtggggaacatgccggcaaacgcggtccacaggctcgggtcggtctcgcccgcgtcggcgacggacagcagcgagccggcggtggcgacgacgttctccttggcgacgaggccagagacggtcagtgcggttgcctgccaggtgctaaagccgagcggggcgaagatccaagcgaccaggttgcccagcatggcgagcacggagtagtccatgaactcctcggggatgccgtccatcgcaggcaggaagccaaaggagccgttgtagctaccaaagttggagaggaaccaaaccacgacggtggacgcgaagatgaccgtgccggccttcttgataaaggcccagcagcgctcccacacgtgcagcgcccaagagcggatcgccgggaagtggtaggcaggaagctccataacgaacggcgtcgggcggccggcgaagagcttcgtcttcttgagcatgaggcccgaggcgatgacggcaaagacgcccaggaagtagaagagcgggctgatccacgccgcggtggtggaagaatcgccgatgatggaacccatgagcagggcgatgatcggcagcttggcgccacagggaatgaacgtggtggtcatgaccgtcatacggcggtccttctcgttctcgatggtcttggtggccatgacgccggggacgccgcagcccgaggacacgagcatggggatgaaggacttaccggacaggccaaagcggcggaacacgcggtccatgatgaaggcgacgcgggccatgtagccgcagtcctccaagaaagacagcatcacgaacagcaggaacatctgcggcacaaagccaaagatggcacccaggccgccaacgataccgtcgcagaccagtgaatcgaccaggccaccgtcctcggtgccgcccgccacaagggcgtcgtgcaccacggtggtgatacccgggacataggggccgtactgtgccgggtcgaccgagtcggcattgtcgcccgcagcctcgacggccgcgtcgtaggcgtcgcggccctgaccgagcacgtaccaaccgtcggtgccgaagagctggtcgttggtgaagtcggtcaccgtgccgcccaaggtagaaacggcgatgtagtacacgcagaacatgatgaccacaaagatcggcaggcccaggatacggttggtaaccacgcggtcgatcttctcggaggtgctcatctttgccggagccttggcgaggcactcgtcaatgatgtgggcaatcacgccgtaacgctcgccggtgatgatggactcggcatcgtcgtcgcagtcctgctcgcactgggcgaccagctgctccacgcgagcggccttctccttagtgaggttgatgagcttgcaggcgtccgcgtcgcgctcaaacagtttgaccgcgtagtagcgacgcttgttggcgggaacgctcgccggcaggttgttctcgatgtggtccagaacgtcctcgatggaggaatcgaacttgtgctccggcacctggcccttagaagcagcggacttcttgacctgctcgaagagctccttgatgcccttgttcttaagagccgagatcatcatgaccggacaaccgagcttcttggagagcttgtctgtgtcgatcttatcgccgttcttctcgaccaggtcggccatgttgagggcaacgaccacgggcaggccggtctcgataacctgaagcgccaggtacaggttgcgctcgaggttggtggcgtcgaccacctggacgacaacatcgggctcgccgctcatgaggtaatcgcgcgagcattgctcctcggggctgtagggggaaagcgagtagatgccagggaggtccgtgatggtaacgttcttgtcgcttaggagcttggcttcctttttctcaaccgtgacgccgggccagttgccaacgtagccgttggcgccggtgatcaggttgaaaagcgtggtcttgccgcagttggggttacccgccagcgcgacatggatctgagaatccgccattcaatccttcttccttgtgtgcctgcactgctttctccgcgcaggctggataatgtgcttcaaagatgctgcattaagttagaaaaacctaactttatctgcagaaatatacgtcgcaagcccttactggacctcgacgacggccgcctcctccttgcggatggaaagctcgtagccgcgcacgttgatctcgaccggatcaccgagcggcgcgaccttcacgaccttgaacgaagtgcccttgatgagccccaggtccataaggtggcggcgaagcgcaccctcaccgtgaagcttgacgatggtggagctctcgcccaccttaacgtcacccaacgtcttcatttacttgtccccctttcagtgcgtacagaaatgccgtcgactaaccgacagtcatgatgtgcatggcaaccttggaatcgatgccaaagcgtgcgcccagcaccgtgacgatgatattggcgccactcgagctcaccacgtggatttcgttgccctcgacaaagccgaggtccttgaggtggtgcttcatgtcctcattgccctttacacgagacacgcgcacggtttcgcccgcctttaccatcgaaagcggcatagccggcatctgcggtccgcaagacatgagtgagctcctaacatcggttcgtcctcaatatcgacatggcaaaagttagccacgtctatgttccctttagtaaactagcacgtggttaacttttttggaagggtcccgattcagttttcgaaaaagtttcctatacgaaacaaaagaggcaccgcaaagaccatctctttgcggtgccttgtcataccaatttatgcaacaaaggggcctgtccccttgtcacattgttgaggttagagcgagaggtttctgatcgatgtgacgcaggaggcctcatccacgcccgaaacgcggaacacgatgtcttcgccacattcgccgtagagagccatgagccccatcacatcgcggccgtcggtatggcgatcgccgatgctgaccgatacgtcgctacgatgcttggcaataatgtcatagagcagcgcaaccgggcgggcatgcaatcccaacggatctttaatcgtctttgtaaactcgaccatgtcccctcccgcggcatcgcacattcggccggcaaacccagccacgtggtagttattgtacgttaccggcgcacccccgtcccacaaaaaacgagggaaggcacacgtccttccctcgttacaggcaataggtagccgcttgcctacatcaagcgcaggctgacgtccttgagctgggcgccggaaacggcactcggggcgcccgacatgaggtcggagccgctggccgtcttggggaacgccatgacgtcgcggatggagtcggagccggtgagcagcatgcacacgcggtccaggcccagggcgaagccgcccatcgggggcgcaccaaacttgagagcctccatgaggaagccgaactgcgactcggcgcgctcctcggtaaagcccaggagcttgagcatggacatctgcatttcggcgttgtggatacgcataccgccgccgccggcctcaaagccgtccatgacaaagtcgtaggtgcaggaaccggctgccagcgggtcggcctcgatcttggcgatgtcggtctcggtcggcagagtgaacggctggtgctcggctgcataggccttgcggtcctcgtcccagtggaacagcgggaagttgacaacccacaggaagtcgtggccctcgcgcttgatctcgagtgtgttggccatgtgagaacgcatgccacccaggatctcgtcagagagcaggcgcgggccggcggcgaacatcacaagatcgccgggctcgacgtccatgcgctcgcgcagggcagccatctcctcgtccgagaagaacttgacgatggggctgttgatggagccgtcctcgcggaaagcgatccaggccagacccttggcgccaaacgtggaggccacgccggcgagcttatcgatcttggcacgtgcccaagcaccggcgcccttggcgttgatagccttgacgacagagccctcctcgtttgcggcggtcgcaaagaccttgaacttggagttggcaaagatgtcggtcaggtcgaccaggtgcataccgtagcgggtatcgggcttgtcggagccataggtatccatggcctcccagtagttcatgcgacgcagcggcgtgggcatctcaacacccatgcgaccgaaggcatcggacaggacctcttcgagcgcgctcatgacatcgttctggtccacgaaggacatctcgatatcgacctgggtgaactcgggctgacggtcggcacgcaggtcctcgtcgcggaagcacttggcaacctggtagtagcgctcaacaccaccgaccatgagcagctgcttcaggagctgcggggactgcggcagggcgtagaagttgcccggctgaatacggctgggaacgatgaagtcgcgggcgccctcgggcgtggacttgaacagggagggcgtctcgacctccatgaactcacggttgtgcagcgcctcgcgaatggcaaaggtaaagtcggagcgcagcttgaggttagccatcatctcgggacggcggaggtccagatagcgatagcgcagacgggtgtcctcgctggtctcgatgccgtcctcgatctggaacggcggagtgacggacgtgttgagcacctcggcatggtcggtcaggacctcgatctcgccggtcgcgagcttggtgttggtggtctcctcgccacgagcgcgcacgacgccgtggatcttgatgggccactcgggacgcatggtctcggcgatcttaaaggcgtcgccgtcggagtgctcggggtcgaaggtgagctgcgtgatgccctcgcggtcgcgaaggtcgcagaagataaggccgccgtggtcacggcgacggctcacccaaccggtgagggtgacctcttcgcccacgttctcgaagcgaagctcgccgcaggtacgggtgtgcatggaatgctcatcgatgggacgggtctggctcataccagtgatcctcctttatggatctgtgccgccccgtgtcgttccgggcggcgtcgtacagatttgcccagcctgcgtaaaccgcgcagccggacatggcgttctatcttatcgcacccgcgtcgatgtgccgcggaaaagtagctcatgcccaaagacttgacggagacgaaacaattgacgcggcctggccgtcgccaaggcacgccgcgtgcgacaatgtgccccaatacaactgcactcggaaaggcccgtcatgaccgcacgcctcatcgttatggatatcgactccacgctcatcaaccaggaagtcatcgacctgttgggcgaggaggccggcgtgggtgagcaagttgcacagatcaccgaacgcgccatgcgcggcgagcttgactttaagcaggcgctcgaggagcgcgtggggctgcttgccggcttggacgagagcgtgttcgagcgcacctttgcgcgcgtgacgtttacccccggcgcgctggagcttgtgcgctcggcgcacagcaagggctggaaggtcggcgtggtaagcggcggcttccacgaggtcgccgataagattgtgtccgctgcaggcatcgatttttgcctggccaaccgcctggaagtcgtggacggcaagctcaccggcaagctggcggcagacattgtgaccaaggaatccaaacttatccagctgctggactgggcagttgagtgcggcgtcgacatggccaacacggtcgctattggcgacggggcaaacgacatccccatgatccaggccgcaggcacgggcatcgcattttgcgccaagcccaagacgcgcgaggcggccccgtttgccatcgacgagcgcaacctgatgctcgccatggacatcatcctgcgtgactagccgatccatctaaaaacagaatcagtctgtcctatagtttccgaacaattttgtcttagtgttcggaaacttgcccttgagtgctagactttgcaccgtcgaagggaacatatatggataagcgagatcttgagcagttactgagcgatgttgccgacggagcagtcaccccggcagtcgccctcacgcgcatccaaacggcgccaaccgccgatctgggttttgcgcagctcgatctttcgcgcggggtgcgccagggagccggcgaggttgtctacggcgccggtaaaaccgccgagcagattgccgccattatcaaaacgctgcgcgatgccggccaggagcgcatcctggtcacgcgcctggacgtcgaaaaggcagcccgcacctcggagctcctcggcaacgaaatcgacctgggatatgccccggacgcacagctcgccctcgcgggcggtaagccctcccctaccggcaacgggcgcatcgtcgtcgcctgcgccggcacgagcgacttacccgtcgccgaggaagccgcgttgacggccgagttctatggcaacgaggtcgaccgcctctacgacgtaggtgtcgccggcctgcaccgcttgctcgctcatgccgaggaacttgcccaggcgcaggtggtcatcgccatcgccggcatggagggcgcgctggcgagcgttatcggcggtctggtgagctgtccggtcatcgccgttcccaccagcgtgggctacggcgcaagttttggtggcgtagccgcgctgctcgccatgctcaactcctgcgccagcggcgtttcggtcgtcaatatcgacaacggctttggtgccgcctaccaggcaagccttatcaatcatttgagcgccggcacaacccgcgcccgttaaggagcattccatgtccaaccatcagcacacgcttatcatcgacggtacctcgggcatcagcggcgatatgaccgtcgcggccctgctcgacctgggcgccagcgaggagcgcctgcgcgaacagctcgccacgctgccggtcgacggctttacgatcgccgtgacgcgcgtaaacaagcatggcatcgacgcctgcgacttcgacgtccagcttgcagaggagctcgagaaccacgatcacgatatggcctggctctacggcaacgaagaagctgccgagcacacgcacgagcatgagcaccaccatcatgatcatggcgagcacgaacacgagcactgccacgagcatgagcacgaggcccacggccatgaccacgagggccatcatcacgcccaccaccatcaccatcgttctttggcggaagtcaccgtcatcatcgatggctcgcagctaagcgatggcgccaaacgtcgcgccctcgccatctttaacgcgctcgccgccgccgaggccaaggcacacggcaaaacgcccgagaccgtcatgttccacgaggtgggcgccgtcgactccatcgtcgacgtctgctctgtcgccatctgcctcgacgacctgggtattgatgacatcgtggtcgagtcgctctccgagggccacggaaccatccgctgcgcccacggcctcatgcccattcccgtccccgctgtcgtcaacctgtgccaggcgggcaatatcgccctcacgcctgcaccggtcgccggcgagctcgtgacgcccacgggcgccgccatcgtcgccgcgctgcgcacgtccgaccaactgccctcacgctaccgcatcgaagccgtcggctacggcgccggcaagcgcccctacgagggttgctccggtacgctccgctgcctgctcgttcacgcggacgcatagccatggatgcccgcaaagaaaaaagccgcgctgccatcgttacggcgttctccgagctgctgcgcgaggaagattacggtaagatcaccgtcggcgacatcatcgctcgcgcccatgtgggtcgtgccacgttctacggcctcttcaagagcaaagatgacctgctggccgagctcgtgagcgatatctgcacccatgccctcgacgatgacggtacgcccctcgacgacccgctcgtacaggtcgagcatatcctcaacaacctctgggaacgccgtcagggcgtacgggcactggtagccggcgccggctcacgcatcttcgccgactgcttacgcaagaccatcatgtcacgcgcagccgaaaccgtccctaccgacccaaacggccccgccgccaccatggaccgaagcttcctactacaccacatagcctcaagcttcgtaggaatggtccaatggtgggcctggcacaacttccaagcagataaggccgacgtagccaaagactacctatcagccataaaacccctcttcaactaagtaaacccctcatcccaaagttccgccccaacccaaagcacaatcatcccaaagtatcgacaacagcccaacgcccctaccagcaacaagcccctcccatccaaattcagatatatatgttgggttgcttgtacgaacgcaacaaagaccccgcagctgaccgcatggggtaacttcccagcgcattccgcaggatgcaaaaaggctcgccgcacgaagtgcgcagcgagcctttttgcatgtccgaggacgcgctgggaagttaccccatgcggccagcggacaactatgtagcctcagactagaacatgcccaagaaaccgtgcacaaacagtgcggccagagcggcgccgacaaacggagcgatgccaggaacgagcaggccatacttccagttgttgtcagccttgttcttgatcggcagcacctgataggccatgcgaggaccaaggtcacgagcctggttcatggcgaagccggtgatgccgcccatgcccatgccaacagcccaaacgatcagaccgacgcagatggcgagcatcagaacgttctcgccagcgcggctagcagcggcaaggatggcgctgatgaacacgaaggtgcagatggcctcgcagaagaagttgcgggcatagttcgtgccctcggtggtggggttggtcgagaagatgttgcgctgggcaatggggtcgacgacgccctcggaagccttgaactcatcggcatacataagccaagcgattacggcgcccacaaagccgccgagcatatcggcaatcatgaaggggatgcagctgctccacggcaccaggcctacgatgcactgggcaagcaccatggcggggttcatgcacacggcgccgccaaagacaaacaggcagaccgagatgccaaaagaccaggtggtgatggcaaacatatggccggagccctgatacttggtgcccttgagcacggtatcgcagtgcacgcccacgccaaagacgatcatgagggccgtcgcgccgaattcgcagaggagtttggtaagcataaaaccttatctttcttgtcggttataaacgattcgtttaggccgcgcactagtgctgcgcaacaacaacgcccaggccatcgggaatgacggcaaccttggcatcggcacccttcatctcaaaggcgagcttgagcgcctcctcgatagtgttgaccggcgtcatgtgcatatccttgagcatctggtgatcgcacagatcggtaaccatgatcacagggtgatgcgccagaatgcgggcaaagatctggctcgtccactggtcgggcagggtctcgtccttaggacggccgatgcaggcgcgctcaaactctgccggatcgttgtcggcgatgttgtgatagaagccctcgccaccgtgaccgtcggcgcaaccggcgacatcgatgatcacaccgccttcgggaagcgtggcctcggcagcgcacatgcccttcacagcctgatagatgttctgatcgagcgggtagccgccgttggtggtaatggcgatctcgcactcaacgggctcaacgccggcaaggctcttcacgaactcgcagccggcctcgtgcgccttgtggatgtcgccggcaaaggagccgatgacctcgtgcttgccgttgagcacaacgttaagcacaaaggcaaggtgagccatctcggcggcggcaaacatgtcctcgctcacgtggttgtggcacaggttgccggcacgcgaatgggaatcattcacaaactgaccgttgtggttgtacatgatggtcttgtagctggcgatgccaggcaggacggacttgcggctaccagagaaaccggcaaagaaatgcggctcaatgaagccctcggcaagcagcagatcgcaatcggcagcaatcttgttgatgatgcactcgccaccagagggcagggtgccgatctttttcatcatgctgtcgtcagtcgcgacgtgcataacgatttcctcgttagcaacgatctcctcgccatacttattgacgagctcctcgtgcgtcgacggacggtgcatacccgtagcaaccagaatgcgcacgtgagcctcgggcgcagcggaatggatgtgatgcagcagaataggcatcgtcacacgcgagggaacgggacgcgtatggtcggagctaatgatgacgatatccttcttgccagcacaaagctcctcgagcgaaggcgagccataagggttggcaagtgactcctctaccagctcttcctgagattttgtagtcttaaactcgttttgatgaccttccatcacacccacgaagttcttatcctcgagctccagatgcaacgtcttgtggtcaaacggcagttcacattcaaacaatgatgagcgccctcttcctttcaactgacacaccagataaaccgttggaaggatacgccgctcaccgaaaaacaccaccgtccaccgactcattaacacaacgttcatatttgacccacaacaaaacgaccgcgatcccaaacgaaaccgcggccgcccgtaaaagacacaatagaaaggatgacttacacagcgccgaggcaaacatctaccccgagacgtacgcacgtaaagcattttgcataaatgcgtcaataattgcataaaatggcgcatggatttctagccgtaacagggtagtaccctccggaacgtgcatttttacgagtattcagcatcgcgggataagattttggtgtcaaaagtctttcaaaaagtagatagtcctcatgactcgacccatctggatagcatgcggcgagaaaccagctatatatggacatcgccaaggcccaattgtcgtgcaaaagcatcaacaaaggcagcgaaagccggctatggccttatgcatcaatctttggctgctgaaaactccgttttttgcacgtcgccccaagcaccaccctcacccagcggccaatccgctgaagaccggacatcgcagggcccgccatcagtttacttttaggcacactccgcaggacgcaagaagccctcgccgcactccacattgggcgcgaagcgcgctttattcccttcagccccaatccctgaagaccgaggacgaaggggcccgacgggtttccctctgaatgcgttccgcagcacgaagcccccttatccgtagctccgaaggagcaggataagggggcttcaagtgcgaggatgcatccagagggaaacccgtcgggccccggtgagagccacagggttatcgattaccccgtgttctgcaatcctgccgagacgccggtcacagtcgaaagaatcaggctcatgtactcggccttcttctcctcggccatctcgtcctggttcatacgcacctcgcgaagggcgcgaacctgggcgatggatagggcgtcaacataggggttacgcacgcggacggcgcagccgagcacacggcggcgctgcagcggccattcatcaccgacgatggcaaggacccacttacgggtgagctgcatctcggtaaagaccttctcggacagatcctggcgatcgcccaggtgcagatacatcttggcgatgcgctggtcggtcttggcgatcgacatctcgatgttgtcgataaaggtgcggaagaacggccactcctggtaggcagccttaagctggtccagatcgccaaactgctcgcaggcggtacccaggccgtaccaggcggccagattgatgcgcgcctggctccagctgaagatccacggaatggtacgcaggtcgtcgagcgacttggcacccaaaccgcgcttggcgggacgcgagccgatcggcagcagaccgacctcggtcagcggcgtcacggtcgagaaccacggtgtaaagtcctcggtgttcagcaggtccagatagcgctcgtggcttacggcgttgagcttctcggccatatcccagaacttctgcgtggtctcggtgttggtcttctcgacgctcggggccgactgcaaaagcgttgcggcggcaacggactcaacatggcgctgagccagcgtgcggttgccgtaacgggcaaagatgacctcgccctgctcggtgagcttaaagaagcagttgaccgaacccttgggctgcgccagcacggccttgttggccggaccgccgccacggcccacggcaccgccgcgaccgtgcatgagtaccaggtcgatatcgttcttctcggcccacttggcaatgcgctcctgcgcggagtgcagcgcgagcatggccgtggtaggaccggcatccttggaggagtcggaatagcccagcatgacctccatgcggcggttggtctgggcaaggcgcttttgcactacgggcagcgtaagcatctggtcgagcacgtcgacgcaaccctcgaggtcctcgagctgctcaaacagcgggatcacgtcgagctcggggacatcctcctcgtgtgcgaaagacaggtgagcaagctcgaagacgtcggccacatgctgagcgctcttggtgaacgagatgatgtagcggtgcgccatcttcttgccgtagcgcttttggatggagccgatagcgcggaaggtgtcgatgacctcgcgcgtcatgggctgcaaatcaccatggataccgttctcgtgaatatccttgagggcgcgggcgtgcaccacggagtgctgacggaactccatctcgaccatatggaagccgaaggactcgacctgccagatgatggtctggaccgggccgtaggcagcacggacggcaccgcaggcggccagggagcgctgaacgacacgcaggtcatccaagaactcgtctgcgctgtggtacatggtgtcggtgatgcgacgcacggtggcgttcagacggtcggccatgacgagcatgacggcgcgatgcggctcgtgctcggagatcagctcagcgcgtgcggtgtactgggtgctcatctcgacctgatggttccacaggttgatgagctcggcagacggcttgctgtaggtggcctcgagcgtcaggttgcggccgatgcggcggcacttgtcctcgagcttgagcaccatgtgagtgaagtacttggcggcgacctcgcggctcaccttggcggtgacgttggggttaccgtcgcggtcggaaccgatccagctgccgggatggaagaacgccgggcacagcggcggcacggtacccgccttgtcgcccagcacccagtcgtcaaaacgacgatagataacggggatgacgtcgaacagcgtgttatcgaagatgtcgatgatggtatcggcttcctcgaccggcgtgggcttcttgagcgcgatggggctcgtacgcaccagggcgtcgatttcctgcagcatatggcgctcgttctccaccaggtcggagccgcccaggcgcggacgctcctccagcaggttggaaatacggcgaatcttgccctcgacggccttacgacgggcctcggtgggatgtgcggtaaagacagggtggaactccagcttgtcgagcagctcgttggcgccctcgacacccatctcgtttaccaactggtgataggcgacggtgagctcgttggcgggatcgacctcggtatcggtcgatgcgccggcctcgcgctcgcgcagctgcgccacgcggtagttctcctccgacaggtttgccagatggaagaagctcgtaaaggcgcggacgataacctgctgcttatcgagcggcagactgtcgatcagatcaacgacctcgcgaaacgccacggcggtgggctcgtcggcagtgggcacgccctgctcgtcgacggactcgtcggcagcacgggtgccggggtttccggcgttggccacaatctcggctgtcaaaatcttgtcgaacaggtccgcgatctcgggatcatactcgctaagcacacggcgctccaggcgcaagaacagcgccagattgtcgcgcagctcctcggggatctcgatctcagcgagacgctccttggattcggcattcgagccgattcggttaacgaggcggttgaccacggcagcgacgcgcgccgcggcttcgggtacagactggttgcttaggttctcagccacgtttcctcccattcctccttctatgcacgtaacatgcggtattcattataggcgcttgcgaaatactttcgacactgattgcgctttaccacacaaaagtattttctgcattgcaagggtttttgctctaaatggtcgtatttctcggtggacggcatacacaaacgggggcattccgcataaatgcgaaacacccccgtaacaatcgctcgcaatggacgagacactcaagcggacccgcagctcaaaatgatgcgctacaggcgctcgcgaaccgcctcgacgacgttggccagatcgacgagaacctcgtcatggctctgcatgtcgcgcaccttgaccttgccggcggcaagctcgtcgccacccaggaccaaaatgagcttggcgccaaccttgtcggcctgcttaaactgagctttgagcgaacgaccctggtagtcggcctcggtcacgatgccagcggcgcgaagctcctgcgtgatggcaaagacgttctggcgcagctccttgccggcattggcgacgtagacgcacggggcctcctcggcacccaagtcgttaccaaaggcctgcagggccagcagggcgcgctcaaaaccgacagcgaagccgacgcccgccgtgggcttgccaccctcgagctcgaccagaccgtcatagcgaccgccgccaccaatggagccgacaccggcgccgggagcctcgacctcaaagacggtacgggtgtagtagtccagaccacgcaccagtgtgggatcctcgacatactcgataccggcggcatccagatagcgcttgacctgctcgtagtgctcgcggcactcgtcgcacaggttgtcgcccatcagcggcgcgtcggccatgatctcgcggcagtggtcgttcttgcagtcgaaggcacgcagcgggttgagctcggcgcgctcgcggcactcgtcacacatctcgtcagcgtgatcgaggataaactgcttgacctgctcgcggtaagccggacggcactgagcgtcgcccatcgagttaatgagcagacggagcttggaaagatcgaagcccaggcgcttgtagaactccatgagcatgatgatgcactcggcgtctgccgccggatcgggagcgccgagccactcgatacccacctggtggaactgacgcaggcggcccttctggggacgctcgccgcggaacatggcctcggcgtagtaagccttaaacggcgtggagccctggggcaccaggttgttctccacgactgcgcgcaccacaccggccgtgccctcgggacgaagcgccaggcgctgcttgggcttgagttttgtgtcggtgccctcggtaaagacgcgctccaggttggcgccgctaaagacgcggaacatctccttgcgcacgacgtcggtcgactggccgatgccgtggacaaagacgtccacctgctcgatcgcgggcgtctcgatgggtttaaaaccaaacggctcgaacacgccggcagcgatctgctgcatcttttgccaagcgcgcatctcggcgccgataaggtcgcgggttccctccgccttctgtgcctgcatgggcaaacacctttcttttgtatcgcgtcataggtagtggacattatacggcacaaagcagcaacgcggcggcgcgtctgaccgaacgagggtatggggactcgttcggccagacgcgccgccgcggtttgtgatcccttttcctccgtccccttcggatcacgtgatcccttggggacggaggaaaagggatcatttcgtaggcccgtggctgccctggaaaccgaatgacggtacgagcatccattcggcttccacggcagccacgggcagaacagacaaacaggaataggcggcgacccgctactcccccgccacgctcgcgcgcagcttggcggcaatgggctcggatgccaacaggaacacgagcatgaccacggagcacgccaggcacacgatccaggtgctcgcaaaggagcccgtggcatcgaacagcacgcccgagacaatggcgcccacggtgccgccgaccatctcgagcgaggtgatggtacccgtgaccttgccgaggtcggccatgccaaactgcttggacgcggcgatggtaggcgtgatggtgcccatgcacgttccaacaccaaagctcacagcagcgacaataggaccgaggtccgtcgtcgggaaacacagcgccacgcaggcgataatgcacgcaacggagccaaggatattgccaaagcgcaggccaaagcggtcgtagatggcaccgagcgaaatcttggcgataacgaccgtgaccatgtaggcagaaagcaccgtaccggcccacatggggtcgtggccacccgtgacgatcttggcgccgttgacggtaacgctcgtcatgttcgtaacttggttgggcaggatggcgccattgacaagccccataaagaggaaggcgacgacaagcagccaaaatgccgggctcttcttgatacgagaccagccgacgctgacctcgggggctgccttctcgttcttatcacccgtggcagaagcagacgggtcgcctggattctcgccgagcggcttaaggccgatctcggaaggcttggtgcggaaggagtaggccgtgatgggcagtgccgccacaatgcagacggcagcgagtaccaggaacgcagagcgccagccaacactcacgataagcgagctcacgatcggcgagagaatagctccgccaaagcccgaacccgaaagtgcgatggaaatggcaaggccgcgtttggcggtaaaccagttggcggtcaccaggctaatgagcagacgggtcgaggccacagcgaagcagcccgaaacggcaaagagcacgtagacctgccaaagctcaccgacaaagctcatgccggcaagaacggcagaggtggcgataacggtgagggagcccaaaacgcggccgcttactttatcggcgacatggccaatgacaagcgagccgataacgctcaccacggtggagatggcgttggagatgttgtactgcgcaagcgtgatgcccaggtcgcttacgatgagcggctgaaacaggctcatgcagttaacgaaaatcgtgtagcacgtggccatgatcacaaagccggaggccaccacgagccagccggggaagaacttacgctgctgggacattggttactccttgtggtccgcaatgtatccgagagcgacggcgacataagccgcggcgccgaggggaagctcggcatcgttaaagcgcgctttgggatggtgctgggcaaagtgttcgtccgtatcggtcacggccgcgcccaccgtaaagtatgcacttgggatctcgctcgagataagcgcgaaatcctcgctcgccatggcatggaacagcggcaagaaggcggccttgggcagcaccgcgcccacgtagccaagcgaggcctgggtcatatcgctgtcgagcacgagcggcggaacgtccgaaagcgtctcgatggttgccggcgtacgatatgttgcggcaacgccgttgacgacctccgcgatacgctccttgagatgagtcatgagctcgacatcgaagccgcgcagcgttccctcgagcacgcaggtgtcggggatgacgttggccgccaagccgccagcgaacttacccacggtaagcgcgacctccttggccgccggcacctcgcgggagataagctcctgaagcgccaggtgcacatgcacgccggccgtgatggggtcgatgcagatctcggggctcgagccatggccgcccttgccctgcagcgtgatacggaaaccgtacacgcccgagagcgccggactcccatagagcaccaggccgagcggcgactggctgttgacgtgcatggcaaaagccgcctgaggacgcgggttctcgagcaagccgtcggcgatggcagcgcgggcgccctcaaaggtctcctcgcccggttggaacagcaacttgacggtagcgttggcccccacaaggtcagcctcgcgggccttgagcaaacgggccgcgccgagcagggccgtcgcgtgcatatcgtggccgcaggcatgcatgcaaccgttggtggaagcgaaaggctcgcccgattcctcgacaacgggcagggcatccatgtcgccgcgaagcatgataaccgtaccggcctgctcgtccgcgcacgcaccattgccctgggcggccgcggccgcaccggcaccgatcaggccaacaacacaggagccgtcgacaagcgtggtatgggggatgtccatctcgtccagacgtgcctggatataggcagacgtctgcggaagattgttaccgagctcgggcatctgatggagatcgtggcgccatgcggcaagctcaccggcaaatgcctgggcttctttgaccaggccatcgccgatagcggtctgcgccgctgcggtagcctgaggcgctggttgcggttgaagatcggaaagagctggtgccataaatgccctccagtaacgtttttgcagcaagcactttgatagcgtaaagtgcaaggtacaactttaagggcgacgcataaaaaatgccgccccgagagggcggcgcaacaagttgtttacaattgcgggcgcggctttttgcgcaaaaaatcgaagtgagtctcgctcaagataatcgacaggaagataagcacgaagccggcgagcaggcgcgaggtgagcgcctcccccatcagcagcaccgaaaacaacacgcccgaaggcgactccatcgaaagaagcagtgagcccgtcgaggcggggacatgcgccaaaccgacgttttggacgagcagcgccgcgcatgtgcagcccaccgagaggaaaacagccacaccgataaactccggcgtccatgcagagaggggcgcctgagtctcgaatagcagcgacgtgattaaactcaaaacgccattgcccacaaacatccaaaacgtgatgacgttgatgtccatcttgcgaccgtacttggcagtcaccgccatctggatggcgaagaagatcgcgccgcccaaggtaataacatcgccggcattgaactcgacgctatcgagcgctaccaggccaatacccgccaggcacaacaacgctgcacccaggttataccgggtaagcttttcaccgctcaggacatagcttgcaaacggcacaaggatgcaatacgtgccggtcaaaaaagcgctcttgcccgccgtggtctgtgccaggccgatcgtctgcaaaccgtaggcaccccacatgagcgcgcccatgccaagcccgacgatcaggttgcgggcattgaaatgagcgatgatgcgcttatggaaaattgcaaacataaccagtgatgccgggagaaagcgaacatagaccagctcgaacaccggaatggtgtcgagtgcgtccttcatagtggtaaaggagtagccccagataatcgccaccgatagcagtagaactttccagaacaacggcgagcgtgcgccggcaccccggggaataccacccgcgcccaaatcctcacgggctacagggctatcgggcatgttttcgatttcgttggcagcgtattgggccatggaacatcctcgcactcaatctgggcgtggtgtccgcacgcgtatggctgcgtgccgcctcatggtcaaataaaaacgggacgcgccggacccccggcacgccccgctactgtagcaacaaccaagcagctcatgcaattcactcaactaaagcgtcgagccggaaggcctcgatgttccgtcaacgccacattgtcgcgctaaatcaatttggtcgactccagcttttcgatgatccagtcgttggctttgatgaccggacggcggaagacgacgcccagggccagcgacggaatcagatagctcgccaagatacccagctcgacccagtactccatatgatacgcaccggccatggcggcatgcatggcgttgatgccgtgggtgaacggcaggaacggatagatcgcctggaacacggggccggtcatctcgatggggaacgtgccgcccgaaccgccgacctgcatgaccagcaacacgacggcaagcgccttgccgatatcgccaaacgaaaccgtgagcgtgtagacgatattggagaacacgagactcgcgacccagccggcaagtacaaactgcagcgggttgtcgcattggatgccaaagaacaggatgtcgcccgcgcacacgagtgtcgcctgcagcagggccagacctccaaagaacaggtagcggcccaggtagatctcgtgcaggcgcacggggatcagctcgttgatgagctcatcgtcaaccgagaccttcatcatggccgccagcacgatcgagccgacccaaagcgacagaatcgtgtagaacggcgccatggccgaaccgtagttgcggatcggatagaccggcttgcgatcgagcgcgacgggaccagaaagcgacacggccaaaccctcggggtcgttgccaatcatcgtcttgatcgtggcaaggtcgtccgacatcagggcgccatcgagctcgtccttaaaggcgctgatcttatcggacgcttcacctagctgatcggaagccttattgaccagcgtggcagccttggagaggcccttagccaacgagccggatgcatcggtgaggccgctcacggcactatccagattgctcgaaataccgttcagcgaatccaaaacacccgagatggtcttcttgagctcctttgccttgaccgagaacgtggagtcgtaatcgatcttggcacccgagacacctgccttggcatcggcgattgcctggtcggtttcggcgcggacatcgttaacctttgccatgctgtccgagagcgacgttgcgatgttcgccagctccttggcattgttacggtactccgtcgcggttttgtcaagctcagcagccgcgccctcaagccctgccttgagcttatcgttactcacctggccagcaagactacggagcttatccgccgtggcatcaatctcgtcagcacgtgtattgagtgacgctgcgccgtcgttgagctgagacaccgtaagatcgacatgctggtttgcggcgtcaaaggcctttgcgagctcggtggacacgttatcgaacgaacccgcacttccatcaatcgcggcatcgatggcatcgctggcagccttgagcgcttgttccgaatcaccgataccgctctcggcatgctccatcagctgtttcaccgactgctcggtagttccggtctgcttgagcaggccgcccgccgacgtcagcgaatcggatgtcgagctcaaaacgcccgcaagcgaagtagcgctggccttgatgtcctgcaggtcctgaaccgagtcgccaagcgtcgaggacaggttggcgatgaagttgctgacctgttcggtgctcatgtaatcgagcaggctggacaccgtcttaagaccgatcgtcgtgatggtctcggtaaaggtctcgttgacctggttctgaacagcactcgagcccttttcggtcacgatctgggcgatggcgttggccttctggttctcgtagaactcgatatcggcatgcttcacgtcggtcgaaaagagcgtcatcatgtcggagctaaagctcttggggattacgacggccgcatagtaagcgcccgacttaacaccgtcgatagccttatcgcgatcgttgagcacaacccagtcaaagttctcgttaccgcgcaacgcggacgtcacgttttcgcccacgttgacctcgacggggatcagatcgctctcgtaaccctcgtcggtgttgaccacggcaatcttaaggtttccggtattgccgtacgggtcccagctgccggcgatgttaaaccatgcatacaagcacggcacgataatgaggcccatcacgacaaccatgccgatcacggagtgagacacgttttggacgtcgcgcttaaacagatgcaggatgttcttcatttatgcctcacctccttttgagtgcttgccaagcggggcgccatcctcattcatcacaaatgtgtcgtccccgttcgcgggcacatggtgcatatcgtggtgaatggactggtcggcagcctgatccttggagttagaacctcgctcgctggcattcaggccaaacatgcgacgggcggcagggatcgccgctgtgtgctcgcgcatctcgcggcgcagatcctcgtccgaaagcgccgagatgcgcatctgggtgttgaggcttgcacggatgtactcgatgttgatgagccatccgcagatggcaatgaccgagataatccagataaccagcagaatgatcttgccattgttgtcgatatcgagaaccgtcgacagaacgaagagcagcacctgcacgccgactacagcagcgaaaccgcccttgatgtagtacgggtagcgatgctcaaaggcgaccgcatgatcgagcacctcgcgacggtacgaatccgaatcgagcacgacgcgcatggccgtgcgcagcgaatagcgctgacgcggcaggtcattagactcgcagatcatcagacccgtcgtggaaagctgtttatcaaagagcaggttgaggttgagcagcagcggacgcagctgcagaccgataaagagcgccacgatcaagaacacgcccagaatgcacaagttaaacaggtagttgaacgagtacatgccgccgaccgtctcgcgcagcagattgatgccgtaggtaaagggcagcagcgggtgcagccactggaagaaaccgggcatcatctcgatgggatacatgcccgacgagccggggatctgcacgatgacgaggatgacaccaatggctttaccgatatgcttaaaggtggtggacagcgcatagatgatgttgacgtaggtgaacgagatagcgatgccgcccagcacgaacagcagcgggttaacgcactgtacgccaatgaccagatctcccaccgtaacgatgatggcctgcaacgcacccaggatcaccaggagcaaccagcggccaaagtagccttggcgcgccgtaaagctgccaacgccctcacggtcgacctcgagcttgtagatggcgatgagcacatagccgcccacccacagcgccaggttggtgtagaagggcgcgatgcccgagccaaagctcttgaccggataaatcgacttggacgtcagctcaacgggggacgccataaagtccgccacgtcgtccacgtcgacgcccatcaggtcggccagctcgcccatagactcagaggtctgcaacgccgcgatgtcgttagcggcggttgcaagcctgtcctggaccttgacaagcgaggcatcggtctgggacagcgtggtcttggcctgcttgagcgtggcatcgagttgggccagcgtgccacgcgcattcgcaatcgtgggcgtaagacccgatacgatgccggtcaggtcgcccgaaacggtggcgaaggagtccagcgcgctcgaagccttcggcagcgcgttctgccccaggtccatctgagcctgattcatgttggtcgtaccggtttggatcgcattgttgatagcatcgctggcgcccgaaacagccgaagcgtcattcgcaatagcgcttgactgagcggagagattatccttgacggcctgaaggctctcattttgccctcgaagcgtatcaatcgcagacgcgatcagcttattaacttcttccgagcccgtcggcgcgctgtcggccaggttctgcagacgatcgataagagtcttgttatggtcaatcgtcgtctgaagcgattcgagcgagttgtcgatgcgagtggtcgtagacgtcaaggcgcccgtcatctttccgaccgcagcgttcgccgaagccgacgtcttggacagtgcaacacttccctccgaaagcgccttagagagcgaggtaatcgatttgcccgcggtggtgcgcgcttcgcccaacaggtcgttgccttgggagatcgcttgagtcagcgaaggcgtctgaccctgcaaaccggccagcgccccatccgccgaggcgatagcaccgctcgttttgtcgatagcggtgttcatgtcgttgatcgaatcgcggacctcgctcaaggtactggatgcctcggacaccgaactcgtcagcgaatcctgaacctgggcggtcttatccttaaaatcgatgccggcatccttggcgatgcccgctacggtctcacccaccgtggagacaaactccgagttgatctgctcctcgatggtgttggcaccggtatcggtgaccttgggcgcaatggcgctctttttctcgttgacgtaataggtgagcttcggctgatggtagttgccgtcgagcatcgagaccagattgtcggagaagttcttggggattacgatcgcagcgtagtattccccgctctcgacaccctctttggcatcggcagccgagtcgacgaaggtccagcccagctgatcgttttccttgagctggtcgacgacctggtcgcccgcgttgagctcgcccactaggtcgttctgagtgccctgatcgttgttggcgatggcaatcttgataccttgggtgtttccgtacggatcccagtttgccacgatgttgtaccaggcatacagcgaggggataacgcacacgccaagggtaaccaccaaggcgacggggttcacaagcagtcgcttaatgtcgcgcttaaatatcgcaaaggagacctttgcatcggatagtttgctgccgagactcacgcttggaccatccatcctgtcgttgaatcaaatcgtactatcaaaaaccattgtacgtaggcgctttagcgtctcgaagcacaatggtattgagttttgcgggtagcaatatactacgaagatgagttagtgtacagttgtacagtatctttaatatcagcaggtcacaaaaccacagcccgcacaaattagcagtccgaataaatagtcattgggtgttcttaaacgactactcaaacaagaacgtccccaatgactaatggtgcgaggaatgtcccaaactgtcggcagagacgatatgagcaggacataaaaacattgagagcccctgctgcatgaagttgtttcgccggaaaaaacagcgtataaagcatatccaaattttggctgattcacgtatgagtaggagaagaccaagagcgttaccagtgctgctgccataagtacattcaagacgattcttctaccgctcatcggtcactcctttcgagtgctgataaaaatatattaatataataacagttttatccaataggattggaggagtcatggcagtaaaatccgttattcgtaagttaatgttattttcagcatcaactgtccttttatcagcttttttggctgtgactccatcttttggtttgacagtaaatcacgatgtgtctatcaccgcgtcttacgcagaagtttcgttgtttgatgaaatctctttagcaaggcgtgccatgcaagaagacgtccttgatacgtattattcgttctattgttttaataacgttgcgcataatattcccttaaaggatccaacttataagcgactaactttcaagaatagctacagccgtatttatccggatacatgtcgaacaagttttgtttatacttgccccacgtgcaagggtgacgggcttatgaaagtatttcagtgcaactaccaaacgcgttgattcgattgtgggtggcttatatgcatagcatgaagttcaaagcaattctaggttctttcttcctttttgtttgtttgtgttttccgactgctggctttgcggacgggattgtctgcaatatgagaaacgatgttcagccggttgcttctctatctaatgatctctcatatgcttctggcaccgctgctcgccgtgcgaacagcgaaagggtcttgaatgtatattggacttttacgggactattgaatggtcgagaagtgaaagatcgaattgtatatagggattacaagtcgctatcttttcctaattcctatagtactctagcgccaacttgggttaatactcgcgccaccggttctaacggtgaatatttttctcaggttcaagctactggggttggatccgtagaaacatggcgttgcaactatcaaattagataatttgatataaacgtcacatctaaataacgtgcactttcgctggagggtcgctgtttggcggccctcttttttgcacaggcgcggtgggatggtaataacgggcgggagtcagccgctctgatagaatcgtccttgctgtcggcagccctcgtgcaaaaccaccacaaaggtgcctgtcccctttgtggtggtcggtcgaccggcatagaaaaaagtccccgccgggcgtgtgctcggcggggactttgccgtttaatggctagcgctgagggtgattactcgcccagcaggctcttggtgatggaagcggcggccttcttgccggcgcccatcgccagaatgaccgtagcggcaccggtgacgatgtcgccgccggcccagatgcggggatcggtggtctggccggtctcctcgtcggcgacgatgtagccccacttgttgagctccatcttgccgccgatcttggcagcgaaggggttggcgttggtgccgatagccgagatcgcgacgtcgcagggaatctcctcgatggcgccctcgatgggcaccgggcgacggcggccggactcgtcgggctcgccgagctccatcttctggaccttgacggcgcacacggagccgtcctcgccagcgacaaactcgagcggggagacgagcggcagaacctcgacgccctcggccttagcatggtgcagctcggcgcgacggcagggcatctcgtcctcggtacgacggtaggcgatgatggcgtgctcggcgcccaggcgcttggcggtacggacggcgtccatagccacgttgccgccaccaaagacgacgacgttcttgccgtgcttggtgggggtgtcgtactcggggaacttgttggccttcatcaggttcacgcgggtgaggtactcgttcgcgaagaagacgttgggcaggttctcgccggggacgttgaggaacttgggcaggccagcgccggtcgccacgtagatggcgtcgaagccctgctcgaacagctcctcggccgtagccatgttgcccacgacggagttgtactcaaacttgacgcccatgtcctccaggccgtcaatctcacgcttgacgactgccttgggcagacggaactcggggatgccgtagaccagcacgccgccgccggtgaagaatgcctcgaagacggtgacgtcaaagccgttacgggcgagctcgccggcgcaggtgatgccggacgggccagagcccacgacggcgaccttcttgccgttcttgggggccatcttgggcgtggaggcgagctcggggcggtcacccaggaagcgctcgagctggccgatggccacgggctcggacttcttaccacggatgcacttgccctcgcactggttctcctgcgggcagacgcgaccgcagatggcgggaagcatggagtcctcgcggatggtatcgagggcgccgccgaagtccttcgcgcggatctgctcgataaagcggggaatgttgatgttgacggggcaaccctcaacacagaacggcttcttgcagttgaggcagcgctcggcctcggccagcgccatctcctcggtgaagcccttgtcgacggggcggaagtcgcaggcgcgctcggcagccggctcctcgttatcgggggtgcggggcgacttcatatcggcaacgaaacgaccgttaactagtggcatgcgcagctcttttcctcataggccttgagggacgcgccctcttcggaacggtaagcggcctggcgggcacgaaggtcatcccagtcgaccagggtggcatcgaagtcggggccgtcgacgcaagcgaacttggtcacgccgcccacctcgacgcggcagcagccgcacataccggtgccgtcaaccatgatggggttgagcgacgcggtgatgggggtgtcgtacttctgggcggtgagggtcgagaacttcatcatcggaacggggccgacgcagaagacctggctcacggccttgtcctgcagcaggcgctccagcggagcggtgacaacgccctgctcgccgtaggagccgtcgtcagtggtgatatggatgtggtcctcgtcgaggagctcgcggaactggtcctccatgagcaggaggtctttggtgcgggcgcccatgatggcgtgaacttcgtgaccggtctcgaccaggtgcttggcgaccgggaaggcaattgccaggccgacgccgccgccaatgacggcgcaggggccctcggccatctcggtgggaacgcccagcgggcccacgacgtcgcgcagcgactcgccggcctcgtaggtggacagcatctcggtggtcttgccgatcaccatgaagatgaactcgacccagccctcgtcaccgttccagccggccagggtaaacgggacgcgctcgcccgtctcgttggcgcgaaccatgaggaactgtccagcgtgcgcatgcttggcgattgcgggcgcctcgatgcggaacttgaacaccttctccgagaactgcgtcttctccaggatcttatacatagaacccctctcttgttagggccgccgaaccgtgcctccacggaaatggacggtagcccgaataaaaccgtacgcgcacaggcgttgtgcagacatacggtacaaattataccctcatggacatgctgtttacgtgtgtcttcggcggttgggaaaagggtttatccacttcgacctaccaaatagggataggtttattttggtcggttttatcaggcaaaacggcaaagggggccggcctcgggttgtgatgaggccggccccctttggggtgttatgcgtgtatggcggcgcggggtttattgcgatgcggccaccggggcgtttctgtagatagaacctgccaaaataaacctgtccctaaacggtaggttttagtgcttgccgttggcggaggcggcgccgttgacgtggtcgcgggcatagatcacgccgtgcacgatggcgagacccgcggcgtcggcggcgcgggcgcaggtgtcctggaagtcatcggcctcgcgggcgcgcagctgtttgagcacatagtctgccacggccatcttgccgggagggttgccgatgccggtgcggatacggctaaagccgcggctgcccatcttgtcgatgatggagcgcaggccgttgtgcccggcgtggccaccgcccaccttgacgcgcacgtcaccggcggggatgtcgagctcgtcgtgaatcacgagtagctcctcggccttgatcttgtactcgcggcagagcttggagatggggccacccgaggtattcatatacgactgcggcttgaccagcacgatctggcgcttgccaccctcttcctcgggatcgttgatgttgatgagtgcgacctcggcgccggcctggtttttccagtacgtgacaccggcctgacgggccagctcatcgatcgccttaaagccggcgttgtggcgggtctcggcatattcctcacccgggttgccgagtccggcaaccatgcgaatcttaagcggctgtgcagctgccatgttcatcctttcgttgatttgtcgcctgctatggtgagcgaccctgttgccgctgtcaaatggagggtaattgagggcgtttgggggcgtttggacggacgtcgaaatccgaggtggacagttagttcagatacgtataagttctgaggactcgaattactcaattcaatgccgatacgttgttttggagctttagttagtccatatggcgctgttttgaagtctaccctgccttcaaatagggcgaatggtatagagatagttgcaaaacagtctaattcaatgcgtccatttatacgtatttgaactaactgcccagccctgctcgacggcgcacgggtgattcgccgtttaggccggcgcgaggccggttccggcccgcagagcgttgagccaagcggcctgacgcttgcgatagcccttgatacggtaccggaatcggactcctgcgagtcgatgcatcgtttgggcgaaggcttcgagtgcaacaaggtctttcatttggtcgcgattgataaccaggacgtggatgcccatggccttgaggccattatttcgattgccatcgtggatgcgagcgttttgaagctcatgcccaattccgttgtattcgttgtcgactccggctgccgggcaatataggtcgcagatggcataggggatgcccgaggacatgttgaccgcaagagtatcgaagtcgattcgatggttgagtagcaggcctcccatgggcaggctgcaacatccgaatccgccaaagcgcatgggcgctccgagaacggcaaacattagggattcggctggggatgcggatccagcccgggcgagtttgactgccgtgcgaaacgaggcgtatgagctacttttggcgaaccgtgcgaccgcctcgagctcttcgatggtcgtggcgggctcgcatttgtagtgcgcctgttcatagcgggtttcgttctgttgttcggccgctgactggttgcccaggcaatcaagatcgcccgtcgcttcgtagccatcgcccttgggccagatgtcgtcatgggcaatggggtatgttgccccgggaggaagggagtaagttccgaccagttccatgagaagcatcaaggttttggcgactgattcatttttagaacaaagcatggctgtcatggcaggagacgttgcgtagatgtcggcctcgacgtgcataattgcaccttcaggaagcggagcggagagaatatgctgaagaagtcgcttgtcggggcgtcggttgccttcgtttgaaacgagaagatcgagcagctcggaatcatcttcattccaggcgtcgagtatcgaaagtgcgccaaagtctatcgcgtcattattgggaatgcagctagccaaggcctgtgcttgctgttcactatcaatggagctccagggtagggcagagtacgcccgtcgtgcgcgacgaattgcgcggagggcggagaaatgtgaaatcacggtcgtcatagctataacgtactaagttggcggcagaatgcgaccgccataccgttcttttcgctcagcggggtgctgggcgccatgaacggccgggtgttaggaaatcggtggaatcggttgaggggattgcaggaaattgagctctgccgagaaggttgacgatggctactggacagttagttcagatacgtataaggcggcgggcgttcgaggtgtttctaagggccttcgagggcgatttgaagataatatatgcggcggttgtactcgaaaacgatgagcttcgggcggcatggcatccgccggggagctcagaaggctccgaacggacctttggagccttaaaaaatacgtatctgaactaactgtccagggcggattggcgaggaatagaaaaagggtcggaagcgagcttccgaccctttaaaaacatcaaagatgatgcgatacgcgttggactacagcgcgaagtcgccgccgacgagcgtggagacgggctcctcgtggtaaacggcggagatggcctgagcgaactcctcggcgaccgagatggtcttgatcttgccgccgacctcgacggggatggcgtcggtgacgacgcactcgacgatgggggcgtcgttcaggcgctcgatggccgggccggagaagatgccgtgggtggcgcacacgtagatgtcgccggcgcccatggccttgagctccttgacgttggcgcacagggtgccagcggtatcgatcatgtcgtcgttgatgatgcaggtcttgcccttgatgtcaccgatgatgcccatgacctcggcggcgttgtggcgcgggcggcccttgtgggcgatggccagatcgcagccgagcatgtcggacagcttcttggcagccttggcgcggcccacatcgggggagacgacaaccaggttgtcggtgtcgaagtgcatgtcgttgtagtactggccaaacagcggcagtgcggacaggtggttaaccgggatatcgaagaagccctggatctggccctggtgcaggtcgagggtgatgatgcggttgacgccggcacgctcgagcaggttggcgacgaggcgggcggtgatgggctcgcgcgggccggccttgcggtcctggcgggcatagccgtagtgggtgatgacggcggtgatggagcgggcggatgcacgcttggcagcgtcggtggcgatgagcagctccatgagcatgtcgttgacgttgccgccggccacggactgaatcaggaagacgtcggcgccgcggacggtctcgtcgtagcgggcgtaaatctcaccattggcgaactgctttagcgtaaggcccgaaagctcgaccccaaggtactcagcaatcttctgagcgaggggacggttggaggaaccggaatacacgcggatggacttgcgcatattctccgacttctcgggatcattaatcggcattacccttctcctttaaatcgaatgccatatagatgccttgttgcattgtaaccgcgcggtggggtttatcgagtcttgataacgtctttaccgtcaacggacacgaaccgaccactcatccggccgcgcaggtcagcatagaaaaaggagccgtccccatgggaacagctccttagatgcttggtaaaacgttatacctcgtcgtcctcgtgcagacggcggcgataatcggcggcccagccctcaatatttacctgacgggcgcggcccagtccgagcgcgtctgccgggaccggctcggtgatgacggagccggcggccacgagtgcaccgtcgccgatctgagcgggcgcgaccatcatggtgtcggagccaatgaaggcgtccttgccgatgacggtcttgtgcttgtgcacgccatcgtagttgcaggtgatggagcccgcgcccacgttgacgccggagcccatggtggtgtcgccgatgtaggacaggtgcggcaccttggagccctcgccgatcgtggacttcttgatctccacgtgcgtgccggccttggagccgtcgagcatgtgggtgcccgggcgcaggtaggcgcgcgggccgcagtcgacgccgttctcgatgacggcctcgatggcgatggtctcatcgatggtgcagccgctgccgacggtggtgtcggtgaggcggctgttgggaccgagctggcactcctcgcccacggtgacgtggccgatcaggtgcgtctgcggccacacgacggtatcgcggccgataacggcatcggggccgatccaggcctgcgtggggtcgatgaaggtaacgccctcggccatccagtgctcgttgatacggtcgcgcgcgatggcggtgagctgtgcgagctggatgcggctgttgacgcccaggccgtcgcggtagtcgtcgcagtggaagatggagacagcctggccgtggcctttgaggatctcgagcatgtcgggcaggtagtactcggattgcgcgttgtcgttgccgatctcgttaatgtgggcggcgagctgcgcgccgtcaaaggcgtagcagccggcgttgcactccagcagcgtggcggcctgctcgggcgtgcagtccttctgctcgatgatgcgctcgatctgaccgtcggcgcccagcttgatgcggccgtagccgaaaggatcgggcggggtcatggtcatgacggtgcaggcgagctcgccggtggcgacggtttgcgcgaacttggcgacggtgtcggcggtgatgagcggcagatcgccgttgagcacgacgaccggaccctcggtgatgccacaggcctcgagcgcgaccttcacggcgtgaccggtgcccagacgctcggtctgctcgacgcactcgaccttggtggcgctgttggcgtaggcgccgtcgatgagggcgcgcatctcgtcggcgtggctgccgatgacaaccacgacgcggctgcagccggccttgatggtagcgtcgacgatccactggaccatgggcttacccaggatcttgtgcgaaaccttgcagtggttcgacttcatgcgggtgccctcgccggcagcgaggataattgcggttgcgtccatgtgatctcctgttacgttatagagacgtgtgtttggaaacgatacacggcgcaatatgataccgcaggcatatgacgagcgcgtaacgattggtttgcggcggttgaggcttgcgccgccggcgtggcgtttgcactgcttgtgtgcggcgttggcggtgctgcggagctgttgtttgagcgaggggacgggggtgcccgtggacaacatacgagaggagtttggcggcgagcccgtcgcggcattctcgatgtcgcatccggctgtgccggcactctatatagtgctgacgctggggctcactatgttctcgatgcagccggcgctgattgcgctgtcacttgcgggcgggctggcgtatggatttgcgacgcgtggggctgcccgcacgctgggcgcactccgctggcagctgccggtgattttgatcgttgcggtgctcaatccgctgtttagcgcctcgggctcgacggagctgttccgtattggcatgcgcgcggtgtatctagagagcatggtttacggcctgtgcatgggcgggctgtttgtggcgagcgtgctgtggtttgaggccgcggcgtcgatgctcgaatacgacaaggtgctcgcgctgctgggtaatgccgcaccggtgattgcgctcatgatctcgatgtgcatgaggcttatcccgcagtttttgcgccgcggtcgtacggtgctggcggtgcaggatgcgattgatgtgccgggccgcgcgccggccgaccccgtgcgctcgcacctgcgggcgtcgagcgtattgatgggctggggcatggaagattcgctggagcgcgcggacgcgatgcgctcgcgcgggtggggcgccgcgacgcgtcgtacgacgtatgcgcggtatcgactggggcgcagcgacgttgccgcgctggttgggcttgcgctgtttggcgtggccacggtggcagtggcgtggaccgcaacgacgcagtattcgttttatccgcagctctcggtgccggcgccgtggccgggctatgtcgtgtacgctgcctggatggtgctgccttgtgcgttgcacgcgattgacgagaagaggtttggctgatggctcggtttgataggagctcgtcggcgggtgtggcatatggctcggccgcgccggcgattgaggtgcgaggccttagttttgcctatcccggggccgaggcaccggtactcgacgggcttgattggcgtgtttcccaaggtgcgtttgcactgcttgttggcggtaccggttcgggcaagtcgacgctgctgtcgctgctcaagcccgagatcgcgccggcgggtacgcgctccggcgagctgcgcgtgctgggcgagcccgtcgccgacatggatgtgcgggcatcggcggagcgcgtgggttatgtgttccaggatcccgagaaccagatcgtgtgcgaaaccgtgtggcacgagatggcgtttggcctagagaatctgggcgtgtcgcgcgacgagatgcgccgccgtgttgccgagaccagctatttctttggtctggaggactggcttcatcgtgataccgatacgctttcgggtggccgcaagcagctgctgtcgcttgccgccgtcctggcactgcgtccgcgtgtgctgctactcgacgagcccacgtctcagctcgatcccgttgccgagaagaattttctgcacgcgctgtttcgcgtgaatcgcgagctgggctgcacggttgttgtggcgacgcatcagccgcggccgatgctcgagtatgcgacgtgtgcgtaccggattgagggcggccgcgtgcgcgaggtggccgacattgcctccttggggcatcgcgaagagctgttttctggtgaggtgccagggtggggtggctcgcggcgtgcaaaaaacggaattttcagcaacgccggtggccagcagagctctttgggaccgcgcgcggccgctccgagtgcgaataaaggactgaaatcgggcaaatcggttgaatttgaggtgcaaatcctgccgcaaaacgactcgggggcgccatcgcgcgccggcggatgccgaatattcccaaaaatgcacgccgggtcagctaccaccctggcagggggctggtttcgctacgaccgcgtgtccggttgggtgctgcgcggactcgatgcggagttctcggctggcgcggtgcatgcggttgttggcggtaacggctgcggcaagtcgacaatgctttcggtgctggcgaagaccgccaagctgcagcgcggccgcatgatgcgcggagcggcctcggcggcgctgctgcctcagaatcccaaagcattgctggttgccgagacggtgcgcgacgagctgatggaatgggcttcgacctgcgggtacggcgaggatatagcgcgggagcgcgcggtgagtctggggctcgcaggcttaggggaacgccacccctatgacctttcgggcggacagcgccaactgcttgcgttagcaaagctactgctaatcggccccgaactgctattgctcgatgagcccaccaagggtctggacctggccagccgccgcatcatcgcccgcgccctgcgcgaccatgcgcgggctggcggcaccgtcatcatggcaacgcacgacctggattttgccgagcaggtagccgacgacatcgccatgatgtttgacggcgagattgcctgtatggagccgcccgccgacttttttgccgacaacgtgttttatagggcgtgatggggttcgtggggcgagatcgggcttactgtttgagcgccgtgtactgctgaaggagcgccataagcccaacacggctattgacccgcgtttttcgaaagatgttctccagatgctttttaacggtgccagtgctgatggagagctcttcggcgatggccgcgttgtccatgcccgataacacgcaacgacacacatcgatttcgcgcgctgagacatcgtagtcgtgagcaaatacgatttcagacgaactgcggtcggcgcgtacacgccatttggataggcgattggtaaggtggggctcgaccagctccagaatctggacttcgcggtcggtgaagtcgccttcctcttttttgcgattgagattgagcgatcccaaaaagccctcatcgttaaagaaactcacgttgacgacatgacggccgccaaggtagtccttcatatagctactctcgatatcgccggggctgagctggtcggattcgcgcagcaccgtcgagcgcgtgaggttgcgatgcgcgacgatcatatcctgttgccagtactcttcggtgtagcgctcgagcatcccggcggggacgtcgatgccgagcgggtcgagaaagacgcgcgtcttccattcctgcggggtggaaacgaggtctttggaaagatcgctcaggaaaaacgctgccgactcgtaggggataagaaaacgcaacttcttgaggatggtcgaccggaattctcggtcgttgtcgatggaattaatcgaaagcacaagatcgtttaagcagagccactcggaatcggacagaaagctcaagatgacctccgatgaaattgcgtagggtttaagctggcgttttagctatttagcgtagtgatactactccttttttcgcatgatgataagccggatgccgaatggtttcggtgaagggtcaatcgcaaaatgtgggcaccgaagagccagggcccggctctccaagctgtctgaatactcgactaaccaaaggagtcatcatggaagagaagcttccttcatggcgctgggcgatcgtttcggtcgtttgcttgctgtgctttatggctaactacatgcagtaccaggtctcggcgctcgccgtcgaggtcatgccgatgctcaacatcgataccgtcggcttctcgatgctgttcctcgtccccatgcttactgctgtcttcttctcgattccgctgggcgccctcggtgaccgcatcggttccaagaaggtcgttgcggtctgcaccgcaatttcggttgccggcggcttcctccgctgctttacgctcgactcgttcacgatgcagatggtgtcgatgttcctgatcggcatgggcatctcggcgctcaacgccaacctcatcaaggtgctcggcacgtggttccgcgagcagaccggctttgccatgggcttgttctacgccgcttcgtgcgtcgccatcgtcgtcgcccagatctgtgccggcatgttcggcagcgttttcaactcctacatggttgccgctgtcgccatgaccatctcctgggtcctttggatcgtactcgaccgtgacgtgcccgagggtcagccgcttcccgagcccgagccagtgctcgactacctcaaggtcgccatcaagagccacggcgtgtggctgatctccatcggcgttggctttggcctcgcctccaccactgcctatgccggcttcctgccccaggcgctccagctcggcaagggcatcgatgccgctaccgccggcttcatggccgccatcgtcaccgtcggcagcttcttcggctgcatcgtgggacctgctttctgcgacaagcttggcaagttcaagggcttcctcatcgtcaccacgctcatcggcgctgtctcgatgttcgtgacgtggtacacccccgtcggcttcctgctgtgggcgatcctggtcaccaacggcttcttcaccgccatcaacggtccgatcatgcagtccatgccggttctgctccccgagatcggcgacacgtacgccggttccgctggcggcatcgttggcaccatctccctgctcatgagctacttcctgcccatcggcatctccgctgtcgccggcgccgactacaccatgaacatgggcctcgagagcctctgcttcctgctttccgtggtgccggtcttcttcctgcccgagctcggccgcaaggctatgcaggctgccgccgctaaggacggcgagtaatcatggaggcggtggttcctgccgacatcgtcattaagacgacggcgctgtttacggccgaggagcttgagccccatgcgggatgcgtcgcggttcgcggcaacgagatcgtcgccgtgggcgcacccgacaaggtgcagccgtttgtcggtcccgataccgaggtgatcgatgcgggcaacaagctggtcatgcccggattcaacgattcgcacatgcactttgcgctcggctccatccagaaagacgaggacttctgctgcgatttgatgttcttgccgagcgagcaggcctgcgtcgatgccgtggcgaagtttgccgccgagcaccccgacaacccgtggatctacggccagggctggtattcgcccgcatgggaggatccgactgatcccgactgccgtagcctcgatgcactcgacatcgatcgcccgattgtgctttcggacttttcgatgcacgtggtttggtgcaataccgccgcgctcaaagcggtcggcatcgaccgtaacaccccgacgcccgagggcggcctcatccgccactttgacaacggcgagcccaacggttttctgtccgagccccaggcgacgaacattctgctcgatgtggtgctcaacaagccggacctcgatgcttcgctgctcaagtcgatgcgcaagtttaacaggctcggcatcacttcgatcggcgacatgcatcccctgggcgtgactacgcccggcgtgtacgacatttacgaccgactggcaaacgaggacctcagcacgctgcgcattagctattactctgcgctcgatgctcccatggcggagtcgcaggctctgagggcgcgccatcatggcgagcgcgtgcgcatggcgggccttaagtacatcctggacggctgccccgaggcctatacggcatacatgcacgagccgtatctcaacgcccccatgggcaagggcttccgcggcgagccggcgtgcaaccaagagacgctcgaccgcatggtgctcgaggccgataagagcggctttgacgttcgcatccatgccattggcgatgcctcggccacgatgatcatcgatgccgtcgagcgcgccgaggaggcgtgcggcgacaaggggacgcgttttgccatcgagcacaccgacaacctgcagtttgaggacattgcgcgtatgaagcgcctgggcatcaacgccgcgattcagccgcagcatcccattggaggccttgggcagggcgtgtacgagggctcgctcggcgaagagcgcatgagccacatgtggcgctatagggaagaggccgatggcggaatccacttagggcttggtactgactggcctgcggtgatgtcaatcgatcctatcgataccgtgtatgctgcggtgacgcgtagcgagtttgacgggcacccggcggagggatacttccgcgagaatgccctgacgctcggcgagacgctgcaagcgcacacgctcggctcagcatatgtcgagggctttgagcgccgtttgggcagccttgccgccggcaagcttgccgatatcgtcatcctgtcgggcaatccgtttgaaatgaacccgatggcgcttcgcgatctcgaagtcgagacgacgatctttaacggacgcgtcgtctatcgcaaggatgaagcatagatagggtgatgaacgtgagcaaagggacggtcgaaaaatatgccctgctgtttgtggtgtgcggcatcgtgtttgctgcgaactacgcgcagtatcaggtgtcgggattgacacatctggttgtgtcggacctgcatctgacctcggccgagttttcagccgtcctgtttgccccgtttgttcctgccgttgtattcggcatgcctgtcggcgtttgcgccgatcgatatggcgtgaaggcgctcgtattcatcgcgtcggcgatttctgcaattgcagcggctgctcgcgcggagtgcgcatcgtttgcgacgctgttcacggcgaccatgcttctgggtgcggcaccatgcgtcgtgaatgccatcgttctaaaagtgcttggttccgcttttggcggagaaaccgatagggccatgggatggttctacgctgcggggtcgggcggaatcgcctgctcgcttgcaacctctcctctctttgcaacgcccggacgagcatatgcccttgccgcggttttgtttgccgtgtttggattgctgtggctgctggttgcgccgtcggcagatgttctgcaggctgcagatggctttggcgttcagggcgcggagcctgctgcatcgtcggcaagtgcgtttgcggcggtaatcaagatgccgatagtttggctcgtggcgatactgcttggagttgcccttgcatcggctacggcgtactcgggttatcttgtttcagcgcttgaggcttcaactgaacccaaggctgctggacttctcgcctctttcgtgacgcttggatcgattgtcggcagcgtggctggaccctatgtgcgggcgcaatttggcgattatcgcgtgtttatggccatctccgcaatggcgggaagtgcccttatgtgggcaggagaggcttttgtctcccatccttctgtggggctgatgtttgcgatcggcgtttcgagctccgtcgctggtccggtcgttcagtcgctgccctacatgctgcccgaggtgcgcgagggacttgcgggaagcgccggcggcgtggtgagcaccgtttcactgggacttacgtttttgattcccgtggccctctccttctgcattggcgagagctacgaaacgctgctttttgggtgcgctgttctgtttggcgcgacggcgctggtgtcgccattcctgccgtctcccgattcacttatgtaatattcgcttccgccctttgggcctggccgacaagggcaaaaggagttggtctacttgacactaaaaaagagtaccgctgtgaccattctcaacggcatcgttaatcctctattcatgtgttcatttctgccgattgttgagggaaagcctggcttagattttcagggacttactggtttctgggggcagcttattctggccatcggtattgcacagttcgtgggttttttgccgctctttggcaaagcaattgagacgtgcgttgagttttttggttttgatcggaacactccgggcgcacggatttgcggaaccgttgtgggcgctactctgctcttctgcattatcgggctatttgaagtcgcgtttcagtcaggcgttggcgttatcgacggtgtgccgtttttctcgcgctgggttcgcctcgtggtgggcggatgggcctttgtcgttgtgggcggcttgctgtttgatccttttgtcgcggccattgccgctaaagttacgggcgaatagcgccaagaccggtcgcgtggcgaaagcctgatcgactggcagccaaggtcggccgggggattggtcggcctcattttgcccgtgctaccataaacggacattcgtttgatgggggctgccgttgtcacgcgtcttgcaacatatggaaatcccgctgctgctggcggttcctgcggtgatggctgcggcgttgctggcgggcgttgagcaggcagcgttggccatgctggttgtggtggcgctggtgcttgcgctgttctttgcgggttacgaggcttcgcgcccgggcctgcgccagattatgcccacgctggtgttggcggcgttggccgcggcggggcgcatcttgttcggtcccattcccgactttaaacccgtgagtgccatcgccattatcgcgggggcgacgcttggccgccgcaatggttttatggttggcgcgctggcggcgctgaccagcaatttcttttttggacagggcatgtggacgccgtggcagatgtatgcctgggggctcgtgggatacgttggcggtgcgctggcgtatgccggcgcttttgatcgcgccgatggcaccgtgcgtatgccggcgctgctgacctacggctttgcttcgggtttgctgtacggcgttgtgatcaacgcctacgacattatcggttttgttcaaccgctcacgtgggcgggtgccatggcgcgtcttgccaccgccgtaccgttcgatatcacgcacggccttgcgacctgcgtgtttttggtcgccctgtacaagccttggtgtcaccgcatcaaccgagtcgtcgtgaagtacggactgtagggctggttgcgccggggcgggaatcaatactgccgaagtgccattttaaaactatgccggtttacggggccagattggcacaagcagaccatgccggctatttttgaaatagagcaagccgtttacctgcggttttattatttcggaattgcgtatggttgggggttcgcgattcagccccgtaaaccggcatagttttaaaatagccggctgatacgacgggcatcgtggccctcggagagccaaattgatccgttttctttcgcctccagacgttcccagggaatcagctgaacccgcccgccacgaaatcggtctatctactacgtttggcccgacacccccaactacaaccgtgttttatgaaaaaccgtaggctttctacctgcggttttctttttgcgttgttcactgtggttgagggtagtggcttaaacgtagtagatgggccagtttcgtggcaagcgagctgcgtggatgatctcgcgaagtgaaaatgattccttttcctccgtccccaggagatcagttggggctagagctctagcgtgagggtgacggggcagtggtcgctgccaaagatgtcgccgcggatgcccgtgtcgcgcacgttgccggcgattgcgtcgcttaccaggaagtagtcgatgcgccaaccggcgttgttcttgcgggcattaaagcggtagctccaccagctgtagacgccctcgacgtccggatttgccgcgcgccaggtatcggtaaacccggcgttgagcagctcggtgaacttgccgcgctcctcgtccgaaaagccggcgttgccgcggttggacttggggttcttaaggtcgatctcctcatgcgccacgttaaagtcgccgcaagttacgacgggcttgccggtctcgcgttcaagcgcgctcaaaaagccgcgataggcatcgtcccaagccatgcgcacgtcgatgcgggcgagttcgttttgcgcgttgggagtgtagacatccacaaaccagaacttgtcgaactccagcgcgcagacgcggccctcggttacggcttgggtgacgagtgcggccgcctcgccctcgccggcgtagggtaacagcgcgtcggcgtgcagcacgcgcagcggtttctggcggctaaagaccgcagtgcccgaatagcctttacgctcggcgtagctccaggtttggtgatagccgggcaggtcaatatcgacctggccttcttgcaacttggtctcttgcagcgccaggatatcgacgtcgagttcttgcgcgatctggataaagctcgggtcctttttgagcacggcgcgcaggccgttgacgttccacgaggcgaaagtgtaagtctgaggcatggtgtcctttcgacggggttggcaggcttaagattagcgcaacaggggcggggtgggctccgcgcatgctgacttaaaggtcgcatgctgggatatcgcccgacgccgcccgatcaacaaggacggaggactcatatgacgcaggcaatatcggaccccaggcaggcgtccgccgcgctggcggatctgtttgacacccacaagcgcgtggtcttctttggcggcgctggtgtttccacggcgagcggcatccccgatttccgcagcgtggacggcctgtatcaccagcagtttgcctatccgcccgagaccatgctgtcgcatagcttttacgaggcgcatccggccgagttcttcgacttctaccgcaccaagatgatcgcgcttaacgctaagcccaaccgctgtcacaccaagctggccgagctggagcgcgccggcaagcttgatgccgtggtgacgcaaaacatcgacggcttgcatcagatggcgggctcgcagcgcgtgttcgagctgcacggatcggtccatcgcaacatttgccagtcgtgcggcgcggtctatagcgccgagtggatttgctcgcgcgagcatgaggacgccgcgggcgtgcccgtgtgccctgcgtgcggtggtcgcatcaagcccgatgtggtgctctacgaagagccgctcgacgagcatgtgttgaccggtgccgttgccgccatcgccgcggccgatgccctcattgtgggtgggacctcgctcgtggtgtatccggcggcgggccttacgcgttactttaccggcgatacgctggccatttgcaatttggcgcctaccgatcaggatgcaaatgccgacctgctgatttcttgcgacatcgcggccgcgtttgcgttctagcccgcgtgcgcggatacaatagaaagactgattgcaaagcgaccacgccgccagcgcccgagcgcggcggcgtgggcattttaggaggatgttcatggcgaacgacagcaagacatggcggtgcggaaagtacgagctcagctttgaccgtccgcgcatcatgggcgtcctcaacgtgacgcccgattcgtttagcgacggcggggagcacttcgacccggatgccgccatcgagtacggcctggcgatgctcgacgccggcgccgacatcatcgacgtgggcggcgagtccacgcgccccggatttaccccggtcaatcccgatgaggaggctcgccgcgtgctgcccgtggtgcgcgcgctggccaaagagggcgccatcgtctcgatcgacacgcgccacgtggcggttgctaaggcggccgtgcgctgcggcgcctcgatcgtcaacgacgtgaccggcttcaccgaccccaagatggtcgagtttgttaagacgagcacctgcggagtcattgtgatgcatgccggcgaggtcgccgtgcccacccgcacgcacgcaacggtgcagctcgatacctcggcagcggcgtttgttgccgagaaggcgcgcgaggcggctgccgaggccgcgcgtgaggccgagaagccggctcgtcgccgtcgcggcaagttgctgggcgagcctaagccggaggccaagcttccgggcggcgtggtgcagccctcgttgccgtttggcgatccggagcccgcgaccgagcctgcaagcgagcaggagacgccggccgccgagcaggctgctgccgccgagaccgtcgcgcccgcgcccgaggccaccgaggccgcatcggagcccaatgaccgcctggccgccatgatgcgccgcagcgcccgccgcgaggaagcctacgtgcccacctcgcagctccgccgcttcaccctgcccgattcggcgcccatcatgcgccgcgtcatgggctttctgtccgaccaggcccgcgcgctcatccacgccggcgtgtcgcgcgaccgcatctgcattgatcccggtccgggctttggcaagacggccaacgaggacatcgtcatccagcgcgagactgccaagatggcgtcactgggttatccgctcatgtgcgccgtatcgcgcaagcgctttgtgggcgctgtctcgggcgtgaccgagtccgccgcgcgcgatgccgccacgtttggcgtgtgcctgggcgctatccaggccggtgccaacatcgtgcgcgtgcacgacgtcactggctttgcgcagttcctgaacggctactgggctgtcgcaaagccgcagccgcgccgtgcgtttgtggccgtgggctccaacctggggcatcgttgcgacaacatccgcgccgcacgcgacatgattgccgagattccgcttacctgcgtgtccaactgctcgcgcatctacgagagcgagccggcctacgagacgcgccaggatgcgtttgccaacgccgtcattgagattaagaccgagctggcgccgttggtgctgctcgacgagcttatgaagatcgaggccgagctggggcgcgaccgctccaagaaggccaaggtcaacggcccgcgcaccatcgacctggacctgctgtggatggacggcgagacccacggcggcaaaaagctgcgcctgccgcatccgctcattggcgagcgcgactttgtgctggtgccgctcgaggacctgatgcacgacccggcgcggttcttccgctacaacggcgtcgaggtcaaggagcccggggaccgcgtgggccatatcgtgggcgaattggggcgtatgtagatgattgagatgaatgctgtggccgttggcaccgagcttgacgccgcgcgcgacgcgggtcgcgagggtgcgtccgcgggctggtgcgcgtggagcgtgggcgaggcgtcgctgacgttttcgctggtcgtgcgccccgatgtgaatatgcacgccttccacggcctgccgtttgtggccgcgatgggcatgatggacgcgctcgtgggcacggcttcgacgccggggttgggccttgccggtaaagtgggtatccagtggccgagcgatatcgtgtgcggtgcgcctgcgtttgagacgtcgctcgcgcgcgtcgccgtcaacggcggtgccggtgccgcgggcatgttcggtgccgtgacggtggatattgagcgctcggcgctgagcgagctcggtgtggatgtggccgacgaagcgctggtcgaggcgctgtccgccgccgtgctgacccgcgtggacgcctgggcggttgttgccaacacgccgcagggcgctgccggtccgctggctcccgtgctgggcgagtatttcgatatggtgccgctgctgggccgccaagttgcggcggtgtcgcccaacggcctgccgctcgcggtcggtgtgttcgcgggtctggacatctggggccgcgcgaccatcaagaccgatgccggcgagcaggagtttccacccgaggccgtacggattcgcggactgtaacgcgaggcgcccgcgctcaaagataacgatgacaacgaagccctcttcggcctgtgccggggagggtttcgcctatctggtgaatgggttgccagcgccctattcctcaaaattgaaaatttttcagttttgaggaataggcttggcgaacgtttgcggggctgtgacatcgggcgtgctcgacttatgtccctgttttacccccagcttctgcatgcggcggtagatttcgcagatgcccttgatggtgagctgcccgtcgactatgtcgaaggcgtcggtcgaatcggcgacgatgctggcgaggccgcccgtggcgataacggtggcgtcctcgcggcccagctcgcgcttcatgcgcgcgaccaggccctcggccatggcggcagcgcccaccacggcgccgaccttgatgcactcttcggtgtcgcgaccgatggcgtgctcgggcgcctcgagcggcacgctggcgagcttggcggcacgggcggcaagcgcgtccatggagatgcggatgcccggcgcaatcgccccgccaatgtaataaccgtcctcatcgatgacgtcgatattggtcgcggtgccaaagtccaccacgatcgccggcgcgccgtagaaagtctcggccgcaacggcgttggcgacgcggtcggcgcccacggcctgggggcgcgccgcgcgcagcttggtcacggcggccgtctgcggcccgatgacgatggcgtctgcggcaatgcggtcggccacggcgtgccactcgcgcgagagctgcggcaccacgcccgcaaaggcgatcgcgtcaaccgtatcgagcgagaggccgtacatcttaaagaaacccatcaggcgcacgtggatctcgtcggcggtataggagcggtcggtgggcatacgccacgactgcaccagctcgtctccgtcaaacaggcccatggccgtctgcgtatttcccatatcgatagcgagcagcatgtctactcccggtgttggcataaaaggacgcgcaccattgtatacgtgccgtcgacggcgctcggctgcaattcgtttacggtgataggggctgaggggtttaaatatgaaggaattatgctctacgagattttccttgccgtttaccgaactcccgcgtaatattctttcttgcgcacatgaggcgcccagacattgcggggtggagcagtctggtagctcgccgggctcataacccggaggtcgtaggttcaaatcctgcccccgcgaccaagacttttagcagctcagaggcattgttcctctgggctgttttcttttttgcctttcaatcttggtcgaattttggtcgaaatcaattttaaacagcttattttagacagggcgcctgcctgaaccagctagcacagaaactggggagtagggattacaggctgtaggatgccgacagacaagcactatgctgcctcaaatctgcattgagcttggccggggccgtctctttgcctcaaagcaggcggtgaactcaggtaatcgaacctcttcgcatttgttctctaggaactgagcgacacgctcctcgcaatttatgttgccgttatatgcggaatatcagaagagagatcgcagggcgtaagtcagtgcatgaagggctgcccgtcgttttgataatgacataattaagtggcaaactaaagcgatcggagcgaccatgattcttgatagcctgcgtaacagcgcgtcttttaatgaaaccgaccgagctattgctacctatctgctcaatcataccagcgaccttaagaccctcactatggcaaagctcgcacaggagacttacacttcgaacgcgactatcatccgcttttgcaagaaactgggcctaagcggctatcgagagttgatcatgcagctcatccaggagataagcggagactatcttctggctgccaccgttgatcgcaatcgcccttttgacagcaccgattcaattgaggccatcgagggtaaccttgcgaatctcttgaagggcatcatagatcaaacgaaaatcgagctcgatagcgccaaattaagcataatcgccaaggcggttcttagcgccccacgaatttacatctttgctaaaggggaaagctacctggcgggatgcatctttcgcaacaatcttcttaagctcgatcgtcatgtcaccatggcagacgacggaggcctgcagacgctgcatgttaaaaacggcaagcccggcgacctgtttttattcctaagctacagcggcattcactatgactattccaaatacgctgccactctttccgaacgcggagtcaagccgtgtttaattacggcgttttctgattcggtgctcgccaagcaatgcgacactgtcttgcccattccaaaatcagaacgcgtgattggaaaggtggccaattactcttctttgatttcgctcacgtatacgcttcaggttatttattcgcttatattcaatcaggactatcaagagaactatcgtgtaaaacgcgaggccgattcgttcatcttcacgagttttgctgagatctaggcatataaaagatggccccaaggcaattttgccttggggccatcttttgcgcttttggtatttgggcggttcctttacttcagctcaggccaatagcccttgttcgcctcgatcatgtcgtccaagacttccttagccacgcgtgctgagggaatcgtgcgattgagggtgaaggcttcgagtgccttctggtaggaaccttcgataacggcttcgaccacaaggccttcacaggcatcctgctgttcgataaggcccttatagaagcggggaatcttcccgacgcgaatcggttcggctcctcgatcagtgatgtacgccggaacctcgactgtcgcgtcgtccgagagattctcgattgcaccattgttgggtacaatcaccagctggcgatggcgcaggtcttttgccagagacttgacgacatcgacaatgaacctgccgtggacgcctacatagaactgcgtgagatctaccttttcaccacgcttaagcgccgcagatgcgtcgaagatgcgcttttcgcggccgtttacgacctgcatgccacgcgtgttattgatgtccatgtactccacgcaggcatcgggcaacagataatactggtaataggtgttggggaggtaatcctggaatagcgtagaaatcgttgccgcattctcgaaggtgtgggcccaatctgggtccttcaccaaggcgtcattgaggcttgcttcggaaatataaccgtatttacgcacgtgctctttgagcttatccgtaacatcgacgcccttgcaacgtacgttggtaaaccacccaaagtgattgaggccaaagtagtcgacctcaatgtcgttgagttcgcaccctaaaatctctgccatgcgggcttcaatctccactggcatatcacagatgtcaagaatgcgagcgttaggacgcagcttgtgcattgccttggctacgatggcagcggggttggagtagttgacgatccagtagtccttgcaggcatactcctcgcagaaatcgacaagctcgcacatggggaagatggttctcatgccatatgccatgccacctgccccgcaggtctcttgaccgactacgccatggcgcaggctgatttgctcatcctggatacgcatcttgagcccgcccacgcgcatctgcgccataacaaagttcgcatctgtaaacgcctctttggggtcgacggttacatgcaaggggatctcgggagcaaggtcatcgataaccgctttaaccaccacggcgactgtgtcttggcgctcctcgtcgatgtcatagagccaaagctcgcgtattcctaattcatccttttggtcgatcagatctttgacgatgccagcggtataggtgctgccgccgccgcagatgacaatcttgtatccgttcatgttgttcatgcctttcaaatcaaattgagctgcagacaatcttggtcactatctgcacgaagtaggtagcgatgttgatgaccgccgccattcctgcaatgctgcctgcgtccgcgtgccttcctgaacgccgggtccaaaccgcagcgagtagacccaggagcggccagataaaaccacatgcgaatgcagccataagtacgagaagaccccttgtcgacttttctttgtacatgttgagcaggcgttcgaacatgcctcggattgaatgaaacgttttggtcaacatgaggtctcctcgcttatcgcctgtcgattaggcgatcgttaatcttccagattaaggatgggacgtagcaggtcgtagacggagtgcacgttggttcccacaacaatctggacattggtaccgttcttaaacaagcccttgtcgatagccttcttgatggtctcttcgttgaccttgttgggatctttgacttcgacacggagacgagtcatgcagcagcccatggtgttgatattgtccttgccgccaaggccgttgatgatgttctgcaccatctcctgctgttttgcgtcgacttccggagttccggaggactcgagggcattgttgtctccggagacttctgcagaccactctgcggaacggccgggcgtcatgaggttgagtttcttgatcaccatcgccagaacgatgaacgaaacggcggcaaacacgatgcccaagacgatgtaaatcgggaacttggtgacgcccattggcaaaggcaggccgagcgtgagcagctcgatgccaccgtacatgttaagcaagcggactcccaggacaaacaggagcatctcgcccagtccgtagaacaggctgtaggcaacccagagaatcggagacgcgaacaggatcatgaagtcgagcggctcagtgatgccggagagcatggcggtgatgtaaatgggcaccagcatggctgcgacagcttttcgattctccggacgggaagtcgcaatcattgcgagcacggtgccgagggttacgaattccttgccaaagccgaacatggcaaagcggacagaggggtcgactgtggtgagggatccgtcagcgatatggggaagctcggcatagaagatgtttgctgcgccggaaacactctggccggcgacgaccgccgtgccgccaatcgcggagtagtcaaacggcatccacataaagtggtgcatgccgagaggtacgaggacgcggttcaggaagccgtaaatgaaaacgcccagaccacccgaggctgcgatgaatgaagaagcgttgctgatggcgttggcgatagggggccacacgatagtcgctccgatgccgaagacaatgctcagcggaaccatcgccagaagggccaggcgaggtccgccgtaaatccggatatactccgatacctttatgtcgatcagtttgttatagagccaaccgcagaagcatccgatgagtacgccgccgaagacgttgacatcggtaacttgaagacccagtaccgttgcctggccagtgccatacagacccatcgcgccggcttttgccagctgatcggtgagcgtcaggtaggcgttgttgacatacaggaacatgaggtaactaataagtccaaacactgccgcgttggatttttgcttctttgcgaagcctgccgtaaggccgactgcgaaaatcaccggcaggttgccgatcaccgcggagttggttgccgcggagagcagcgtgcccagatctgcgacaactccgctgccgagcgagcataccgtggcgatggccaaaatgatgcccgttaccgaaaggtacaaaatagggtcgacgataacgcggccaaagttctggaaggccgttttgactttatccatctcttcccctctcttaactaatctcggggacttgccccttgggcagaggaggcgctcacatgcttgccggcgttggatgttgatgtccgcctctgtttactggcttcatgatagttagcgtgttcgcaaaacatgcggggcggaacaaacggtgcttaaaaacgagcttgatagtctttttcgttgttaccatctttccacttcggccagcggtatttatttttaggcaaacggctttgggtgcgagcggctggtcgtgtcttgatttgccaggtccgtctctattcgcattaggcttgcgtgaagtttggatattgaggagacgttccgactcttgccatccgtgcatcctggaggaaaggaggaggagccgaaaaagctcttcccaacagaggactatgaatacaggctggatccgtcgtatgagccaaaggacgaaggaggaacagacgctatgcctccagcagagcccaggaacaaccgggtgttctctctgctccagaaatacaaccggcatggtcttctggttccagttggcgccgaccatatgtggaacgcggcgatggagagcaagttctgccggttgacgctcctcggcaagcattatcgaaggcttgcggaccagggcctactttgacatgttgactaacgaggctttcagcgatcatgctcaaactttagggcttgtggcaagaggtcggataacgctcaagccgtttgatgctcatcgaggagctttagcttctcgatgagcatcttcgtcagctcctcgtcttggatgaggtctatgccgaagcacttctttcccgcgtccttgagggatgcgccgatgtgatacgcggtcgcaccgtcgaggataaggaagcggtcgtggaacgttctggtgcggcggacggtgagctgcgggtactgtgcgttgaacacgtcgacatcgccttgcgtgagccggttgccggacgtgtagacggtcaccgcgacgcccttgcgcttctttgcgaggatgttcagggtgtggacatctacgtagccatccacgagggagatttcgcgctcggcgcggcccacgagatctgtcagcaggctgaaggcgtcgaacatctgcccggcgaagaagatccgctggggtttctcgacctcgccttcgagcaggcggaacacctggttgaaacgctcgttggtcgattgctgaaacgccgcctgactcaactcgacgccgcgcagccgctcaaacagggtggcattttcggcgaggaggtggcgcatggcgacaaacgccctcatgatactgatactggtctgcaccgccacttcgctgcgtagcacgccggacagcatggctatgccctgctcggtataggcataggggagataacgtcgcccgccgcggccctccatggtctttgaggttccaatttggcacctcaaagactcgtcctcctccttggtcagttgaaaacggaagtcctcggggaatctgtcggcgttgcgtgcggcggcgcggttgagattctttgtctctacctcgtataaccgagcgagatcggtgtcgagcatgatttgctgcccacggacggtatggattaggggctctatgtttgcggaatcgggcagggctatcgacgcgctcgtttcgaccgattcgtcctcggcatcaaaatcgctcatggttcctcgattcaaagatggggacgctcctgcgtcgaaagcattttatcatcctgggctttgtcgcctgccggtccagcggcgatgacccctgacgttagggagggagtgtgcttcgtcgtggcgacgtctgccctaagcctccctcgccatgacggtgatccggctcccgtcgatggtgatgggcgcgcccgccccgcgctggatctccaggagatcggcggcttcgcggtcgttccctcccatcatgcgcgcgtacacgtccatcgtcatgctcgacacctcgtggccgagcctcccctgcacgctcttcgggtcgatgccgttgccgatcaggaaggtggcctgcgtatgcctcagctcgtggaaatcgtagccgacgtagcgcctccgcttgcggccgccctcctccatcctgccgaggccgtgctcgatgaagtagcccttctgccacgtcgagaagttgccggggtcgtggaagccgaagtcgctgtccgagcacaccggggtgtccggggtctgggagaggccctgaacctgcatccgcctcgccttcgagcgggcggaatatccggtcgaagcgctcgtcggtcgaatagaatggtcggtctatttcgcacctttgtcgcagtaatgtcgcacctctgtcgcagtaatgtcgcaccttggccgcggtggcatcgatgacccaaggggttacccctttgtcgctccccatggctaactaatgccggcgtgcaccggcgcggcgtgaattagggaactctgctgtggggttgggaacctttactgggggctgccgttggccaaatcccatcccggacatgacggtcccgtttccggacattcgcggacaatgtccggaaacgggctaaaaatgtccggaaaagggatgaaatgtccggaattgcggggttggcccacgcccgggctgccgtggcgcggtcctcggtatgacggcggggcgatgccgtcggcctgtccgcttttccactcgggcttctggtctctagcctctcaaacaaaatctcgatctgtaacaggtgggcccgatttgggtggctagatgttacagatcgagacaggccagcgcgccggtttccgtttatctaaatctgtaacacgagggacggattttgccgagtagctgttacagatttagatcttccggcagcacggttcggtttgtctcgatctgtaacacctggggtcgtttttggccgatagatgttacagattgagatgttttgttgggacggtttctgttgtctcaatctgtaacaggtaggaaccaaaagtcggtctagatgttacagatctagattgttgaggatgggttgagagaaatgtctcaatctgtaacatctagggtcatttttggtctgtaggtgttacagatcgagattttccgacggaacgcttccgtttgtcttgatctgtaacaggtagaccccggttttgctgagtaactgttacggattgagacaaaccgacgggccgccccgccccatccacctgccgctacctgctgtctgccgatttccgttgcgccactgtgctcccatgccatatcctctaaacaactacgcggcaacatcgccgccgcgcctacaagagaggaatgtccatgaccgcacccgcatccaaactgctccagcccattacggttggcccccttgagcttaaaaaccgcattatgttcccgccgctgaccaccggctacgaggagcgcgacggttccattggcgagcgcagcctggctttttacgagcgcctggcccgtggcggcgtgagctacatcgtcatcggcgacgttgctcctgttatgaccgcaagccccacgcccaagttagcgaccgacgcccagatccccacgtttaaggcgctggccgacgccgttcacaagcacggcgccaaggtcgcgctgcagctgttccaccccgagtacgacgtgcccggcgtcggccgcatggtcatgggttccatggccgccgccaaggctgcgcaggaggccaaggccgccggcgacgaggagacctttgccgccaagatggccgagtccaacgagatccgcaagcaggcctacgccaagctgcaccacgacatgcagcactttgtgaacgaggcgagcgtagagcagctcacccagatcaaggaggccatcgctgcctcggccgcccgcgcgcagcaggccggcatcgacgccatcgaggttcacggcgaccgtctggtgggttcgctgtgctcggccatcctcaaccagcgcaccgacgagtacggtggctcgttcgagaaccgcgttcgctatgcgctcgaggttgtcgccgccattagggaagccgcgccgcagctgatggtggagtacaagctccccgtgatcatggagaaccccgacggcacgccgcgcggcaagggcggcctgcagcccgatgaggcctgcgagtttgccaagctgctcgagggcgccggcatcgacatgatccaggttgcacaggccaaccataccggcaacatgggcgacaccattccgcccatgggcgccatgccctacaactggacgctgcccgtggccgagcgcgtcaaggccctggtctccgtgccggtggcaaccgtcggccgcgttgtctcggtcgaggccggcgagaagatcctggaagacggttcggccgatatcatcgcgtacggccgctcgctcatgtgcgaccccgacattgcgctgaaggccgccacgggcgagcccatccgcgagtgcctcaactgcaacaagggctgcgtcgacgcgattcaaaaccgcaagtacatctcgtgcgtgctcaatgccgagaacggagacgaggcgaccatcgccattaagccgggcgagggcgacaagaagattgccgtggtgggcggcggtattgccggcctggaggccgcgcgcgtggcggccaagcgcggctacgacgtgaccgtctacgaggcgagcgatcatctgggcggtcagattgtgctggcggccgcgcccccgcgcaaggacgagatcatgcgctcggtcgagtactacgagaagattctgcccggcctgggcgtgaaggtcgagctcaaccatgccgctaccactgagggcctcaacgccgccgacgccgcgattgtggccgtgggtgcgcacgacgtggtcatccccgttccgggcgctgactcggagaaggtcgtctcgagctgggatgtgctggccggcaaggcggagcttacgggccgcgtcgccgttatcggcggcggcctggtgggcaccgagactgccgagtacctgctgcagcacggctgcgaggtggcgatcgtggagatgctcgacaagattgccgcgggcgagtccgagaccattctgccgctgattatgagcgactttgcagagcacaacgtggagcagcacgttaagacccgcctgaccgccattaccgacgagggcgtggaggccgtgcgcaccaccgaggatggcgccgaggagccggtgaagatcgcctgcgattacgtggtgatggccgtgggctccaaggccaacgcgtttgacctggatggcgtgacggtgcccgtgacctgcgtgggcgactgctcgggcgagcgtaccgccgatattgcgagcgccattcgcacggcgtatcacgcggccaacgagctgtagttgaacatcgcggccaggcggggcggtagcacggatccgcctcgcccggctgtgtcccgtcgggtgtcaaccggtgcggggcctgcaagcgcagcaggccccgccctttttgttttgctccggtggatggtaatgcgcggtaatcatgaggagtaaggacgtctactgccttgccgattactcaaaattattgggggaggggttaataatcatatccgctatagcaaaggacataaagaggtgtcaattttgttgacaggcgaatgacgattggctgcgagtcagctaccagcgtaaataatcgataaagaaatgtcgtaaattggtgccaaatgcccagataacgccgcgtctattttaattaactgctttgagcaaacagtaaaatgctactatctaacttgcacgtaagaaagcagattaacggttaaggctaagaagtggcaggtatgtcggaagcaactaggactcgcacgcatgcgcccgaggttaggcagcgcgccgtcgagatcctccaagagggggtcggtcatcgcgccctcgccgcggagcttggcattccccaggccacggctcgtcagtgggcccgcgcgtatgccgtgggcggtgccgacgccgttctcaacgccggttcgcatcatcacacctattcgtacgaagttaagctcgccgtggtcaaggaccgcttggaaaatggcttaacggttcgcgaggccatgatcaagcacaagattcccagcgagtcttcggtcaaggcttggtgccgccagtatcgcgagagcggtgagtccgcgctggtcgataagccgcgcggtcgcaagccgcgcgttaaaaaggcggaatagcgaacgggatggtgcgcccacaggggcgcatttttcttgccgcgccaactttttggaccgtcgtgagcctactggaacatcctccaaagtggttaataaaccgcgcgcagtggcccgtgcgcccgccgccgcgatagggggagcgtcgcctctctgctccaaagcggacagactccttaccccgtacgcctaaaactccccagttgaccgaaaacccgccgccgctactcctcaactgagctataacgttaaacaattgcagcgtttttgcatgggggagtgatggtatgacgctactgtatttccttaccctgtttccgctggtaccggcgctgggcatgctgctcgcgcgcggtgaccgcgcccgcgatgcggtagggcttgtaggctccggcattattatggcggtgacagttgtagtcgccgtcatgttttttggcacgggtccgcagagctttgaggtcgcccccggcacctcgcatgtgctctcgatcttcagctccgtcatcgacgtaattctgtgcgccgtcatcctgtacaacgcgtacaaatataggaacgcgcttaccggtgtgctcggcgtggtgcagctggtgggctcgctcgcctttgcagctatgacgctgcccgcgaccgaagccgtcacggcaacgccactctaccttgactacatgagcgcgatcatggtgcttgccgtcggcatcgtcggcagccttatctgcgtgtacgccctgggctacatgaaggacttccaggcccacgacgagcacgaggccgcgctgcgcgggcagaccgcgcccgaccgtcgcccgcagttcctggcgcttatgttcctgttcctctcggccatgttcgtcattgtgacgagcgacaacctggagtggctgttctgcggctgggaaatcaccaccgtgtgctcgtttcttatgattggctacacgcgcacgcccgaggccatcaaaaacgcctttacccagatcatcctcaacatgctgggcggcatcgcgtttttggcgggccttatgttcctgcacttcaacggcatgccgctgaccatctcgggcatgattgagctttccggcgctggcaccgcgcagtccgcgctgctggtgatgccggtcgtcctactgtcgctcgccgcccttaccaaagccgcccagatgccgttccacacctggctgctcggcgccatggtcgcccccacgcccacgagtgcgctgctgcactcgtccaccatggtcaaggccggcgtgttcctgatggtcaagctcagcccgctctacgccacctatcccgtgacgggctttatggtcaccagcgtgggcgccatcacgtttttgcttgctgccctcatggccatctcgcagagcaacgccaagcgcgtgcttgcgtactccaccatctctaacctgggcctcatcagtgcctgcctgggcgtcggcgcgcccgaggccgtgtgggccgccatcttcctaatcctgttccacacggtggccaagtcgctgctgttcctgtgcgtgggcaccgccgagcatcatatcggcagccgcaacatcgaggacatggacggcatgttcagccgcatgccgcacctgacgcgcctgatgatgctgggcatcatgggcatgttcgtggccccgtttggcatgctcgtgtccaagtggggcgccctggtggcgttcgcgcagaccggcaacgtactcatgatcatggtgctggcctttggctcggccgcgacgttcttcttctggggcaagtggctcgccaagctttcgggcgtcgaccccacagctcaaaacgtggaggtcaatgtccacaagaccgagtggacggcgctcaacaccatcgccgcactgctggtgctgtgctgcgtggcgttcccgctcatctcgagtggcctggtttcgccttacctggccatggtgtttggccgcgtgccgcacgttattggcaaggacgccatgtatctgatggtggtcatcgtggcgtttatcgccgtggtgctgctgacctcgttccgcgtgagcaacaagccgcacgtcaacgtgtacctttcgggcgttgggaccgagagctaccgtcatttccgcggctcgatgggccacgaggtaaaggccgaaaagcgcaatttgtacctggaggatgcccttggcgagaagcgccttggccccgccggcagcgtcgtgtgctgcgcgattatcctgtttgcgctgctgtgctgcgcgtggattgggcccgagcggcttgccatgagcgcgccctcggtgctgcgcggcaagtatttcgaaggctcgggcgtcgtgggcatttttattggcaccgtggcgtttgccctgatcgcgccgcttgtgggcggcctgatcgacggtcttgaccgcaagctttcggcccgcatgcagggccgtgtgggcccgcgcctgctgcagccgttctacgacgttgccaagctgctgcgcaaggcccctgccagcgtaaacaccatggacgatacctatatggcatgcgcgcttatctttaccgtggtgggcggcggcatcttcgtgtcgggttccaacacgctgctgtgtgcctttatggttacgctcgccgcgatctttgtggtactggcgtccgcctcgacgcaaagcccgtttgcgcaggtcggcgccgaccgcgagctgctgcaggttatgagctacgagcccgccgttttgctgatgagcgtgggtctgtatctcgccaccgacagctttgactccatcgccgtaaccggacaatccgcgcccatcgtcgtgtacagtgcgcccattttcctcgcgctgcttgcggtgctcaccatcaaactgcgcaagtcgccgttcgatctttcgtattcgcatcacgcgcatcaggaaatcgtccagggcatcgccaccgagatgagcggcggcacgctggcaaagatgacgctcatgcactggtgcgagaccgtgctgtttttgatgtgggtgggcatgttctttgtttgggacaacccggtgagctgggtggttgccctggtcgtcatggccgcgacgtattttgtcgaggtgctgatcgacaacaccttcgcccgcagcacctggcgcagctgttttaagctcggctggggcgtggcgctggtgtttggcctgctcaaccttatgcccatcctcgtcgacgtgtttatttaggaggcggcatccatggatcataaaatgtcgcgctcgccgtgggttattcattacgacggttcgagctgcaacggatgcgatatcgaggtgctggcctcgctcacgccgctgttcgatgcagagcgctttggcgtggtcaacaccggtaaccccaagcatgcggatatctttttggtgacgggttcggtcaacgcgcagaacctgcccgtcgtgcgccagatctacaaccagatgctcgagcccaagtgcgtggtggcatgcggcatttgcgcatgctcgggcggcgtgttccgcgatgcctacaacgtaatcggcggcgtggatcgcgcgattcccgtggacgtgtacgcgcccggatgcgccattcgccccgagaccgtgatcgatgccatcgtggaggcgtgcggcattctggatcagaaggaggccgtgctgcgcgccggcggcgatccgctcaccgtgggcggcgccgctacctgggacggtggcgttgaactgggcgagagcgggtttgtggccgctgcggaggccggggctggcgatgcgcccgcggctgacggcgcggtcgcggctggtggcacgtccgacgagcccgccgctgcaaaggaggccgagtaatgcaaaaggcaatctataccaccgtcgggatcgatgagttgctgccgcatgtgcaggcgctcaagggtgccggcgcgcgctttgtgcagatgcacgccgagcgctgcgtggacgacggttcgtatcgcctggtctatacgtttatcaacgtccgcgccgccctggatcacattgcgcaggacggtagctatgcgattgagaatctggtgatcgagggcatcgatcagtaccaggagatcccgtccatcagctcgtactatccagcggtgttcccgtttgagaacgaggctcatgacctgtttggccttgccatcaccgatatgcagatcgactttaagggttttttctaccaggtctcgactgccgagcccatgagcgtgatcacgcccgaggtgaaggccgcgcgcgagaaggccatgaaggttcgcgccgctgccgaggccaaggcgcgcaaggccgcggccgaaaaggccgccgctgccgcggctactgcgggggagggcgccgcagatggcagtggcaccgcggacgctgccactgcccagcccgctgcggccgccggctccgatgctcagcatgacgaggctgccgccaaggccgcgctcaaagccgccgagatggaggcaaagctcgccgccatggatcccgagaaagtggccagggtccgcgcggcgcttgccgccaaggccgcccgcgacaagcagaaaaaggaggcgtagggtccatggcacatcgctccgttattccgtttggcccgcagcacccggtgctgcccgagccgcttcatctggacctggtgatcgaggacgaccgcgttctcgaggcaattccgcagatcggctttgtgcaccgcggactcgagaagctcaccgaaaagcgtgacatgcaccagtttggctacatcgccgagcgcatctgcggcatctgcgccgtgggccacagctgcggctatgccagcgcctgcgagcgcatgctcgacatcgaggtgcccggccgcgtgcagtatatccgcaccattttgcacgagctgtcgcgtatccactcgcatttgctgtggctgggcctgctcgccgatgcctttggttttgaggcgctgttctatcgttcgtggaccctgcgcgagcagatcctcaagattttcgagagcacctgcggcggccgcgtgatcctgtcaatcaacgagatcggcggccttaagcacgacatcgaggactccgaactggcgggtattgtccaaacgctcgatgctatgcgtcccgactacgagactctggtgcatacgtttttggatgatgccagctgcggcgagcgcctgcatggtgtgggcgtgatcagcaagaaagacgcgctggagctttcgatggtcggtccgttcggtcgcgcctcgggtgtggattacgacgtgcgcatgttcggcgacggcgcctatgcggacttggcggcgtttgagccgattgtcgccaccgacggcgactgctatgcccgctgccaggtgcgttgcgccgaggtcacgcaggccatggacattatcaaggagctcgtggccaagattccgcacgatggtatcggtgaacgcacaaagctcacgccggccgacggtgcgcgcggcgaggtcgtgattgagcagccgcgcggcgaggcgtattactatgtgcgcggcaacggcaccaagaacttggatcgcttccgcgtgcgcacgccgacgtcgcaaaacctggcgggtctgacgcacgcgctgcagggcgtgctcattgccaacgtccccatgattatcctgaccatcgacccctgcattagctgcacggaaaggtaggcgcggcatgagtttgctgacatttgccaagacggccttgggttctatggtcaagcagccagtcacggtgtgctacccgcaggagaagctcgcggcgcccgagcgcctgcgcgggcatatcgtcaacgacatggacgtgtgcatctgctgcggcatgtgcgcacggcgttgcccggcgggcgcgctcgtggtcgatcgcaagggcggtacctggtcgatcgatccgtatgcctgtgtggtgtgcggcgaatgcatcgaaagttgccccaagcactgcctgagtatggacaccgcccgcaccccagtcgcggcggacaaaactctcacggtagaaaccaagccggaatagggtcggaatgggactggtatagcgctggaataggggccggcggggcaaaaatgccccgccggccccgcacatgagcgcgcggttgggtcgccgcgagcaaaaccatgccggtttactacgatgaatcgccaatctccaaccacaccgcatttggtaaaaacagaaccgcaggtagatggcttgcgattttgcaaagaaagcgagtgtggtcggggacttcgtatttatcgtagtaaaccggcatagttttgaaatggcaccgcatcggtaacagcccctaatcccccggggatggaggaaaacggatcattttggccttgcgagggcgtcctcgcgacccgtccgccacgaaatgggcccatctactacgtttgggcggccaccctcaaccacagcgaaaagcgagaaaagaaaaccgcaggtagatggcctgcggtttttcgtaaaacgctggtatggtcggaggtatcgggtcaaacgtagtagatgggccggtttcgtggcgagcaccatcaattgatcccccggggacggaggaaaacggatcattttggcccgtcggctccgagtcgcacctgttttcctgcgaaaacgctgtgtctcaactttggtgagacatttgtctcacgctcaaaaccgaatctggaacgtgtgtcacctgccctaattgtgtctcattccgtaactttaggctgatgcaaggtctagtcctgcgagaagggagacacgatgggtaagtacacgaggggtctcttggcggtgatactggccgtagtgctggtgttgccggctgcagcattcgccatgctgcccgaggccaacgccaggtccagcaccggaatggacgggccgacagtgagcgggccgacggtcgtcgaccccgacaccaccggacgctgggaaatctgggcggccggccacagcggcaataaagtaacgactcaaaacgtcggtcgaatctggaccgacaagacggtcgtggcaaccggagaaaacgaagagtcggatttcttgactacgctttcggcgatgtcctcgacgtctaattcaaaggtgacggttaccacgccgcttgacatcgtgatggtgctggatgcctctggctcgatgaatgatcctatgggcggtggagattccaccaagcgtatcgatgcactgaagaacgctgcgaacagctttatcgacaccatcgccaaacaaaacgagggtatcgagggcgtcgataggcagcataaggttgccattgttaagtttgcgggtgatgagaccgataaggtcggaaacgacacgtaccgctccggcggccatagctacaactattcgcagacaatgcaagagttgacggcgtgcacggttggcggcgcaaagggtcttaagggaacgatcgattccatcaagcctgctggcgctacgcgtgccgattatggtatgaaacaagccgagaaaaacatcaaaacttctggtcgcgcagacgccaagaagatcgttgtgttctttaccgacggcacgccgacaagcttcagcgagtttgattcgggcgtcgctaacactgccgtgacggctgccaaaaacatgaaggacggcaaggccaccgtttataccattggcatctttaacggtgcgaaccccaatgccagtgtccaagattcgatgacaagccaagagaacaagttcatgcaggccgtatcgagtaactaccccaacgctacggcatggaatactcacggcacacgtgcgaaaaactccgactactacaagtcggcgaccaatgccgatgagctcaagaaggtcttcgacgacatctcaaaggccatcacgtcggaagcacctcacccgaccaaaatcgacaagggctacgacgcgaccaagtctggctacattacgtttaccgatgagctgggcgactttatgcaggtcgacggttttatatacaacggcacgacgtttgacaagccgacaaagaccgaggacaacgtcgacacctacacatttacgggtgatgccgcgaacctggtcatcaccgttcagcatgccaaagagggcgagccccggaccggcgatatcgtaacggtcaagattcctgcgtcgttgattccgcagagccactttaagaacgaaaacggcaagctttcggtcgacaacgttaagcccattcaggtgaagtatgcctcgagcgtgaagaaggtcgcactcgacaatctgtttacgcccgagaaggtcacggggctcaaggactacatcgggcataatacgaccgtcgtcgacggcaccgagaccgtgaatttctgcgcgaacaagtggaacggcggcgagctgggtgatacggttgcgacctttgagccggccgacaccaaccgctactactacttccagaagcagacgcacatttacacggataaggaatgcacgaagccggcaacgggctcgctggctgatgacgacacctattactacaaggatgagtttgaggagcagggcgagaacggcgaggctaagcccgcgaccgccgtcatcgaatttatcggcggcgacgccgcgaagttcgacggcgcgattgttcccgatgagaacggtaacttggtgtttactgtgggaaccgcacgcctggcctttatcgatgagcttcacaccaccaaggagagcgtgggcggcaacaacacccataccgcctccgatgtgctcaatcccaagtggaacaacgtgtctgccaaagcggccgcgacgcatgtcaactcctacctgggcaacaacggcaagatcagctataagtacgacatgacgccgacgacggtgaacaccaaggccggctttggcctgaccaaggtgctcgaaggccgcgcctggagggatacggacaggttcgagtttggtctgacgtccgagggcaacgccccgatgcccgagttcgcgactgtgcccgtgaccaagggcgatctggatgacaagggcaaggctgccattaacttcggcatgatcgaatacaccgagccgggtacgtatgtctacaaggttagcgaaaagaacgccgggaccacggttgacggcattgcctacagcaagaacgtcgcggagatcaccgtgacggtgacgcccaacaagaagggcgtgctcagcgctgccgtgcaggtgacttggagtgaagcaggcgaggacgagttcaagaacgtttacactgcgaagtctgttgagtccagcgttaccgacaagattgacgtgaccaagtccctgaccgggcgtgaccttacggccggcgagttcagctttgagctgcgcgaagtcgtggacaaggaagttaagcctgtcgagaccgttacaaacgacgccgacggtaaggtgacgttcagcgccatcgagtacaaagaggtcggccagcacacctacaagctgcgcgaggtcaagggtgacgccggcggtattgcctacgacgaaacggaatataccatcgtgacgaccattgccgacaacggcaagggcaagcttgtggctacgcacgagctaaaggacgccaaggacgccaaggacgccaagagcatcgagttcaagaacgtctacaccacgaatgatgccgaggcatcgcttgtgggcatcaagaatctgcaggttcctgatggcctgatcccggccgacatcgccggcaagttcacctttatcgtgaccggtgaagagggcgcgcctatgcctgcgagcacgagcgtgaccaatgacgccaagggcaaggtcaactttggcgagatccactttacgctcgacgatcttaacaatgctctgggcgagaagcccgagaagcgcgagcacacctttacctacaccgtgaccgagtccggcgaggtggctggcgtgactaacgacgccaagccttcgcgcacggtttccttcaccgtgaccgatgacggcaagggcaatctgaacgtgtcccgcaagccggacggaaacgcggccttcacgttcaccaatacctatagcgtgacgcctgtcgactccagcgtcacctaccagatcaccgcgaagaaggtcctggacgggcgcgacctcaaggacggcgagttctccttcgagctcgtcgagggcgagggcaaggacgccaaggtcgttgccaagggcaccaacactgccgacggcaagatcgcgatgggcaagatcacctacgacaagcctggaacgcacacctacacgctgcgcgaggtcaagggtaacgtcggcggcattacctacagcaccgccgagtacaccatcgtgaccaccatcgccgacaagggcgacggtacgctcgaggcgaagcatgaactgaagggcgccgacgaggcgaagttcaccaactcctacaagcctggttccaaggactccagcgtcaccgacaagattaccgcgaccaaggtcctgaccgggcgtgagtctggcctcgcggccggcgagttccgctttgagctcgtcgaaggtaacgttgttgtcgctaccggcaccaacaatgccgacggcaagatcatgatggatcccgtcacgtacaccgaggtcggcgaacacacctacacgctgcgcgagtccaaggccggtaccatcgagaacggtgttacctacagcaccgccaagtacaccatcgtgactacggttacggacaacggcgacggtaccctcagcgtcgagcataagctgcagaacgccgagaaggcgatcttcgagaacacctacaagccgaatcctggcaagtcgagtgtcaccgacaagatcgcggcgaccaaggtcctggccggccgcgacctcaaggccggcgagttctccttcgagctcgtcgagggcaacgacgtggtcgccaccggtgccaatgacgccgacggcaacattgcgatgggcgagatcacctacaccgaggccggcaagcacgcctacacgctgcgcgaggtcccgggcgacgccggcaatggcatcacttacgacagcaagacctacaccatcgagacgaccatcaccgacaacggtgacggcacgctcaacgctacgcatgagctgaagggagccggcgaggcgaagttcaacaacagctataagccgaaccccgacgagttcagcgtcaccgacatggtcaaggcgaccaaggtcctgaccgggcgcgacctcaaggctggcgagttctccttcgagctcgttgagggcgagggcgaggacgccaaggtcgtcgccaccggtaccaatgacgctaccggcaacatcacgatgggcgccgtgaagtacaccaagcccggcaagcacacctacacgctgcgcgaggtcaacggcggaaccatcagcaagggcatcacctacagcgacgccaagttcaccatcgagaccaccatcacggacaacggcgatggcacgcttagcgccaatcacgagctgaagggcgacaaacctgcgaccttcgagaactcctacagcgtgaccccgaccgatgcagacctcgactttggtctgagcaaggccatcgacggtcgcgagtggacggatggggacgagttcagctttaccatcaccgctcccgacggcaccccgctgcccaatcctgcaaccgtaaccgtgagcaagcgcgacacgaaggacggcatcgccgccatcaagttcggcaagattcgctacacggctgccggaacctacaagtacgagatccgcgagaacgcgggcagcacggtcggcatgacgtatgacgcccatgtcgcggccgccgaagtgaccgtgaccgaggacggcgagggcaaactgaccgccaacgtcaccaagaaggaaaacggacgctttaccaacacgtatcgcactgagcttaactacaccgcggccggcggcctcaagctcagcaagaccctctccggacgtcccatgaccgagggccagttcacctttaccgtgacgcccgccgacgaggcttcggccaacgcgcttggcctactgcccgtcgccaacgaattcaagtcccccgcgacggcagagggaacggtcggcctgattgacatcctggctggccatgaggtcaagtttacgcaggctgacgccggtaagacctttacatacaccgtggccgagaagaacgacgaccagcccggctacacctacgacgacgctgtccgcaccgtgacgatcgctatcgccgacgacaccgccggtacgctcaccgccacgacgactgtttctggcggttccgagggcacgctggtgaccgagtacaagactggtgccgctgcggtcgagagcgccgtggtcccgttcgtcaacagctacagtgctacgaccaacacgactggtggcgccgctgctcaggtcgttgccgccaagaccctgaccggtcgcccgatggccgacggcgagttctactttggcatcgcctacgcaggtgagaaggaagccatcgagggcacgtgcactaccaacgttaatgggcatgtaagcttcggttccctgcattacaccaccgagatgctcgccgacttggtgaacgccaagcgcgctatccgcaccgataaggatgccaagcctgcatggaccatcggctacaccgcctttgagttcacgccgcagctcgcagccaagggcatcacggccgcaacgccgagctttagctttaaggttattgtcgtcgataacggcgacggtaccctgacggcaacgcctgtctacgacggcattgagcccctgttcgagaacgtctacggcaccgatgccgttgatgccgcactcgccggcaccaagaagctccaggccgccgaaggcctgaccccggccgacatcgcgggtaagttcacctttaccgtggccgctgacgaggcgggcgccccgatgcccgagcacgcgaccgcaaccaacgacgcggccggcaacgtggactttggcaagatccactttacgctcgaggacctcaaccgcgccctgggcgtgacggacgacgcgaccgacaagaccgaagccaatgaagccgaagccgatgaagcaaatgccgacgaggcagagaccgacgaggccgacgttgacgttatcgctgatgaatccgagaacgagaacgagcctgccgccgctactccgcgctcgcacacctttacctatacggtgtccgagtccggtagcgcccctggcgtgaccaacgacgccaacgccacgcgcaaggtttcctacaccgtgactgacgacggcgccggacatctgagcgtcgtgcgcgagggcgacgacggcgcggccttcacgttcaccaacacctacagcgtggcgcctaccgattctgtggtgaccgatcaggtcaagacggtcaagcgtctgatcggacgcgaccttgcagccggcgagttcacgtttgaactgctcgaggacggcgtggttgtcgcgagcggcaccaacgacgccaacggcaccgtcgcactgagcccgatccgctacgaggcgcccggcacgcacacgtacatgctgcgcgaggcttgccccaacgcgctcggcctgtacaagggcgtcacctatgacggcgcgacctacaccgtcgtgaccaccgtctccgacaacggcgacggcacactgaccgcgacgcacaagctcgagggaaccaccgagtccgctggctttaccaacaagtatcacgccatgcccacgcaggtctccatcggcgcgatcaaggtgctcgagggacgcgagctcaagaaggacgagtttagctttaagctcgctggtgaggacgtcgagtccaccgtcaccaacgatgccgacggcaagatcggcttcgacaagttcgagtacagcgagcccggaacgtacgtctacaccatcagcgagatcaagggcgacgaggccggcatgacctacgacaagtccgtctttaccgcgaccgtcaacgtggttgatgacggcgagggcaacctcaaggcgagcgttgcctataccaagggcgacaagagcgtcgagggcatcgtgttcaacaacacgtacaagaagcccgaaacgcccgtgccgacgcccgaccccggcacgcccaagaccgtgacgaacatcgtcaagacggtcaagggctatctgcccaccacgggtgaccagcaggcagccgcgctgctcgtggcatttgtcatcgccatggctggcgttggagccctggtctggggtatccgtaagcgctaggcacgtcgacggagcctggggccaaaaggccccgggccgccggcggggagccagaaacatagcccctaccccacccccagccgccacggaggcatctccctcctccgtggcggcacttttgtgcgaccgctcataagttgcggtgaaatacggactgtttggcggccctagggggcacagcagtccgtatttcaccgcaactgagtcgccgattctttgagttatccgcgcaggtaggcgatggcgatttgggtgcggttgcgtagacccattttggccaggatcgagctgatgtggttgcgtacggtgccttcgcccatataggcggtggcggcgatctccttgttgtcgaggccgcgggcgatgagctcggcaacttcgaattcgcggtcggtcaggccggtaaaggctgcgggccggcgggacgcgcctgtcttgtcgcccatcccgtcaaagtcaacatcctcgattgccttgccctcgagcatgcgcttgccgtccatgacctgcgccaatgccggcggaatggcggcgacatcggtcttgatcaggtaaccgcgggcgcccagcttgagcgccgacacgatgtactcgtcatccgaaaacgtggtcaggaacaccacgcgtgctgcggggtcgcgctcaagaatctcgcgtgccgccgaaagcccgtcgcgcctcggcatctggatatcgagcagcgcgatgtcgggcgcgtgctcggcatagagcgcgaccgcgtcgttgccgttggcgccggtgccaaccacttcgatctgcggctgggcacccaggataatcttgagcgaatcgaccaccaagcggtcgtcgtcgacaacaatgagcctcatcgggcctcatctccttgctgtttgggaacggtggcaaacacgcgccagccggcggcgccggcgcgtgggccggcggtgaaggtcccgccgagcgcctcgacgcgctcgcgcatggagccgagccccatgccttccgcgacgccgcgactgcacgcccggattccgccctcgccatcgtcggtaacgatgagctggtaaaacgacggatgctccatgcatcgcacggtaacgttctgcgcgcgggcgtggcgcatggtgttggagagcgcttcgcgcaggaccgccgcaaagcagttgacgacgttggccggtgcatgctcggccaaaacctcaagctcgatctgcgggccgccgtccgagcgcacgtcctcaacaatgcgctcaagctgtacggagaggtcggcggcgttgtcgttgagcgcgtggacgctggcgcgcacaagctgaagcgcctcgtcaacggtgcgcttgacgtcggcgaagtcggcggcgacgccgggttcgttggcgtggaccacgcgcagggcttcggtttgcagcgaggcgcgcgtaagttggtggcccacattgtcgtggatctcgcgcgcgatgcgggcgcgctcggcaagtgtcgcgagctcgacctcgtagtcctgacggtcggcgaggtcgcggttgcgcgcctcgagcgcgagagttcgttcctgcagcccgtcgcggatgcggcgcatgcgctcctgctcgcgctcgagctgtgcggtgcgcagtgacagcaaggtggcggcggccgaaaggatggtggtcagcaggagcgttcgggtggtgagcgcgccggcgcgaaggtccgcgacgagggcgaaggcaaagatgatgccaatgcccagcgcaggccaggcgtgctcacggcgcacgcgtcgcgcgatgtcatagaaggcgaggggcgcaaacggcataaacgacggtacaaagacggccacgatgacgtagacgtagctgccggcctcactggcgcggcgggcgcgttcgccttgtgcgacttcggccaaggcggtgatgataacgccaaggcaaaacgctgcgaccaagcgcgcgtccacagcaaggcctaaggcggctgcgatacagcacgccagcacgatcgatttgtcgaatagcctgttcatacgggtattgtacgcgatggcgcgcacggcgaagacgccacctggagcaaccgtgacatttgtcccagcaagggggaccgcgactatgtctcgccgacaatcattttaccggaacatttttgatagctgtatctatcatttttgctagatatagctattatttttgctagatagatttatcaaaaggaggctctaggtgtataggcgcaagatatcgaccgtgttacagcaaagactcatggggccgcgttcctttattcaggtggttatgggtcccaggcaaactggcaagaccacggctatcaagcaggcggccaaggcttgcgggcttccgtgtcgcgtggcgagtgctgactcgtcgcgcgaactcgcgggggattggatcgaccttgagtggcgccaggctcggcagctgacaagtaatggctcgcgtgccatccttgtgctcgacgagatacaaaaagttacgggttggtccgagacggtcaaggccctgtgggacgaagactcttggaacgacaccgagcttcttgtggtgctgtccggttcgtcgagcttgcttctcggcagtgggctgaccgaatcgcttgcgggacgatttgagctactgcgttcgacgcattggagcctatctgagatgtccgaggcgtttggctatagcttcgaggattatctgatgtttggcgggtatccgggtgctgctattctcaagaacgatgtcgatcgctggcgcgagtatatgcgcgattcaatcgtggaatcgacgatttcgcgtgacgtattgcagatggaagacgtgcgcaagcctgcgctcatgcgagccctctttgagctgggtgcgcagtattcggcgcaggagatatcgtatcgaaaactgctggggcagctcgacgataagggaaacactgataccgtgcgccattatcttgatctgctgtccaaggcgggcatgatgagcgggttgcaaaaatacgacgccaagcaggtgaggtcgagggcaagctcgccgcgactgctcgtgcatgatccctcattaatgttctcgatgtggcgcggggcgggtgacttgttggctgattctgccctgcgagggcatttggtcgaaactgcggtgggcgcccggctcatcgcgcgtgctcaaacagaaggctttgagctgtattggtggcgtgagggtaatctcgaagtggactttgtggcgaagcgcggcgatgacgcccttgcggcgatcgaggttaaaagcggccgcgtgtccaagagtggtatgactgagtttttggcgcagaaccctcaggcgaagccgatgattgtgggcgatcgtaacgtttcggttgagcagttcttgcgggatgaggtggagctgttttagctggtgattgctacggcgcgggcgggtcaaagtgatcagaaatgcaagccccacttacttaagatttgggacaaacacatctgattgctttgtcctgtggcgatgccggttctgttggcgccgcactcgtgacaaagctcactggtgcggcccgcctgctcctgcgatgatgcaatcgtaccgggccgcaatcaacggaaaggccgcctcatgacagacatcgtccacgtcgaaaacctcgtcaagcgctatgacgaccttatcgcgctcgaccactttaacctgaacatcgcccctggcgagatctttggcctgctcggccccaacggctcgggcaagaccacgtccatcaactgcatcctgcagctgctcgcctacgacaagggcaccatcgagctgttcggcgagcccatgacgcccgtccgctacgacctcaagcgccgtattggcgtggtgccgcagcaggtggcggtgtttgacgagctcaccgtgcgcgagaacatcgactatttctgcagcctctacgtcaacgaccgtaagcgccgccgcgcgctggtggacgaggcaatcgactttgtcggcctgggcgactttgccaagttccgccccggcaagctttcgggcggcctggcgcgtcgccttaacatcgcctgcggcatcgcgcacaagcccgaactcatcttctttgacgagcccacggtggcggtcgacccgcaaagccgcaatgccatcctggaaggcatctgccgcctgcgcgacgaaggcgccacggtggtgtataccagccactacatggaggaagtcgagcagatctgcagccgcatcatgatcatggacggtgggcgcgtgctggcgcagggcactaacgacgagctcaagcgcatgattcagatgggcgagaagattgtaatcgaggccggcgaggttccgagtgcggcgctcggtgccgtcgcaagcctgccgcacgttctggacctttcggcaacggcgggacagctcacgttttcgtgcgaagcgagcccgcacaacctgacggacatcctcgacgcgctgcgctcgtacgacgtgccgctcggccgcatctactccgagccgccgaccctcaacgacgtgttcctcgagatcaccggccgcgagctgcgcgactagggggcggccatgttcaacaccatcatcaccacggtcaagacgttgctgcgccggccgagcacgtgggtctggggcgctctctttcctattgcgctttccacgatgttcatgtttatgtttgcgaacctcagctccgacggcacggtcgacccggtgccggttgccgtcgtggcggacgaggcctgggatgcctcgacctttaaggatgtggcagcttcgcttgccaaggcaggcgacgaccagctgctcgatgtgagcgagtacgaagacttggctgccgcgcgcaaagcgctcaaggccggcgaggtcgcgggcatctatacggttgatgccgcgggcacgcccaggctcacgctgctatcgagttacgacagctcgcgcgcctcgtcggtgcttaccgaccgcagcatccttgaaacggtggcaagctcgtatacgcaaaatgctgagctcatggcacagattgcccaggacaacccggcggcgcttgccgacccgcaggcagttgcgcgcgctctgtcgctcgagggcggaacccgccgcgtgagcctgactcgtgccacgcctgatggcacggtcatctactactacgcgctctttggcctggtcgcgatgatgtctgccgagtttgccgccttgagcgtcgtcgacttgcagcccaatctgtcgggccttggtgcccgccgttgtgtgggcggcctctccaagacggcgtcgctggccggcatttttgtcggctcgtggctggtttcctttgcatcgatggcggttgcgatcggctacgtgcgcctggtcgtgggcgtcgactttggcgggcgcgaggggttgtgcctgctgggcggggctgcatccgcgcttgcggcgacgggcctggggctctttgtgggcacgctgcccgttaagggcggcaaggcgtccaagtcgggcatcctcacgggcttcgccaccacgtgtgccctgttcgccggcctttacggcgagccggcgatggcgcttgccgacgacgtcgcccgcgcctgcccggccgagtgctggctcaatcccgtcaagctcatctgtgacatgttcaaccgcctgtatttctttgaggacctgggtccctttgccgtgcgcgccggcgcgcttgtcctgatggccctggtgtttgtcgccgcagccacgctgatctttggaaggagccgctatgagcacctttaagactgcgcttcgcatggcgctggcgcacccgttctacctgctcatctatacggtgttcatttcgctcatgggcgtattcatcgcggcttcggtgagctggaactcgtcgcggcttaccgagtacaagccctacgacaccaacgtgatcgtggtcgaccgcgacaatagcgacctttcgcgggcgcttaccaagcacctgggctcacgctttgacctggtcacgggcatcggcgacgacgcgtacgaccttgcggacgcgctcgccaagagcaacagcgccaagggcagtgccgattgcgtgttctttatcccggaggggtttgaggacgatcttgttgcagccgcccgtgcgggggagaccctgcccatgctcgacgtgacgtacggctccggcaccatggcggcggcgctttcgtctgccgaggcctcgcgctggatctcgctcgcgggcgctgcggcggcgcttgaacccgctgcctccaacggtgacgtcgcaagggccgccgagcacgcggccgcaaagcgcgcggaggtccagatcgagcaggtcaaggtcgattcgactgccgccgccacgctcgagtcgtatttcaactttggcgcgtacgcgatcatctcgtcggtcatcgtgtcggtggggctggtgttctcgggcatgaacgagcccgagcgcgtgcgccgcatggatgccggcccggtctctgagcgccagcgctcgctcgctgtgtttgccgccgccgcggtgctcaccgtctgcatctggtttgtgtcgagcatgatgggcgtcgtgggctttgccggcgcggttgccgaggtcggcgtgggccgcgtgtgccttgcgctggcggcaacgtttaccctagcgtgcacgcccctggccgttggctttacgctgtcgagcctgggtgcgcgcgaggagctgctcaacggcgtgggcaacctgcttggtatgctcatgacgtttttgggcggcgcctggatgccgctgtcgctcatgggctcggccgtgcagaccgtggcgcgctttgtgccgacatattgggtgaacgacgcgatcggcaaggcgctcgcgtcggacctgacgtctgccgtgctgggcgacatcgcctgcgacctgggcgtcaccgtgctcttcgccgccgccatcgccgccgtaggcctagccctcacccacaccaaagcccgagcctagccatcgggtactcattggggacagacttaaacgaccaagagtggtcattggggacagacttaaatgactagttatcggggacagtctttgccgattcgccgcctcgccggctgggttggcaaggactgtccccaactgccggcaggaaaggaacgtccctaactgccggatagcgaaagagtgtccctagtgactagtcgtttaagaacgtccccaatgactagtttgaaataaatgtcatatgtcacacaaaaatagttcgcctgggtttactataaccctagaaaagtagcagaaggctaacaatgggggatagtatggcgacgaagcaagcctacgtccaggttaaggacctcaagaaacactacggcgacggcgatgcacgcctgacggtgcttgacggcatcgacacatccatcaaccgcggcgagatctgcgtcatgctggggccctcgggttcgggcaagtcgacgttcctcaatctcatcggtggcctggaggacgccgacggcggctccattatggtggacggctgcgacctgacgacgctcaagcccgccgacctgggcgagtaccgccgccgcgagctgggctttgtcttccagttctacaacttggtgcccgacctcaccatcaaggaaaacatcgaggtcacggcgcacctgtccaaaaacccgctcaacgtcgatgacctgctgcgctcgctgggcctctacgagcaccgcaacaagtttccgcgccaggtctcgggcggtcagcagcagcgctgcgccatcggccgtgcgctcgtcaaaaatccgggcttgctgctgtgcgacgagcccacgggcgcgctcgattacaagacatccaaggagatcctgcagctcatggaggacgtcaaccgtacctacggctgcaccatcatcatcgtcacccacaacgccgccatcgcccgcatggccaaccgcgtgctgcgcctgcgcgatgggcgcatcgtcgaggacgagctcaacgagtcgcccgccgcggccgccgagctcgattggtaggcggcgccatgtcacctctcgcaaaacgactcccccgcgagctgcgccgcaatatcggaaagtacctgggaatcttcctgcttatgtgcggaagtatcgccctcacgtcgggctttttgcttgcggcccattccatcggctgcctcatcgacggcatgcgcgacgagtacacaatcgaggacggtcgcctgaccacggcgttcgaggccaccgacgaccagctcaaagccgccgagaatgcggccagcgacaccggcggcgtcacgctctacaagaacttctccatcgacgccatcatcaaaaaggcgtccggcgacgacggcaccaagcgcaccctgcgcacctatgctcaccgtaccaaggtcgatatcgcgtcctactgcgaaggcaagcagccccgcgcggacgacgaggtggccatcgaccgcgtcttcgccaccaacaacgatctcgccgtgggcgataaggtcgagctcgagggccgcacctacaccatctgcggcatcatgacgcagcccgatagccaggcgctgttcctcaacaactccgactttacggtgaacaccatcacctatggcgtggccgaggtcaccgacgccggatttgccgcgctcgaggacgccggcggcgcgcccacctacacctactcctttacctttaacgaccgcgacctctccaccgcggatcgcatcgatgccgagcaggatatggtcgaggcgctggtggatgccgatgcgcgcgtggatgacctgaccgatgccgattccaaccagggcattggctatgcgcgcgacgatgtggacggcgactccatgatgtggacgacgctgctcgacatcatcatcgtgatcatggcgtttgtctttgtggtgctcaccgacgccaccatcgaggaggagagcgccattatcgggacgctgctcgccagcggctatcgccgtcgcgagatcgtgctgcactaccttgcgcttcccgccatcgtgggcgtgctcgcggcgcttttgggcaccgcgctcggcgttgcgttctttaccgagcccatgcgcagcctctattacggctcgtacagcctaccgcccttccaggtgtactggagctgggagatctttgtaaagtgcgccgtggttcctgccttcgcactcatcctcattaccttggtgggcctgctccgcaagatgggaaagaccccgctgcagttcctccgtcacgaggctggtggcaagtcgggtaccaagcgcggttttcagctgccggagcgcatgggctttgtctcgcgcttccgcctacgcatcttcctgcgcaacctgggcaacttcgccacgctctttgtgggcatcgcgtttgcgtcgctgctgctgctctttggtctggcgatcctgccaacgatgacgcactatgcggacaacctggagacgagtttggtcgccgagcatcaatacacgctcaaggctccgttggagcttgagggtaccgccgaggagcgtgagcagtggtcggcgctcgagcgcctgcagtcggtcgacggttcgctgcttgctgccgcccaggatgcggatgacgagcttgatgacgcggtcgatgccgcgcaggcggcggccaatgctgcgaccagcgctccgtctgccgagagcctgactgcagcgcaggacgcgctcgcaacggttcaggacaagaaggacgccctctatgcgcgcctcgacgatcttgccgatgcccttggctgcgaccgtgacgaggccatcaatctgatcgacaaggcctcgaagatcgacgcggataacgacgacattcaccccgtcaatacgacggacaacggtgcgggcaagattgcacaggccgagaaatacgccgtttaccagctgcaatacgaccgcggcgacggaaatgggcaggagacgatctccatctacggcgtctcgcccgattcacgctactggaaagggctggacgtcggcgatggacgcgttatctttggcggcggcctgctcgacaagtttggctggagcgaggggcagaaggtcacgctccgcgacaagtacgagggtaaggactattcgctggagtacgcgggcaaggacgccacctggggctccaagtcggacatgaatatctacataagtatcgatgactttaacgagttgttcggcaacgacgccacttactttaacggctacgtgagcgacgagaagctcagcctcgacgcgcgatactttgccggcgacaccacacccgacgacatgcgcgccgtgggtgaccagtttatcggcatgatgagcgacatgatcggcatgatggtcgggctcgcggtgttcattttcctactgtttatgtatctgctgaccaaggccgtcatcgaccacagcgcccgctcgatcagctacatgaaggtctttggctatcgcgatggcgagatctcgcatctgtacatccgctcgattacgctgtgcgtggcggcgtcgcttgtgctgagcctgcccgtgattatcggctcacttacggctatcttccgctctatgctgctcgcctacaacggcaatatcgagatctatgtgcccgcctggtccatggcggcgtgtgtcggcatcggctttgcgacctatctggtcgtggcgctgctgcacacgcgctccatcaagcgcgtccccctggccgaggccctcaaggtgcaggaataaacccacgtatgcggggcgctctcttaagggggtgccccgttttggtactcattaatctgataacaaggagaagccatggccagatcggcagatgactataagcagctttccattaaggagttcaccgaggcggcgcggatctacgagtccgaccatgccggtatttacgagatgtgcaaggacgactacccgcagatgcttgcggagctggagttggagccgtttgaggacgtgctcgatgttggctgcggaacgggtgcggtgctggagctgctgcacgagcggtatccgcacaaacaactgacgggactcgaccttacccccaagatgatcgaggtcgcttgtgccaagcagctcgacaacatcaactttatcgtcggcgatgccgagaacctgccgtttgagtctcagggcttcgatgccgtgctctgctccaacagctttcaccattatccgcacccggacaggtttttcgcggaggcggcgcgcgtcttgcgccccggcgggcgtttgattcttcgcgactacacatcgaacgatgtcgtagtgtggctcatgaacaaccttgagctgccgctggcccacctctttggtcacggtgacgtgcggatctgcaagatgtccgagtttcgtgaccttgccgagactgctggcctaaagctgctgaagctcgaggcccagaagggatttcgcgcacacttggtggcgagaaagcggtaggggtgcggttgctctgggcacctctggcggctagtcgtttaggaacgtccccagctgccggatggcccgccgctgcgcttgactttgaccctactccaatgggtaccatcctcttatgtctgtaacgccatatagaccgaggggatatgtctatgaccgcaaccgcacccgctgcacccgccaaggtgtactttacgaacctgcgcacgcatgctcgcgagagccagctcgacaagctcaagcgcctcatccgccgcgccggcatcgagcagatcgactttgagaacaagttcgtcgccatcaagattcactttggcgagctgggcaacctgagctttttgcgccccaactacgcccgcgccgtcgcggatgtcgtcaaggaactgggcggcaagcccttcctcaccgactgcaacacgctctacgtcggtagccgcaaaaacgcactcgagcacatcgacactgcctatcagaacggtttcaccccgtacgccacgggctgccaggtcatcatcgccgacggcctcaagggtaccgacgaggcgctcgtcccggtcgagggcggcgagtacgtgcacgaggccaagatcggccaggcgctcatggacgccgatatcgtgatcagcctcacccactttaagggccatgagcaggccggttttggcggcgccatgaagaacctgggcatgggtggcggcagccgcgccggcaagatggagcagcacgccgccggcaagccgagcgttgcgaccgagcattgcgtgggctgccgtgcctgcgagaagatctgcgcgcacaacgccatctcgtttgacgacacccgcgagcgcgagcttgccaacggcggcacccgcacggtgcacgtggccgccatcgaccacgaccgctgcctaggctgcggccgctgcatcggcgtgtgcaaccaggacgccatcaagcccgactacgacgccaaggccagcgcggccgacgtgctcaactgcaagatcgccgagtacacgaaggccatcgtcgacggtcgcccgagcttccacatctcgctggccatggatatcagccccaactgcgactgccatcccgagaacgacacgcccatcgtcaacgacatcggcatgttcgcgagtttcgatccagttgccatcgaccaagcctgcgccgacgccgtcatggcatccgagccgcttcctaacactgagctcaccgatagcgccgccaagatggagcacaatcacgagcatctggagggcgagcaggccaaggatcccttctgcatcacgcatcccgataccgactggcgctcctgcatcgcgcacgccgagaaaattggcctgggcacgagcgagtacgagctcatcgaggtcaagtagcgctaggctattggacaaatcacgcgcttttgttgcgtaacgtaaactaaaaccgcccgtgagcgcagcgctcacgggcggtttttcggaagtatgcggcaaatttcgaaaccgccgagcacacgacggtcgcgcgcgcagacgtggtgtaagagtgtcctgaggtccgtcgctgcaagtctcggtcggaggggtggctttgtaaagccgtttgtctccacccgcatagcgggtgggttgaagctggccgctgcgcgcccagcagactaaagtcttgaacgcaaaggaggccacttaatgtggcctccgtcttgcgcaggactgcccgagcaggcgatgttaccccatacgcccgcccaggtccgccgggatcacgacagcttgacgatcggcgcaaagcccttcataagctttttggtctggccggtcttttcgaattgaacctcgatcatgtctccagcgaccgagatcacggtaccggtgccaaaggtcttgtggctcacggtatcgcccgcggcaaagtcctgcgacgcgctggcgcgatcgactttgcgctccaccgtcggcgacaccttggacgacggctttttggctcgcggcgcgcccgagccaaaggtcgaggcaacacggccggcgtcgggcgagaccccacgatggcgctcggtcccatagctgctgccgccaaagaaatcgtcgaagctcgatccgccgcgcgatccggagccgccggtcgagcgcgtatgcgaaccgaacaccttgccgccatacatatccgaacccatgcccgagccaaaagtgccgtgacggtcgccgcgcttctcccatcccgtgccctcaaaaccggcagagccgataccgctaaactcgatatcttcaaacggaatctcgttgaggaagcgcgagcgcgggttggccgaggtcgagccataggtacggcgcgttgccgcatatgttaggaacaggcgcttgcgggcgcgcgtgatggcgacgtatgccaagcggcgctcttcctcgagcttgcccggatcgtcgctgccaccaaagtcgtgcacgtgcgggaagatgccctcctccatgccggcaacgaagaccgccgggaactccagacccttggcggagtggatggtcatcatggtgatggcatgcgtctcgccggccagggagtccaggtcggagcgcagggccagccactccataagggcgggcagtgccttgcaggtaagcgggccataagtgcgctcaatctcgtcagcatgcacggcaccggccggcagctccgtcggcgcggcgtacgcgttgcccgcgatggcggcagccagagcatcctgcggagagagcgccggagccgccagactgtcgagcggattggagccagcggcgtcacgggcgccgaccaatgcctcaaacgaggatgcgggtgcggacggtccgggctcgggcgcaggtgcgctcaccacgacgggctcgggctcggcgcctgccggcacatcggcaacgccagccgcacgcagctcttccaagctctcgagcgtaccctcgatatcctcgtgcgtctcctcaaactcggcggcgacgcccaggaattcctggatgttctcggcgcggctctcggactccatggtgccctcggcgcggaacgcctgcagcaggcccgtcttgtcgatgatcatctcaacgacgtccttgagctcgccgtccatgcggcggccctcgcgcaccagcgccacaaagctcgacaggccgttgcgcaccttggcgctaaacatgcccgtctcggccgttgcgatctcgcaggcctggaagaacgaacagcggttatcgcgcgccagctgctcgatcttttgaatcgaggtggagccgataccgcggcgcggcgtgttaatgacgcgcttgacgctcatttcgtcggccgggttcacgatcatcttgaggtaggccatgacgtcgcggatctcggcacggtcgaagaatcgcgtgccgccgacgatcttgtagggcacgcccgcgcgcaggaacatatcttcgaggatacgcgactgggcattggttcggtagaagacggcgatatcgtcgtagctcgtgcccttggagtgcaacttttcgatctcgccggcaatccagcggccctcgtcgcgctcatcgctcgcctggaaggcctggatcttctcgccgtcgccctcggccgtaaacaggcgcttgtccttgcgctgcgagttatggcgcaccacggcgttggcggcgctcaggatatgacccgtggagcggtagttctgctccagcttgacggtcttgcagtttttaaagtccttctcaaagtccaggatgttggtaatgtcggcgccgcgccagctgtaaatggactggtcgtcgtcgcccacgaccatgaggttttggtacttggcggccagcaggttggcgatctcgtactgaacgtggttggtgtcctgatactcgtcgacgctaatgtagcggaagcgctcctgatacttatcgagcacctcggggcgggtgcgcagcagctcgagcgtgcgcacgagcaagtcatcgaagtccatagcgttggcggcgcgcaggcggcgttccagctccaggtagacctgcgcggcctttttgtcgttggggctgtcggcagatttaagcatgtcctcggggccgatcatggcgtttttggccgagctgatcttgctgcggatcatgttgatggggaactgcttttgctcaatgccgagcgcctgcataatgtcgcgaaccatgcgcttggagtcgtcgtcatcgtagatggtgaactgaccggtgtagcccagcaggtcggcgtcctcgcgcagcatgcgcacgcacatggcatggaacgtgcatacccacatgccgcgggtaccgttggggatgagcgccgccagacgctcgcgcatctcggccgcggccttgttggtaaacgtgatggccaggacccgccagggcttaacgcctaggtcgccgagcatgtgcgcgatgcggaaggtcaggacgcgggtcttgcccgagccggcgccggcaaggaccagcagcggaccctcggtagtcaggaccgcctcgcgctgggcggggttgaggctgtcgatgtcgacgagcggcttggcgggcttgggctccggcgccggggcgtcgtagatgtcgagcggaacgagctcgggctccggcgcggcaggggcggtgtacgcatcgagcggcacaggctccggcgcgggcggaacgggcgcggcgatgttcttttcccagggcaagggctgggtcatgggcgactcctcatctgacggacggcgcgcctgcgggcggcgccatagtttgagccgtaccagtataccgagccgcgcggacaccgacgcaaatcacaccacgactccgcgcaccgccaccacccaagcgccccaaataagttgcggtgaaatagttcctgaaaccagccttctggcccccaaacaggaactattccaccgcaacttcgattggctcggagggctagaatatctaccacttctaccccatccccacatggcaggagggcctctgtgaagcataaggtgctctattacatggtcgatggttcgaccgaagctggccaggcagcgctcgatgcaatcgaaggtggcgaccagattgagctgattggctgcgcgcatgagcctaatgtctgtcctaccgccgagcagctgatcggctgcgagggctttgtcggcgagttcggtcccgtcgatgatgcatgtgccgacgccatggcagccgcgggaatgcgcatcgtctcgaacatgtctatcggcctgaaccacgttgccgtcgaccggctggcctcacatggcatcaccgtcaccaactgccctggatactgctcggacgacgtcgctcagcacgccatcgctttgatgcttgacctgatgcgccaagttacgtttctcaaccgcggcgtgcgcgatggcgcctggaatccacttgccggctacaccatgcatcgcacgcagggccgcacgttggggcttgtcttttttggcagcatcgcgcgtgctgttgtgcccatcgcgcaagcgctcggcatgaaggtactggtgtgggcgccgaccaagacggcagaagagcttgtcgccgccggttgcgccaaggctcaaacgctcgatgaactgctcggcgcatcggatatcgtcagcctgcattgtccgctgattcccgagaccgagagcctcattggagagcgcgagctcgcactcatgaagcccacggcatttttgattaacacggcccgcgggcccatcgtagatgaggatgccctggttactgccttggacgagggcatcgccagcggtggcacgcgcggcatctgcggcgccgcgctcgacgtgctcgccgatgaaaccgcgcccaaccaggccctgatcgcgcacccgcgctgtattgtcacgccccattgtgcgtacagcacgcaggaagcctacgacaccgtccgtcacatgtcgctgcaggccgtagtagacaagctcgtcttcaaccgcaaacccgaacacaccgtgaccgaataattggtgcaaacaaacctggccccaatgcaccaatcacggagccgccgatgtcatagcaacggcagcgagcggcggccagagcgaacaaattggcatgaaaagagggcggcatagaccttttggtcatgccgccctctttgaatgacaagctgtcgctctggccgccgcgcagcgtcaaccaagttacaggccgagcatcggcaccgctacaaagaagtatgcaagcactacgatgcccaggatgatgcggtagacgccgaagcacttgaagtcgtgacgacggacgaagcccatgagccacttgatggcgatgagcgacaccacgaaggccacaacgcagcccacgcccaggatggcgatctcgttggcgccaaacgtgccgcccttaatgaagtacttgaccagtttgagcgcgctcgcaccgaacataacggggatagccaagaagaacgtgaacttggacgccaccgaacgcgtgcagcccaaaagcaagccgccgatgatggtggaaccggagcgagacgtaccaggcaccagcgaaagaacctggaagcagccgatgcccagcgcggtcttccagctcaggtcctcgagcgtagtgatggagccaaagtccagatcctcgttatcgtcctcatcctcggcaacagccgctgcgggcgctgcaaagtgcgcaccggcgggacgtccgcccgccaccacggcacgcgaaccaaacgaaccggcaacggccatttcctcgcgcttgctggcgcgccagttctcgatcacgataaacagcacgccgtacacgataagcgccagcgccacgacgggagcgttgtagaaatgctcctccatccagtcgttgagcggcaggccgatcgccgcggcaggaatacagccgagcacgatcttgccccacagcacccacgtgtcgcgacggccttccttgcccttgctgggcgagaacgggttgagctcgtggaagaacagcacgcagacggccagaatggcgccgagctgaatcacgaccaggaacatattccagaacgtctcgctcacgttcatcttgacgaactcgtccaccaagatcatatggcccgtcgacgaaaccggcaaccattcggtgatgccctcgaccagtcccatgaaggcagattttagaagctcgataatatccaaagggaccccctcgttagacacccgccggtagatgttctgcggacgatgcgggcgatgtcccattatcaaccgttagcggcgcgcccgcgcctacccttaccaaaaaactcgcccgttcacagaattgcgagcggtcaaaccgaaatccttgggtataactgcaacaaggtaaagtgtccggcggccaacgcgcccgcgcccgctcgacgcacgagcctcacgcccgtgcgatagaccaaggaggaaaccatgaacgagggctacaccaaggtatttgtttcgctcgacggtaccgagcagcaggattttgtgctcgcacgcgccatcaaggtcgccgcaaacaacggtgccaagctgattattggtcacgtgattgactccacggcgctcgagagcgccggctcctacccggtcgacctggtcaacggcctagaggaggcctttaacaactccattgccaagcagctcgaggaggccaaggccaatcccgatattcccgaggtcgaggtcatgattcgcgccggtcgtattcgcgagacgctcaaggacgagatgctcgacgtggtcaagcccgacctggtgctctgcggtgcccgcggcctatcctcgattaagtatgcgctgctgggctcgatttcgacgttcctgctgcgtaacacggactgcgacattttggtcgtgaagtaggttccttcccgtcggcgcaaggcctgcggggttatcacgccgacgtcctcgccgcttcgcggctgcgggatgtcggcttagataacccctcccggccttgcgccttcgtcaccgtacttcaacgagttatctgattaaaagatggcgtgctgccccgtttggggcggcacgttttgtttgggtggggcggcacgtttttgttatggggcgattctgtttaggcgggtttgtacttctggaatgatcttatcgaacattgcttctgcctcagggaaaccttcttctttgaggctgcgcgctgcatctctcagtgcgtctggcacctcactgcaggtgtcgttaatcattccggtgacgatcccctggggcaaacccgcctcggccatttgcctcaacaccgactcgcgagtcacatcatcgatttttcggcttccgccaaacgaaacccccatctcgcgaacgagattgggatagatcgttgtacacaacacgtcgtagagcggcgccaacctcacttgcttccagtcctcgtcccacacgagtgaccaattcttaagatggttgtcgcagtttcctacggcataatcgaacagttggttatagccaacaagaaacctatcctccatttgattcgtcgacacccttcgtaccgcgtcgacgataagccccaggtaattgacgcccgttggctcatatttaagctcgcgcgaaatgccttttgcctgacaaatgtcctcctggtgcagacgatttggaaccagcagcccatcgagcgaacgaccaccattagacatcgctcggtcaaaccgcttcacggcgataatcggttcggcatcttcaactcgaattagaaagcactcttcggctgatagatccatcagcgaagcagctctcacgcacatagcttcgcacaccgtctcacccggaaatgctttcgaccccgctttgaggatatgcgtcgatggggctgccccgtggggcagataccatccatcgcatgagtcatcacccgcatggtagaggccgattttcgcctgagcgcccgcaagggaaattcgactctcgagcgcaagaccaaaggccacctccgctggcgcgtacgccagcttgttcagctgcttctcccctatctcctcatagcccatttcgagaccgtcggccgaaggttctcgcgtcaaaatcaaagcgccgacgggttcgttgcgaaccaaatcgaggaccttaaagtaatcgccgcgttccgcccgagcctttttctcaaggtctctattgagctgtccctctggaataatgccggagaaaaaggagctcgttacgtccgggctgaatgtctcggccgacaagggcaacgaggacgaaatcggaaccgcgtcagcattctcgaggtactcggggacataggtgaatagcggaagcccagcattctcttccaatatgccaagcagctggtaggatcccttaaactcacgatgaacaaacagcgtgccgcccattattttcccctcaccttcagaataaaatcgatatccacgatggaggcgtagtcgaaaatgacgccgatttcgaccgttgtccgcccccgctcgatatcgcctatcacacgaaggctgcgacccgtcatagtcgcgacgtcgcgttgagttagaccaagttcacgccttctaagcctaagggccttccccatctcgcccggatcgaaaaccatgcgttccgagaaagcagtttcagacggcttaagtttgatgcgcccatcgagcactttagtcgttgtcaccgttctcatgtcgctccttagctatgttcccattcgtgaacatagtatagaactgtaaagctatgttcccgaacgtgattatagctttacaagtaatacctatattcacgttcgtgaacatagtagccaaagcaatcgtcatcctcctaaacgggaagattccgtcgattgcgccacgcggaccggctactcgaagtattggaacttgttcgttgagaaggcgaaggttacggtgaagccttcgccgggctccgacgctgcggtgacggcgatgcccattttggagcataggcgtgccaccaggtagaggccgatgcccgttgcgcgtttggtcgtgcggccgttgtcgccggtaaagcccttctcgaacacgcggggcaggtcagctgcgctcacgccgcaaccgttgtcggcaacggtaagctcaatacgctcgctcgcctggccttcgtccagtagcgctcccgaaaacgtaatcttcgcaccgtcctcgcgcgcgtatttaatgctgttctgaataagttggcccaggataaactcgagccacttctcgtcggtaaagacctcaaagtcgaggttctcacacaccggtgccacgtgcgccgcgatgagctcgcgcgcgttggccttaatcgcgcccgtcaccagggccttgaggctccagcggcgaatcagatagtcgcgctccacgacttccgagcgcgcatagtagagcgcctggtcgatgtagcgctccacgcgggccagctcgcgacccaggtcatccacgcgcgataggtcgccttcgctgccgtccaggttttccaagatcagatgggctgccgccaggggcaacttggcctcgtggacccagctctcgatatagtcgcgatagtcatcggtttgacggcggccttcggctacctcatcgcaagccgccttgcccacgcgacgcaagacctcgtactcgagctcgccctcagcataagtcgggcactgcaccatctcctgcacccatgctgggctttccagctcctcggccgcgcgctccagctgatgcaaaaaacgacgacggcgcgcatactcgatcacgattccgagcatgccaaagataaaggacacgccaactgccacgattgtgatggaaacgggcgccccggcgaccgtcagcacaaagcagctcagcagcacgccgcacgtccacacggcgacgggaagcagcgcgtctttaaagaacttggcaaacatcatggccggcccctagaccgaatagccctggccgcggtgcgtggtcagataccccttgatgccgattttttcgagcgtggtgcgcaggcggttgatgttgacggtaagcgtgttgtcgtccacgaaggcatcggagtcccacagatcctgcatgatagccgagcgcgaaacgatcttacccgcgcggctcaggagcagcgagagaatgcgcagctcgtttttggtgagctcggtggcatcgccggttgccgtattggtgaccgtggagcgggcgagatcgagctccagtcccttatggacaagcgtgctgcgctcgcctgccgccgcggtgcgtcgcagcagggcgttgatgcgcgccacgagcacgcgggcgctatagggcttagggacaaagtcgtccgcgccgagcgtcatggccatgacctcgtcgatctcggtcgtgcgcgacgtaaggacgatgatgggaacctcggactcgcggcggacttcgtggcagatatgctggccgtctttgacgggaagtgtgaggtcgagcagtaccagatcgggcgtggccgcgaggatatcgcgcgagacgtgctcgaacgattcgcaggcctcgacctcaaacccggcgcgcgccaagatgtcggcgagctcgcgacggatgggttcgtcgtcctcaacgatatagatcagcgccatggattacgctcccctcttggttgtctcacagtcattatggccgcgaagccaccagtgcgcgccgcgcacggcgccaaggtgacagaactgttcgcgagcggtggcgttgggcacgtctcgcgctcgcaacgtatacgggggccaaaatgattttttaatccccgtcccaaaaaaaatcatttagcggcgggcgcggagcttttcgtagccgtcggcaaagaaggcgaccgtggcggcgtcgggctcggcggcatcggcgtcggtggcgggaaccacgccgtgctcgtcgctcaccaggaacagtgcgcccttgagctgagcggggatatccacgcgcgtgaccggcatgtccttggtttgggccagctgctcgatgagcgtcgccgtaccgcacaggcactcgtccgccggcgccacaaaggccagctcgccgttgttgacggcagcgagcagctcgggtgccacgccggtctcgtcggcctcggagcgggcctcggcagaacgggcgcgcagtgccttggccgacgtgtcggccagcggctcgtactcccccaccgtcatggcggcattgccgttcacatcgatcaccagcatgagcacgccgtcgtgggcggtgtagtcgccctcggcaagcgaccactcaacgtgctgcttggcccagctgagcatgttatgggtgagcggctcgccctgcaccaagcgctcggacagcgcgcggatgtggcggttgagcatgggcacctttttgttggacatgcgccaacggcagatgagcgcgggcttatcgagcgcgaacttctcgaccgcctcctgattggcgcaaaagtcctcgtacgcacgctgatcctcggcattgccaaacagctcggcgtcatcaatctggggcatggttgtacctttcgtgttagtcattccgtcctcttataccaaaaagacggccctccaaacggagcagccgtcttttgcagagattattttgtcccagggcggaacttagtgcctaaagtggcgagccccggtgaacaccatagcaatattgtgttcattgcaggcctggatgctctcgtcgtcgcgcttggagccgccgggctgaatgatgcaggtcacgccatgcgcggcaagcacgtccacgttgtcgcggaacgggaagaacgcgtcgcttgcgcaggcaaagccgcccttctcaacgccctcgcgctcgcagaagtcctcggcacgctcgcaggccagcagtgcggaatcaacgcggttgggctgacccgggcccatgccaatgccggccttgcccttggaaaccaggatggcgttggacttgacgcccttgcagaccttccaggcaaactcgagctcggccatctcagcgtcggtgggcttgcggtcggtggggaacgtaaaggtcgcggggtcctcggtcacatggtcgacctcctgcaccagcatgccgccgtcgatggagcgcagctccacctgggcgccgtggtccacgccgccggtggccagcacgcgcaggttggggcgcttggccatgcgctcgagcgcctcgtcggtgtagctcggggcgatgatgacctcgacgaactgcttgttctggtcggcgaagtgctcgaccagctcaaagggaacctcgcggttgcaggcgatgatgccgccgaaggcgctcttgggatcgcaggcgaaagcgcggtcgtaggcggccgtgatgtcctcggcaacggcggaaccgcaggggttctgatgcttgaggatcacgcaggccggctcgtcgaactcgcggaccaggttccaagcggcgtcggcatccagatagttgttgtagctgagcggcttgccctggatctgctcggagcccacgagcgggaactgcgagctcgcggtgttctcgcagccctcggcaaaacgatagaccgtggccttctgctgtgggttctcgccatagcgcaggtcgtcgaccttttccagcgaaatctcgagcttggcagaggtgtccgccacgtcgcttgcctgggcggcaagccaacgggagatagccgtatcgtaggcggcggtagtctggtagaccttcacctgcaggcgacgacgggtggaaagcgtggtgcagccgccggtctcgtgcatctcggcaaggacggcgtcgtagtcggccgggtcggagatgacggtaacgctcgcggcgttcttggcggcagagcgcagcatggaggggccaccgatgtcgatgtgctcgatggcatccgcaaaggtgacctcggggttggcgacggtcttctcgaactcgtacaggttgacgacgaccaggtcgatcagcttaatgccgtgctgagcggcctcctgcatgtgctgctcggaatcgcggcgggccagcagcgcgccgtggaccttggggtgcagcgtcttgacgcggccgtccatcatctcgggatagcccgtgaactcctcgatgggggttacgggaacgcccgcgtcctcgatggcacgagccgtgccgcccgtagagataatctcgacgccaaagtcgtcaaccagcgtccgtgcgaaatcgacgacgcccgtcttatcggtaaccgagatcaacgcgcgtgcgatcttcacatcagatcccatgcagtcctcctgtctggtacgccgccgtgctctgtgagtcggtgatacgtcgatctgcagcgctcgcgcagcggcattgaaaatactgattcaatgtagcgcatcgagcgcgacgttgcaccccgcaacgcacggctgtgcagaaaaagtttgcgagcgggggttgcaggagcgccgctgagcacggtgagttgatggaacacaggggcaccataattagatgccaatggcgtggtagaactgtgctcgatatgcatccgcaaaagaaagaggcaccatggtctcgcgggttctctaccgaccgtttgataccgaagacttcgacgccatcgcgctgattctgcagcagctttggcataacaattcggataacgatgagtacaaccgccttgaggccgcgtgcgacctcgcctattgcctttcgtcatcgacgttttcgcaggttgccgtaatcgacggtcaggcgcgtggcatttcgctcgcgcgtgcgggacagagctccggcgccaccgttaaggaacattggatggataccgagcgtacactgctgtcgcagatgcgtgagctagaacccgagtcgtgcgccgagtatctctcgtttgtgcgcgccaccattcgaaccaacaaccgcctgctcgagaaaagcccactgccgcatgacaatgaggtcacgctgctcgccgtcgaccctgacgtccacggcctgggcgtgggatcggtgctgctcgacgccgcaatctcacatctgtcctcgtgcggggcgaccagcgcacacctgtataccgattccaactgctcgtggaagttctacgagctgcacggctttaagcgcacggccacgcaccgcgccaaccgcgaagagcgccgtcacgacatgccgcgtgaaagctttctctacgaactcgacctaacagcctagcccaggcagccacacctagtcatttaagtctgtccccaatgagtagccttggtgatctgcaaatagctgtggtcaaaaaacatcaaatatgagtactgttacctttttagtagcagcgatttggggcatttttgatgcttgtaggcatgacgaccagctgcacgagctgacgtaactccccaaatgtttaataaaatgggctcctaacgagaagtactctcattaggagcccattattatgtgcaaacatatgtgaccaacgcagcaacagtactcatatttggcattttttgtccactgccccttgcgcgaaggtcctcagcggaaagtttgacccgtttcgatgcacaaaaaagggatgaatcttccctggcaaccgcccagaaagatccaccccaaagcaagcgctcactagaacgttccgccgccgcctccgccggcgccgccaccaccgccgccagagaagccgccgccgctgccgccgctcgagctatcggagctcgaagccagctcgcggatggtctcgtggtacacatcgttgaacgaatcgagcggggactcgttgccgtagtgatggtaataccaccagtagcaggggtagttgtcgtagaaatcgtcgctgttgcgcaggtccgcaggcacggcctcggccagctgtcgcagcacttctttcgaaacgcccagggcaacgcccatcaccagcagcttgttccacagcaccagatcgcccgggacggcttcctttaggcgtgtgaaatcctcgagccaatgcttgagcgccttgcagcgagccgccacctcggcgccctccggcgtgtaacggcggaaggtgcagctcaggacaaagcccacaatcacgatgggaatcgaaatcgcagcggcaacgacgttggcctccgcaaagtcggtatagaacagggaacccaggatgcaaaagacaataatgatgccaagaatcaagccggccaccagggcgacgctaccgtccgatgcgataagctcgcgcccttccagcttgcccttgaccgtggtctgatagtcctcgagcttgtcgccaacagattcggtgcgctcgctggcgtaatcttccagctcgctaaacgtgcgcgaacggacgccgtccttgtcgggcttaacgccggcaaagaagaccttgagtacgtcgcgatcgatgccgtccttcttggcggccttccagccctcgtcggtcacggtgatgcgatacgtctgctcctctttttcacgacgaagcagacccttcttcttggtctcgatcgcctcttccagcttgatcacgcgatcgtcggtaagcttcataagcgtggcgatatatgcctggtcgggcacatcattccaggccatgagggccgccagcacggcaggatggtcggccgagggcacatcgcggaagtaatcgtcctggaagagcggcttgggcttggggcgacgcagtttgagcatcacgatcgcaccggtataggcaactgccacgacaacacacactacggcaatcgcgctggcaaccgcacgcgcgtgctcgcggcgggcgttggcctcgtcggcccattccttctcttcgctcagaatcgtcgacatgcgctcttcgcccgaggcggcaagctgcggcacccagtcgctggggaaggcgacgcgcgcctcggcgaactcgccctcatgcacgcacggaatggtataggtgaccatgggttcgctctcgtcgagcgacacgtcgcccgtcagcggaccgtggccccacgcgcggaagttatcgcccttgacggccgccgtccccgcggcggcgtttgcgaagtagacttccatctcgacgtcatcagaatccgccgaccagccgtcgcccacaaacttccagtagagctcggcggtgtcggaccagttcatgaccgcaccggtcatggtgtagctcacgtaaaagatcgcgctgtcgccactctcgtggggactgaataccttgatccttacgccgtcgccggactgctccaccgtgtaaacaccgttgtcgcccttgtttgcgctgtcgaccttgttaaacgcggtgtcgtcttcctcgacgctcagcacatcgacccccaccgaacctccttgctggttggagcccgtattgatatcccaatacacgccgttgatgtcgtcgtcaaaatcgaactgacgtccctcgacaacggtcagcgagccatcggcctcgaccgtggcgccgatataggtttggctcatggaatagccgtcggcatgggcgacggcgggcagcagcaacagtgcgcacgcaacaagcgcgcagacggaagcgaatcgcgcaaataggcggcgctgccgacagggtttggcaacgggggcgttcataggcacatcctttgtctgtgataccagtaacgctattgtcccacgtttgtgagctcgcgacgcgagcttctaggtcagcggagtaccaaacgggacaaaagtcacgcccacgggtagtcgttggggacgctcttaaacaactagccatttgggacaatctttggctgagcccatgaccggaggataataccacttcatagctccgtcacaggtgtagcggctttgtgtgggcgcggcgtgagccgattaagccggcgagcgaggggcataaagcagttgagcgaaaacggtttgcccctttgccgttcgcttgaggatcatgtcccccttttccgcggaaaccccggcagttgcgaagagctgccggggtttctgtcgtctaaggtgctgagttgatagacagaaatcaaagcaccgagtctgcggcccgccatacgccatgcaggggcctcgacaacttgcgagccacggcaacgccttccctaccgtgccccgcgctatactcgtccgcatggatatcaaaacacgcaacataccaacgctctccgcggacgcgccaacgacgctgctcgcccccgccctcgcgcccgtcgtgggccgcttcgccccatcgccctcgggccgcatgcacctgggcaacgtcttcagctgcctgtgcgcgtggctttcggcccgcagtcagggcggccgcatcgtattgcgcatcgaggacctggacgatcgctgcaaacggccggaactcgctgcccagctcatcgatgacctggcctggctggggctcgagtgggacgaaggcccctactaccagcacgatcgcctggatctatacgagaccgcgctgcacaagctgcagaacgccggcctcacctatccctgcttttgcacgcgcgccgagctccacgccgcgagcgcgccgcacgccagcgacggcacgcccatctaccgcggtgcctgccgaggtctttctgccgaagaggtcgcccgccgcagcgccctgcgcgccccggccacacgtctgcgcgttcccgccgtcgacgacctcgcggacgacgtggtcgagtttgtggaccgtacgtacggcgcccagtgcgaggcgctcgccaccgagtgcggcgactttttggtacgccgcagcgacggcgtgtttgcctaccagctggctgttgtggtcgacgatgccgccatgggcgtcaccgaggtcgtgcgcggatgcgacctgctgggctccacgccgcgccaaatctatcttcagcatctactgggactgcccacgccgcactacgcacacatcccgctgctcatgtcaccggacggccgccgcctttccaagcgcgatcgcgacctggacctgggcgaactacgcacccgctttggcacgcccgaagcactgctcggctggctcgccggacaaacaggcatcgcaccggacaccatgccccgctccgccgagcagctcgtcgagcactttagctgggatgttatccgcgagcaccgcgagaacatcaccataacggccgcatagccaaacgccccgaccccttcacgcccacccctcgacgagtgcataatcctgcgtcttgttatgtacggaataattccgtacaatgaagcaaaggaggttttaccatgccaacgattgaaaagcagcgccgtatggatctaaggctgaccgagcgtcaacgccttacttacgagcgcgccgcggccttgcgcgggcaaactctcacccaatgggccacggctcaccttgacgagagctccgcacgtgacatcgccgaggcgtcaacaacctatctttctcctgatggttttgatgcattttgcgaaatgctcgattcgcccatgcctcaagccgcaaaagcgttgcttgaccgtaaagcgatttgggaatgagcacgtttaccaagcccgttcaactccccgttggccaaggcatcgaagctttccactgtggaaatactcttgtagacggatgggctaaaaacagatcggcctcggcgcgaaaaagagggtcagcggttatatacgcatcgtattgcgacggcgcagtcgctgggttctatacgctatgcacgcactccgtagcccgcgaaaatgttgatggaggatggttcgtgcgaaactccccttcccaagttcccgcagtgttgcttggaatgatgggggttgacgagaagttcaaggggcttggtcttggggcatcactgctcaaagatgccatcgagaatgccctgaaaatttctgccctggcaggagcgcgagctttgattgtcgatccagtagatgatgaggctgcagcgttctatgcgcattttggctttgtaaccctacccggcaccaaccgaatggcgctgaaactctaaaccgtcggcgacatctcctccggctcgcagtatgtcttaagttaccctgcagataatcaccattgccgaaatgtagggtaactacccaagacatcgtatgaaaagctcgctacgcccctcccctacacagcatcccagggctggagctcgtcaccaaggcggacgatgcgatcgtagagcacggtgtggcgctcggccgggtttgcatcccgatgaaaatgcccgtaataccaacgcttgtagtccaagcggtcctccagctcatcgaaaaacgccgtaagccggtcaacctcaggacgatcccacccgggcgccggatagagcgtgggcgagagcatgcgcgtggagcaggtgtgagtgattacgtagtcgaccttccagcccacactgtcgagctttgcccgcgcctcatcaaagttgcgctcgtccgggagctcctgcggccaccagctcgaatacggtatgcgatactccttgtccacgctcgtggcgccgcccatggtaaagattgttgagccatcgagctcaaagacctcgccgcgcgtcaggcgccgtatgggcgaggtatccgacagacgctgggtcaggccgccgtgccacaactccatggggcgctccgcccaatggtcgaagcgctcgtggttgccgtcgacaaacagcaccgtataggggcgagactccagccacgcgatatcggcgcattcctcggcggagaaatcccacggaaaaccaaagtcgcccgcgacaatcagatagtcgtcgctcgtcagactatccccaagttcccaatcgcggagcttttgcatgtcgatgccaccgtggacatcgcccgccacatagaccgtcatcggatcaccacttccctcttatatgcctcgagatcgtgttcgatctgctcgtcgtccgtggcgttgacccaccacggccatttaacgcaacacgccggctcgtcgacctgcgcaaaccacgacttgagctcctccaggctcaccggggtgtagccgttggcgtccacacccacgtcatagcgcagcagcccctgcctgaggttgaacctgttgtacgcgccgccgcaactgtggatatgcccgtgaagatgccagccaccgtgcgacataccctgccagtcgaccatagggtagtggctcagcacgattttttggcggtcgatcttgagcacgcaaatgggtggctcgacgataaaggcatccgctaccgcaggctgcgtccagtctttgtcgtggttgccgggcagcagatgaacgcgcttgcatgcgatgcttttgcgcagctcgtaggcctcttgaaccgtcatcttaaagctgaagtcacccaaaatgtaaagctcgtcgtccacagcgaccttgctattaacgctcgcgaccatggcgtcgttcatctgcgcaacagtcgaccaaggcctgtcggcgagccgtagcatgttctcgtgtccaaagtgagtatcgctggtaaaccaaatcaaggggacctcctaacgctgcggtgcatccattctttagggcttacccttcgttcttccatccaaacgggtcaaacacccaaaaaatcagatcgagcacgccgccggtcgccatggcaccggcaagggccatgcaaacgtgcagtgagctggcgcttcgaagcacgtcgaacggccccaggacggcgaacagcccgaccgccgcgccggccatgcacagcgcgaggcacggcgccgcgtccttaacgcatttcttcgcgagatgcttggtgttgtcactcatcgatatcgaactccttagagggtcgctgttctggtgcatgccgccgcgacagagcatggcggcaggttaagtgtcacatggcgtgcggacacgtttttggcctccacagtaaaaaacggtgcgcgccgcgtgggaccttcttgccccctacggtgcgcgccgaaaatggtccgcttcccctctgtccctaacgggtcagctggcggcgcttatcggacaggaagacaccggcggccaccaggaccgtgccgccgataacgaaggtctcacccagcaggtcggacgtatcgcccgtggcaggcatcgccgtctgccgcgtcgcggcctcggttgttgccaccgcatgtttggcctggtacgtcacttgcgtggtgggctgggcctgctcgccattcccgtgctcggcggcctcttggcgagcgatctcggcgttgagctcgacaatagcctgatcgagctcggacttggcggcggtgtagtttgcaagcgcctccaagtatgccggcgccacagcagccgtcgcagccgtggcagcatcgagctcggccttggcggccgcggcgcgctcggcggcatcgtgagccgcagcaatcttggcgttgagcgcctcgtccgcatcgtcagcgctgccgttggcaatggcttcggcaagattgatcccgcgcagacgggcagccgcggcggcagaggcatcgcgggcggcagccgcatccgtcacagcatcgtcagcctccaccacgtcgtactcggcatccatcacggcatgcgccgcagcatcgagcgcggcatcggcagcggctttgccctcggtagccttggtaagcgatgcggcagcattcttaagctgagaggcgcgggcggcagccgcgtcagactttgtctgagccgttgccacggcggcgtcggcatcgctcgcagcctgctgtgccatatcgagctccgtctgcacggcagcagcatcgatgtctgcctgatcggcatcgccttgggcggcagcaagttcggcctccgccccgcgctgattggcacgagcgtcttcgagtgcagacgatgccgcatcaaacgcacgctgagctgcagcaacatcggccgagtacgccgccagctcgtcctgagcagcagcaagcgcgccctccttgtcgccaacaccggcacgagcggcatccagcgcacgcttggcggaagccaccttgcctttggcactgtcgagctcgccagacttggcagccacgacgtcctgcgctgttgtcacagcagcgttggcagcactcaaatcggcgcgggcatcgctgacggcacgcacggcggcgtcaactgcagcctgcttctgctccacggcggcctgggcctcagaaaccctggtcacagcagcatcaacatcagcggaagcggcgtcgacctgcgcctgcttcgcggcaactgcctgcgatgctgcgtccactttgttggcggcatcgtcggcaacgccctgcgccgcagcaagctccttacatgagttgcttgcccggtttgtcctggcatatctgtcgtccgacgagggacagaaaactggcagacacctcgcacggagatgcgcttgtgcaacttgcccccaaagacctccgaagcatgaccgtacccgttcccagccaaccggaacagaagcgctacgcgcaagagcacgaagcaaaacagcgctcctacgaggacgctcttaagaaggcggagcattacgccgcgagcaagggaacgatgcagggctgggatcggcagcctgcttggacttttcccggcagcctgccgatcggtcgcgccgttcagtgcagcggctaaagactgtcatcaatcaaaattcgggctcctcagacggcgacgcatgccatgggaaccgcctttctgttggcgccgaggatagtatacggtcgcgctggcgcgcccgggagattccatgcgtaagcgggcccgtgacgcggatagaagatggggcaagggaattgacggtgaggaggtagctatgagcgtctggagggagccgggtgcggacgcgaggtgtctgtgcgacgacggaaacgtgaggacgtgggcagagctcacgcacggcctcgatgacgacgtgtacccgaagagcgcagacgacgagggatggctgctgtggacgttcggggcggtgtgcgcgtgcgcggcaatcccggatgacgcagcgccatgggcgcgggagcgcaggatcagagtcgcgggcggtagtgacggggatgacagggcacggacgcgccccggaagaccgacgtccgacggcgcgggcgaaccgcgcgcgacggcgcttgcccacgctgggcggcaaaagtcaaaagattatttatcaccatagagcgcaagttcgagggcaagcccgtatactcccggttccggaagctggacgcgactaaacgctgcctgcacctgttcaacggtggtgcactcgtcaccgattactgccagcggaaccggaatgccgtcaatcggcatggccctagggtcatagtcatacctaaggaaatgaagagcaccaggttgaggagcatatccaaatgacaggtttgactgacctccaagcctttctagaattctctgatatacgggctcgggggttacaaaccatagtccagtccggcacagtttctcacgctgcagaacttgccctttatatacgagttggggaatgattctttttgagacattttcccagttaagtccaacagtagattgaacgatgcgtctaccgtcaatcaaggcttctcttgaatcccgatagttaccggtggtatcaattgtctggacctcaattgaagtgaattcccttagttctccaagggcatctatatatgccaagacccagtctgcaaagtaattaccactgccgttccgcttcgggagccttagttctccgccccatctatgtccaaaaacggctatagcgccgccctcttcttttgccttttcaacggcaaccctgcccgaatacaaatgtaactttttgccaaatgacttttcagcgatgatgctgagcatcttgtagtcgtccgcatatagcctatgtggacaacaaataatatggttatcgttctttacttgcttgactgcgcagaccccagacctttgtccgtctcttgataacatcttcgtacaagtgtcatgaataaaagggcattcctgccgcgcaaccgctgacgcggcgatttcagatgtgtcctgcgccctgtatccaaagaagtcggttaccgttccagccatgctacgcctccaaaactgattttaaagaagtacctactgccgccgcgagcatgggcggtacggcattgccgacttgcgcatattgttctgcctgagaaccgaaaaacacataatgatccgggaaggattggatcctcgccgcttcccttacggtaaatgcacggtcttgttcaggatggaagaacgccccccaatgcgggtcgcacttggtaagaaccgtactggccagttcatcccaggactgtctgccatatcgttttgtatgatcgctccgtctagcagctttcatccctttgggcaatagctcgaaaggaatgtcggtccaattaccaccctgtttaatgtacttaagccgttgcatgtttatctctgacagcttcgccgcctcatgattgagaacgccagttgaaccgatgcgcagcaatttctggtattcacattgaggcttagtctgatagtcttttacggcagtgccacgttctccatttttgaggcggggcaagtctccaattgcctcacgcagtgtagtaaatggagctgacgtctccggagagggacgcttgactatttggcgaccgtcaaatgtggtagcgaaattaacccgaatcggtgcatgacgaacaggttccggccaagcactctgggggataactgcacccctgagacccaaaacaatcgtgcgccaacgcatttgtggtacgccgtaatacggggcgccaaggatatggacatccgccccatagcccaaatcagccaatgccctcaaaatagcatgaagcgtcgcgcccttttcgaaggaaacgagcccggggacgttttcaataagaacagctctcggcttgaactcgtcaacgaagcgcaggtactccctaaacagatgattgcgtgggtcctctttcgatcgaattggagcgttgatcgagaaaccttggcacggcggaccaccggcaagtagatcaagctcgccggtttctaggccaagtcgcgtacgtatatcgaggggattcacctctcgaatatcacttacgcaaacttctgcatttggatggttatggccataggtttgagcatacgttggcattatttctgatgcgaaaagcgagtggaatccagcctcttcaagtccttcggagaggccgccagctccggcaaacagatctatacaggtcaggttactcaagagccctccttggaattgatgaaaacccttctagtttagtctagcggattgtcctgacacgtcttgtttccgggattttctggtggcagactaattgctcggctactgttgaaccatcatcatatgcctcagcgcacacaacagtaccgttcgatttcgttcaaagcacattcgaaaccgagcatatattgccagggcggccagaaatagcgccacgaaaaccgcggcttgaattggattgctcgccgccaacgcagaccaaagcgagcccgcgataaaagaaatcaccagaccaatcaggtcgagggcccagctcgtatagtgcgcttcggcaaccgcccgttcgattatttcgcatttcttttccaagctaatatcctcgtcagctccagcgagagagaagtccattcctgaaatcaaatcaattaattctgcctcgctatatccgcttttcttgaacttttttgcgaagaaacctgctggaccaggcacataggtaggatagtttttacgaaatagattcttataagcgatccccattgtttaccccttaaagcacggatgctgtctagcgttattgttctatcatttcgctcggacagactttacagagccgccgccaatcattcatggaaagcgccctatgcggcctacctccgtctaattattccccgcgctcctcatacccgcgttcgagcttcttcccaagctctgcggcacagcgcttcgtttcctcggcaaacaggccatcgatggccctgtcgatccgcgtgcaagtctgccggtgctcgtccttccagggcaggttgagccccaagttcgcatcccaatagccgccgagcttggcgtcaatcacttcctcgggatacagcacgtcgcggcgaatgccctcaaccgcatcgtcctcgtccatatcacaggccgcatcgccctgctcaaggcacttgcgcagctccttctgctcccggatgttgttcagcatgcgaacacacaccacggccaaaaagcgatagcgttcgcatagatcccactcgccttcgagccatacgcgaaagcccagcatttcgctcgcggactcgtcgtccatcaggatcaattcccacggaagcacattggcgagcgcgtcctcccccagcctttgcacgccatcgcgcgtaaagatgcacggctccacctcgtaatagccaaagccgtggcctgcaccacaacgattaatggcgtgcttgggcagcaggacgatcttgtcgctgggctcggggtcaatcttgcgcagctttttgatcttgcggcgggcgcgctttaggccgcgctcgctatcgccacggccgcccgccttgccggcgcatcgcagggcgatctcgcgcaccagggtctttgtgtccgccgcgcacaaccggtccatcgtccggcgcagacggcatagcgcttgtgcagcagtgtcaccatcgacaaggcgcaccatgcccaccggctagcccatcccaacggcctgcctgcagtcgctacgaaggccagcgtgccgacatgagcgcgacaaccgctgtacccagccccattcgtctgatgacaccgccgcagcgggcagatacgacccccagagtgggcatccctgccaaccctccgcgaaccccatgcggcgcagctcgtcggcatccagcctgtctagcagctcaaacaagcgtgtgcgccagcccgtctcgggggcgatgcgctccagcaggtaactcaggatggtgagtatgccgaacatgttgtccgaccgcacctggtacggctcgtgccactctggatacttcgacttggtggggatggtcggcctggtgccaagccctctgttccacaggcggccatggtgatcctgtgctcgatgcataaaagaagacccgccagtgtgcatgctcgagagcagaggccgggcgggtttactacgagaattttaccacggtcgaagccattctatacgaagctccacgaggaaagtttgcaagcgcccgcctcccttgaatatcaacttcatcccacccaaaaactcatccaacattaatcttggctcaagaatcgcttaatctattacctgcactatagagttcgaccaagggcggggcggcgccgcgcaacgcaggccgccgaacgcaacgctcgcgcccgggcaaatcgcccggcgtcgcgcccatcgaacgaaaggacaggtcatggacgacctcgaaaaagttgaaaccatccgcaccaagtgcaacgtgagctacaccgatgccaaggccgcgctcgacgccgccgacggcaacgttctggatgccatcatttggcttgagtcgcagggcaagacgcaggccacgtcggcgcacgccgccaccgagtccgcgccggtcgatgaaccttcggccgagatggtcgccgcgcaagccgcctatgagaagtcgagtgaaaagaccgacttctccaagaaaatggacagcgtgtgggagtacctcaaaaagctcttccgtctgagcctggacaccaagtttatcgccacgcgccgcgacgccatcatcctcaacatccccatcctgattcccatcgtcgcgctgtttgcctggggcgccacgatatggctgatgctgattggcctgttctttggcatgcgctaccgcatcgacagcgacggcgatgtgcccggcagcatcaacaacctgatggaccacgctgccgacgccgcggacggcatcaagcagaatctgaacgacgacaagtaatcgcagacgggggcacatatggcacgaatcctgatcgtagaggacgaggagaaaatcgcccgctttgtgacgctcgagctggagcacgagggctaccaggtggagcatgccgccgacggccgcaccgccgtggacctggcgctggagcgcgactacgatctgattctgctcgacgtgctgttgccgcagctcaacggcatggaggtgctgcggcgcgtccgcaagcacaaggatgtgccggtgattatggtcaccgcacgcgatgccgtgatggacaaggtggccgggctcgatgccggcgccgacgattacctgaccaagccgtttgcgatcgaggagctgttcgcacggatccgcgtggcgctgaagcgtgcggaggccgtgcaggcggcttcgggcgttggcggcatcgggacgggcgcggcgagcggcgcggatgtcggcgccactgcgatacccccggccagcgactcggcccggaccgccgccgcgccttctcccgccgcgctcaccgtgggctcggtcgcgctcgatccagatcgccgcgaggtcacggtcggcggctcgcccatcgtgctaaccgcccgcgagttcgacgtccttgccctgcttatggcgcacgccggcaccgtactcacgcgcgagcgcatcgcgcacgaggcgctcggctacgagtacgtgggcgataccaacaacgtcgacgtgcacatcgcgcacctgcgtgccaagatcgaggacgccggcggcgcccgcatcatccaaaccgtgcgcggggtgggctatgtctgtcgcgcgtaacgccgaaaccaaacgcgtcacctccatcgcccgtgccatcaactggagctacatgtggcgccgcctggcgagctacatctggctcgacctgtggctgctggttgctgcggcggcgatcctcatctatggctataaccaaacgctgcccgacggcgcgtttaccgcgggatggatccccggtgccgccgtccacggcatgtcgctgacgcccgcgcacggctgggaccccgccacgctcacctataccgtcgagcttgcgcgcaccaccaagaccttccccctcgcgcaggacctcatcgcgctgtggcccctctatcttgtcgttgcaggtgggcaggtcatcagcgtgctcaacatgctcggcggcgcccgccgcgtgcgccgcaccatggcaccgctcaacgacctggccctgcgcgtagacgagctcagccgtatgcagctctccggcggcaagatggaaacgctggagcaggccatcgagcgcgcaagcgtcgactcgccgagcgtcaccaccggcgacgccgacctggcgagcatcgaggtcgcgctcaaccgcctgctgcgccagatgcaagaggcaaagctgcagcagatgcgctttgtcaacgatgcaagccacgagctacgaacgcccatcgcggtgattcagggttacgtaaacatgctcgaccgctggggcaaagatgacccggacgtgctggcggaatccatcgcgtccctcaaggccgaaagcgagcatatgcaggagctcgtggagcagctgctgtttttggcgcgcggcgatgccgggcgcacggtcctgcggcgtgcgaataccaacctggccgcactggtcggcgaggtatgcgaggagtcacagatgatcgatgccgagcacacgtatcggctggcttttgacgccttgcttgccagcgacccgcgctgcgacgcgcccgtcgacgtggcgctcgtgaagcaggctctgcgcgtgatcgtgcaaaacgccgccaagtattcggacgcgggcacatccatctcgtttggcgtgacgccggatgcgggcgcgggcacgatcgacataagtgttgaggacgagggcatcggcatgaaccagaaatccgcagctcacgcattcgaacggttctaccgcgccgacaacgcgcgcgatgccggcgcgcagggctcgggtctggggctcgccatcgccaagtggatcgtcgacagccacggcggcgtcatcggtgtgacctcagtcgagggcgtcggcagccgctttacgattcgcctgccacgatagaaagcccctcggcataaataaagggataaggccatgcggccctatccctttttgctagctatagcagcttgtgcgctactcgcggcacagatgcacggcgaagccggcgaactcgcgcttaaagtacacgagtttggtgccgccgtcgggcagcagcacgcgcgactcctcgttgacctcgagtccgcgctcggcaaaccacttctcggccgcatcgatgtcgttgacggcaaagccaatgtggcccttggtgccacgaccgttctgcttcatgacctcgatcagcgaatcgttaaagtacgaaaccggggtctcgatgacaggtaggcccatcatcgtcgagaacagctccgcgatctccagggcatcggccgggtcggtggcgttaatgcccacgtgggcgacgcgcatgccaaagagctctaccgggttggcgttctgctcattcatacaggcagcgcctactgagccataacgtcgagaacggccttctcggcagcgacgcggttcatgccggtcatgaagggcacgccgctcacgtacgggcaggtgaggccctcgggggcaacggtggtggcgatcagcaggtcggcgccctcgtcgcaagcgtccttggcctcggagatggcgcactgcacgatctcatacttgccggcgtaaccgttggcgtcgagcatggtggcgaccttctgggcaacgagcgtggaagtagcagcgccagcaccgcaagccaaaacgatcttcttcataggtaatgtctcccttcgaggtttactttaggtaagtgtaccgcagcgagcgatggcgctcggcctcgatgcgcttttgtgccagtttgcttgcacgctgcgtataatacatctagtacatgttgtcataccgctcgccttacgagcgactaaggactctaatcatgcccgattcccgcaccctctggaccgccgtcgttatcatctgtatcgccatatcggtgttctttagcgttaaaaaacgcaccacgttcaagcgcctgcagcagctgatggccgccaagcagtgggatgagttcgaccgcctgctcgacagcaagctcaccagcatgctgtacccgcgctacaaccgcgactacctgcgcctgaactcctacctgctgcgcgaggaccacaagcgcgccgacgagatgttcgatttgctgctgggccttaacctgcccaagatgcagcgcgtcgacctggtaatcaaggccttcaactactacgttggccaggaggaccgcaaaaagtccaaggagctgctgcacgagatcaagggctttgagggtggccaggcagaggcggtcgcgcacgaatgccagctgatgtacgacacgatgatcctcaagcgccacaacgacattcccgaactggagcgcatgctcgaggaggccggcgacgacaaggtcaaggcttgccgactggaataccttctggccctgcagtacaagaacaagggcgacgaagccaagttccaagagttcctggagaagtcaggccagcactcgatggccgtcaacgcgtaacggacggcttgtgctagacttctagtctcacgggggcgtggcggaattggcatacgcaggagacttaaaatctctcgccgcaaggattgtgggttcgagtcccaccgcccctaccatatgacgcttacgggcccgtgtccttttgggatgcgggctcgtttctctaagatgccggcgggactcgaacccgcgagggggcgagcgtcaagcggacgcgcagcgtccgcagcgagccggcgagggcgccggcaggcgaccgaagccggtgcggatttgcgcagcaaatacgcagacgtcccaccgccccgcgcttctgaatttggaacggggctaaatagactactcatatcgagtcaaggactgtcccaggctgccggcaggaaaggaacgtccctaagtgccggctgttgagttgcggtggaatagggactgcttggggtcccaaagggcgattttagtccgtatttcgccgcaacttatttgagggtgctgagttccggggtccaggtgatggtgggggctttgccgtcgaggacttcgttgatggtggcggccatgccggcgagcaggctgttctcgcttacggtgagcgtctggtaaccgccggctcgcatgagctcgcggatcaccacggcgccggccagaatcacgcccgcacgcttgggctgcacgcccggcagtgcggcaatgccctccacgtccagcgcggacatgcgctcgatagcggccgaaatctgctccattgaaagcttgcgcaagtgcacaaagctcgagtcatacggctccaactcgtgaaccagcgccacgagcgtggtgacagtgccacccaccgcaaccagccgctcggcgcgctcaaagtcgctgggcaggctctcaaagtaggcggcgaattgctcacctgcccagtccgctgcagccgaaagctcgcccgccgcaggcggcaaggccgagaagaagcgctccgtcacgcgacggcagccaatgtccagcgagcgcgtgccctccagcgcaaagatcccgcgctccggtgcgtacacgcccgtcgcgagctccgtggacccgccgcccgaatccgcgacgacaatgcgctcgccgacaaagtcgtgcgccacgccaaaaaacgtcaggcgcgcctcgacctcgcccggaatcacctgcggctcgagccccagctcgcgcaggccgtccagcagcagcgcggcgttggacgcatcgcgcgcagcgctcgtgcacgtggtgcagatgcacgcggccccaaaggcgcgtgcctcggccacgaacatgcggcacgcggcgagcacgcgctccacagccgcctcgcaaaagcgacccgtcgcgtcgacgccctcgcccagatcggtaatctcggtatgcttggacgattccacgatcgccccggcctcgacctgcgccaacaccagtcgcgacgacaccgttcccaggtcgatcgccgccaccttatatcgtttgcaatctgccattgcgggctcccctccgggcgctactcgcctattcgccgctggacgcgaccgtctgaccctcgacgccgttaaaaccaaacagcgtatcgagcgcctgaatgtaccacggcgcatccttgccgacttcttcgatctccttggccacttcgctggccttcttggcgttcgacgacttcttactcgacgacgaatccgaatcgtcatccaggcccaagacgtcaatcctcgtctcgccgggcattaccaagcccaggtcctcggatgccgcatccttgatgccctcctccgagagcagcttgtcgacgcttttttgcaggtcgtcgttatactgctcgcgaatctcgacctgcttggccaagatatcgctcgagcgttttgccacatacagatcgcgcacgggaaaatacaggctcacgagcgccagggccacaacgataccgataaacagccctcgctggggtccgtgggtaaagtcgtagattgccttgaccaccgcgttatcgttggcgtagtgcataaagtccgagcccgaaagacggctcgacggcctgctcgatctgtcgtgcgtccgagccgaggaacacgatgcatgcgtcgagcgcgacggacgcaccgggctgtcttccggcatattcatctgagcattggagcgcgaggcacttgccgcacgatgcgtaggacgggcggcaccggcataatcggacccgccgagctgcaccgtatgcgcgcggcgaggcgacggctcacgcgaaccggcggaatagtacctgttgtcgtaaatctgatccatgtgcgccttgtgcggttgaggtttgtttgcgctaagtattctagttatagcacgagcgcgcacaacgccttcggcggcctttgctcgacataaaaaaggcgctgagccacacggcccagcgcccaatgacagcaagcagaagtagggcgggcccgagtcaaccccgccccgcgagcaccacttgccttagcgaatgttgtagaacgcggccttgccggcgtagcgcgcgctgccctcgagctcgtcctcgatacggatgagctggttgtacttggcgatgcggtcgctgcggcacggggcacccgacttgatctggccggcgttgacgcccacgaccaggtcggcgatcgtggaatcctcggtctcgccggagcggtggctcacgatgcaggcgtagccggcctccttggcggtctcgatggcctcgagcgactcggtgagcgtaccgatctggttgaccttgaccaggatcgcgttggcggcgcccagctcgatgcccttcttgaggcgctcggtgttggtgacgaacaggtcgtcgcccaccagctgcaccttgttgccaatgcggcgggtaagctcgacccaaccgtcccagtcctcctcggccatgccgtcctcgatggagatgatgggataggtgtcgacgagcttctcccagtaatcgaccatttgggtgctcgtgtactcaacgccctcgcccttgagctcgtacatgccggtctcggcgttgtagaactcggtcgaggccgggtccatggcgtacatgaagtcgacgccgggcttaaagccggccttctccacggccttggtgatgtactcgaacggctcggcattggtcttgaggttgggcgcgaagccgccctcgtcgcccacgccgccgcccaggccggcctcgtgcagcacgcccttgagggtgtggtagacctcggcgcaccagcgcaggccctcggcaaagctcggggcgcccaccggcataatcatgaactcctggaagtccacgttgttgtcggcatgcacgccgccgttgaggatgttcatcataggcgtgggcagcaggtgggcgttgacaccgcccaggtactggtacagcgacaggcccgccgactcggcagcggcgcgggcgacggccagcgacacgcccaggatggcgttggcgccgagcttggtcttgttgggggtaccgtccgcggcgatcagcgcggcatcgacggcgcgctgatcgaaggcgtcgaggcccacgacggcgtcggcgcactcgttgttgacgtgctcgacggcctgcgagacgcccttgcccagatagcggcccttgtcgccatcgcgcagctcgcatgcctcaaaggcgccggtcgaagcgcccgaaggcaccatcgcgcggccgaagctgccgtcctcgagcacgacctcgacctcgacggtgggattgccgcggctgtcgagcacctcgcgaccgtagacgtccaaaatgtcactcatgctgtctccctctcacttggaaacgtagttgatgcaagcgactggccgaccgtgcaccatcggtgcgcctccgtaagttagccatgtcgcacttttgcattatgccctaagttaaccgagggatacaattgttttcgaaaaatttagcgggaacgatgagacgtgtcagctcgtcgttcccgcagttttactcctccgcctttgcggcatcccacaggtcgttgaggccatgggtcgaaagctcagccagatccatatgggcgttggccgtcatctgctccatcgcggcccagcggcggcggaactttgccgtgctggcgcgcagagcactctcggcgtcgattccctccttgcgcgcaacgttgaccagggcaaagagcaggtcgccaaactccatctcgcgctcgggcgagccgggagcctcagcctcaaactcggcacgctcctcggcgacctcgtcccacacgtcctggaccgtctcccactcaaagcccacggcagccgccttgcgcgacaccttctgagcctgcatcagcgccggcaggtgcgtgggcacgccgtcgagcaggccctcgggcgcagcctcgcctgccgccacggccttgtccttggcagctttctcggcaagcttaacctcgtcccagatcttgagtacctcgtcagagttatcggcatccgcatcgccaaacacgtgcgggtgacggcggatgagcttggcgtcgatatcgcgtgccacatcggccagcgtaaactcaccggcgtccgccgcaatctgcgcatgcagtacgacctgcatgagcacgtcgccgagctcctcgcgcagatgcgccacgtcgtccgcctcaatgcaatcgagcgcctcgtaggcttcctcgatcatgttcttgccgatgctctgatgcgtctgttcgcgatcccacgggcagccatcgggctgacgcagacgccagatggtctgcaccagatgctgcagctcggccgacgcgtcgaccagcgtggacagatcgcgcgagccctcggcattttgctgggccgtgtgctgcgccatggttagtcctcctccatgatcacgtggcggaacgcaccgccctcgtagatgccgtagctgtgcgtgccatccttgggaatgctcacgctgccggggttgaagagccataggcccgggtgcgtctcgcttgcctcgttaaccttgatatgcgtgtggccgtagacgagcgcggagccctcgggcagcgcgggcgcgtggtcgacgctgttgtgcatgccggcgccaaagacgtggccatgcgtcaggaacagctcgcggccggtctcgtcgaacagcatggcgtagtccgccatgacgggaaagtcgagcaccatctggtcgacctcggcgtcacagttgccacgcaccgcgatgatgcggtcggccagggcgttgagcagcggaatcacacgcttgggggcgtagtcgcgcggcaggtcgttgcgcgggccgtggtagagcaggtcgcccagcagcacaatgcggtcgggctgctcggactcgatggcggcgaccaggcgctcggtccaatatgccgagccgtggatgtcggaagcgatgaggtatttcatggtggtcctttcgggtggggtggatatgactgggcgcgggatgtcgccggccgcgctattcaaatcgcagtgccgcgctctgggccgcctgcatcacgcgttggagcggcacgttgtgctcacgggcaagacgggcgcaatcctcgtactcgggagccgcgcgctcgctgccgtcgggcagggtggctactttgacggccacctcgccccaaggcgtcgccacctgctcaaaacgacgcggcagacagacgcgctccataacctggcggcggatgccgttggtcgtggtttccaaaaagatgatcatctgcagacggtcaatgtcctcgcgagcgcagattacctgcagctgccagccgggacgaccttttttgcagtagagaggcagccagtgcacttcgcgggcgcccgcctcacgcaagcggtcggcggcataggcgagtacctcgggcgacgcatcgtcgatgtcgcactccagcttgacgatggtttcgggcgcatcggtctcgcgggacagcggagatgtacttccacgttgcatacggtccggatcctttccgcacgggctcgttttattcatccaaacgctagcacatcggacgtggcacaggcgtgactttcgtccgtcgccgccctcgcccctatccaaacatgtacatcagcctccaaacatgtcattttttgtcggttttggaggctgacgtacatgttttggagcgggcaacgcctaggacaaactcacgccgcccacacccaccccttaagttcgccacgctcaacaattttgaacattctacgcagttcgtcggccaaaaataaccctcggcgtacttatgcaacccccgatggtactctagttgcatttggctaactagacggctgtcgagcatcctgcgcggcaccgtcacgacaccggaggttccatgttcgagaagcggctcttctcccttgttccgcaggcaacgccctacattgtggcgagcgtcctgtttaagtggattgcgctcatggcaaacattaccgtgatgtgggtgctcgcgcgcatcttgggcggtatcgtcatcggcggcctccccacctcgctcgccatcgatgcactcaagcaggccgctctgccgctcgccgccgccatcatcgtgcgtgccgcctccatctatctggcccagcgcgccggcgacaaggctgccttcgaggccgtccgccgcgtgcgctcgctcgtctacgacaagctcaccgcgctcggcccctcctacaccgagaccgtccccaccgccgaggccgtgcagaccagcgtcgagggcgccacgcagctccaggtgtactttggcggttacctgccgcagcttttctttgccggcctggcgcccatcacgctgtttgtgctgctcgcaggccaggcgggccttcccgccgcactgttgctcgcctgcgttccggtcatccccgtctccatcatgatggtcatgcgcaacgccaaaaagatcggcgccgagtactggggcagctatgtcgatctgggcggcatgttcctggaggccgttcagggcctcaccacccttaaggtctaccaggccgaccgcgactggcacgagcgcatcaacgccgagtccgagcgttttcgcggggcgaccatgcgcctgctggtgatgcagctgcgctccatttgtgtcatggacctggtcgtctacatgggcgccgcactcggcattatcgtcgccgcgctgcaactcgccagcggaaagatcggctttgacgccgccttcctcatcgtctttctatcgcaggagttctttttgcccatgcgccgcctggggtcgctgttccacacggccatgaacggcatggctgcctcgcgccgcatgttcggcattttggatacgcccgagcccgagcgcggcaatgttgagcttgacggccacggcgatatcgaactttccggcgtgggctatgcctacggcgaccgcaccgtgttggacggcgccgacgcgaccatcgcgcgcggctcgctcgtggcgctcgtgggcgaaagcggtggcggcaagtccacactcgcggggatcatcgcaggccgcaaggatgcctaccggggcaacgttcgcatcggcggcgttgagctgcgcgatgccacggccgcctcgcttatgcgcgccgtgaccctggtgcccaccaacggctatctgttcgccggcaccctgcgcgaaaacctgctgctcgccaagcccgatgccaccgatgccgagcttttgcacgcgctcgaccgcacacgcgttgcggcctttgtgcaggcaaacggcggactcgacatggtgattaacgaaggcggcaccaacctttcgggcggtcagcgtcagcgcgtgtgcatggcccgcgccctgctgcacgactcgcctatctatgtgtttgacgaggctacgagcaacgtagacgctgcaagcgaggcggcgattggcgaggtcatcgcgtcgtttgccggcgatcacaccgtgatcgtggtggcacatcgcttgtcgaccatcgtggacgccgaccagattctggtgctagagcgcggtcgcattgccgagcgcgggactcacggcgaacttctggcagacgcgggcgtctatgcacgcatgtgggacagccaggagcagctctcggcgtatgcgtatgccgaggacggggctgaggatgttgccgtggtggaggctgccgagggcgatgacgtttgcgctgatgaccgcggcggtgccggcgtggctgcaaccgccgcggcatccggctccggccatgcccgtcgctcggctccgtccatcatgtggcgcatgatggggctcgtgcgtccgctggccggatggctcgtgctggccgtcgccctgggcagcatcggcatgcttaccgccgcgtttgttccggcgtttggtgcctttggacttatggccgccttgggtcacaacgccctggggctgggtcttgttggcgcatgcgtggcctgcgccgtctgcggcatcgcgcgcggaccgctccactatggcgaacagctctgcaaccattacatcgcgtttcgcctactcgcgcacatccgcgacctggtgttcggagccctgcgccagctggcgcccgccaagctcgagggccgcggcaagggcgagctcgtgagtctcgtcacctcggatattgagctgctcgaggtcttctatgcacacaccatctcgcccatcgccatcgccttggtctgcaccgccgtctttgagggcttcttgctgaccgtgagccccgagctcgccggcatcgcgcttgtggcctatgcggtcttgggcgtgctgctgcctctggtttcggccaaggcatgtggcaccaccggccgccagagccgcgagggcgcaggcaaactgggcgcctttgtgctcgacagcctgcgtggcgcgtccgagaccatccagtttgccggcggcaccgatcgcggtcgcgccctgggcgagctgaccgagcaggtcggcaccgtggacgcacgcctcaagcgccgccaggcagccagcgaggccgtggccgacgcgctcatcctcgttgccaacctggtgatgctcggacgtgcgctgcagctggtggctgcgggaacgatcgatttcgccgcggcgtttgtcgccgtctttacctttgtgtcgtcctttggctcggtaatggccgtgagccgtctgggcgcctcgctacaggagacgctcgcctcgggcgcgcgcgtgctcgacctgctcgatgagcagccccagtgtgccgaggtcgcggacggacaggacgtggagttcgctggcgccgccgccgaacatgtgagctttagctatacgggtgacgcgggtgccgacgacgcaggacaggtggcggacgagacggccgcgaacctcatcctcgacgacgtgacctgcacctttgcgcccggcaccatgacctgcatcatggggcgttcgggttcgggcaagtcgacgctgctcaagctgctcatgcgcttttgggaccccaccgccggtgccatcacggtgagcggcatcgacacccgtcgcatcaacacggcgagcttgcgcggccacgaggcctatatgacccaggacacgcacctgttctgcggcaccgtgcgcgagaacttgctcgtcgcgcgcgccgacgccaccgatgccgagctgctcgacgcctgccagtccgcctcgctcactgcgcttatcgaccgcctgccgcagggcctcgacacccccgtcgccgagctgggcgactcgctctcgggcggcgagcgtcagcgcatcggcctcgcgcgcatcttcctcaacgatgcgcccttcattttgctcgacgaacccaccagcgcgctcgatgccctcaacgaggcagccgtgatgcaggcggtcgatgagctcaagcgccgtggcaagaccatcgtgctggtgagccaccgtgccagcacctgcgcgtttgccgattgctcgctttcggtcgagcacgggaggctcagctaatggcgcgcccggccgacacgccggagctggcgggcgagcgtgcgcgcgaggcccagatggtgtcgcagatgatcgccctgtggtgccgcgggcatcatggcggcgggcgtgcgggcgtgcgggctgctggtggcgatgcgcccgcgcgcataaagctcggattccgaaccatcgccctctgtcccgaatgcgccgagctgcgagaatacgccgtcgcacgcattgagcgctgcccgcatatgggcaccaagacgttttgctcggcctgtccctcgcattgttatcggcctgccatgcgcgagaagatccgcgaggtcatgcgttggtcgggcccgcgcatgatcttctatcgccccatcaccgccatacgccacgcggtggtgaccgtgcaatccaaacgggcggcgaagcggagcaagtagcactggagctgacgtgcgccgctgccgccccttgccttcgcctcaaacgtgtacgtcagcctccaaacatgtcattttttgacggttttggaggctgatgtacacgttttgagagcgcaaacgaggccgcaccgcgcgctgcacagcctttccactcgatttcaactcgcggcgcgcacgacatgccagacgccgcgtcattacaatggagcggattcgccaaatgcaaaggagccgccatgtccacgtgcccgctggttgattgccatacccatacctcgttttcggacggacgtgcctcgtttgaggaaaacgttcgcgctgccgcagcagccggctgccaggtcatggtctcgaccgaccacctcaccttgcctgccagcatggatgctaactgcgaggtgcaggttgtcgagggcgacttgccggtgcatcgcctggcatttgaggacgcccgcaaactcgccgcgcagattgcgccggagctcagctttatctacggatttgaatgtgattggtacgagggctgcgagcccttggttgaacgctggtccgatggcgccgtggtgcgcctgggcagcgtgcattggatcggcgaccccggcgatatcatggccggcgccgcgggtacggcgggaacggaggatgtcgctcgccccgacacgcatgattcgctctgcggttggatcgacgacgacaccaacctgcatgtttgggagaacctgggggtgcgcggcgtatgggagcgctatgtcgacgactggtgccacgcctgcgagagctcgctcaactttgacgtgatggcccatcccgatctggtcatgcgtttttcgaaggagggcttcgcgcccgactttgaccccatgccattctgggagcagatggccgagtgcgctcacgatacgggtcgccgcgttgaggtctcgaccgccgcgccgcgcaagggcctcgacgactactatcccgcgaccggcctgttgcgctgtttcgcccacgccgaggtgccgatcacttttggctcggacgcgcaccgcgccttcgatatctgctggaacatccgcgaagcccaggcccacgcctacgaatgcggctaccgaaccttcgacatcccccaccccactggcgaatggaagcccgcgcccctcttctaacccatccccttcatcagttgcggtgaaatagggactgttttgcctgatgaagcgtttaaacagtccctatttcaccgcaacttccatggggccagggtagctaatttgggcttgactagtgacggcgggcgttgagttcgccggccagttcgtcgagggtgatgccgtagcgctcgagcgttacgagcaggtggtagatcaggtcgccggcctcgtagcgaatgtggtcgtggtcgttgtccttgcaggccatgatgacctcgctcgcctcctcggccagcttcttgagcagctcgtcctcgacgtcggtcagcagacgagcagtgtagctctcctgtggcgatgcgtcgcgacggccgtgaatcacctcggccaggcccgtcagcgtctcaccaatatttccatcctgaacatttgcggtgcgcacacccatagttcaatcctttccgttttgccgagcgcctaacagagcgcccgccctaggcgagtttcttaaagaagcaggtacggttgccggtgtggcaagccgggcccggagagtccaccttgaccagcagcgtatcgctatcgcagtcggcccagagctccttgacctcctgcatattgccgctcgtcgcgcccttgttccagagctcctgacggctacggctccaaaaccacgtggtcccggtcttgagcgtcagccccaccgactcctcattcatccaagcaaccataagcacctcgccagtgtcatactgctgaaccacacaaggaatcagccccttggcgtcgtatgtaagctcggccgcagtcgtcacttgctccatttaaaagtccaatctcacagggattccctgactggccatatattccttcacttcgcggatgctgaaagttccaaagtgaaagacgctggctgccagcacggcgtcggcttcgccctcgattacaccctcggcaaaatgctcgagcgtgcccacgccaccgctcgcgatgacgggaatcggcaccgcacgcgccacggcgcgggtaagcgccaggtcgaagccggccttggtgccgtcgcggtccatactggtaagcagaatctcgccggcgccgcgacgagccgcttcctcggcccacgccacagcatcgatacccgtggcgttgcggcctcccgcggtgaagacctcccacttgtcggcgcccggctcgccgggcaggccgacgcgcttggcatcaatcgccacgatcacggcttggctgccaaacgccgcggcagcttggctgatcagcgacgggtcacgcacggcagcagagttgagcgacaccttgtcggcgccggccgcaaccatggtacgcatgcccgccaggtcgcggaagccgccgcccacggtatagggaatagcgagttcctcggccgcgtgcgccgccatctcgatggtcgtcgcgcggttatcgctcgtcgcggtgatgtccaaaaacacgacctcgtccgcaccctcgcggtcgtaggcacgcgccagctccaccgggtcgccagcatcgcgcaggctcacaaagttgacgcccttgaccacgcggccgtccttgacgtccaggcagggaatcacgcgtttggtaagcatgggctactcctcccctcgggcggcggccagcgcctgggccagcgtaaagttgccctcgtagagcgcgcgaccggtaatggcgccctcgatggcgtcctcgcccaccgcggcgagtgcgcggatatcgtcgagcgtcgagatgccgcccgacgccacgacgggaaagcccgcgacctgcgccacgtggcgatacgcagccacgtcgatgcccgtctgcatgccgtcgcgcgcgatgtcggtgtagaccaggtgcttaaagcccagctcgctgagctgcgccacggcatcgtcgagcgccacgcccgcgccgtcgcgccagccgttcaccttgacctggccatcgcgcgcagcgatgtctgccaccagcagctcgccaaatccgcgggccgccacctcggcaaagcccggctcggtcacgagcaccgtgcccagcgcaatgcgacgcgcgccgtagccggcaagctcgtcgatacgcgcgagcgagcgaacgccgccgcccacgtccacagacagaccgtcgacgccgcagctggccttaatcgccgccgaattggcagcgcatgcgtcctcgtcctcgccaaaagcggcggacaggtcgacaacgtgcacccagctcgcgccctgctcggcaaaggagcgggcgacggccacggggtcgtcggaatataccttgcagcggctgcgatcgccgcgctccaggcgcacgaccttgccaccgatcaaatcgattgcgggaaacaggatcatcggccggcctcctcgacgatgttgacgaagttcttaaggatgcgctgacccagcgcggaggatttctcgggatggaattggcaaccccacacgctgccgtggcgcacgatgcacgggaagctccgcgtgtagtgcgtgcgtgccaagacatcggcgacatcggcgtcgtcagccaccgcgtagctgtgggtgaagtacatgttggcgccctcggcaaagccggcgagcagcggatcggccgtaccggcgggcgtcatatgcacttggtcccagcccacgtgcggtaccttcagacggctcgattccaagcgtgtgcacgagccgcgcatgatgcccaggccatcgacccaaggaccgccagcccactcggaggcgttgccgtcggcgaccgcgccctcgtccgcaggcacgccctcgttgccgcgctcaaaaaacagctgaaggcccaggcagatgccgagcaacggagttccagcggcaacggcatcgagcacggccgcctcctcgccgctctggcgcataaaggcgatcgcgtcataaaacgcgcccacgcccgggatgaccaggccgtcggcgcggcgaatctgctccggatcgtccgacgtgcaggcggcggcaccggcgcgcgcaagcccgcgcgcaacgctcgacaagttgcccttgtggtagtcgaccaccacgattttcggttcgcccacgcgaccctcccttttcctcatccaaaacctgccaaaaagggacaggtttattttggtcggttaaacgttcacccaccacatgagacagcatttccgcagataaaacctgccaaaataaacctgtccctttttggtaggttacagcgagcccttggtgctggggatgccctgcacgcggggatcgagctcgcaggcgtggcgcatcgtgcggcccacggccttaaaggcggcctcgataatgtgatgcgagttgccgcccgccagctcgcgcacatgcagcgtgagtttggcgtcgcgcgcaaaggcgtagaagaactcgaccgccagctcggtatcgaagctgcccacgcgctcggtcggcacgggcagctcgcagtaggcctgcccgcggcccgaaatatcaacagcagccatcactagcgtctcgtccatggcgatcgccgcgtcggcaaagcgtgtaatgcccgccttgtcgcccagagcctggcaaaacgcctcgcccagcacaatacccgtgtcctcgacggtgtggtgcgcatcgacctccacgtcgcccaccgcgtgcaccgtcagatcgaacaggccatggcggccaaaggcgttgagcatgtggtcgaaaaacggtacgccggtcgagatatcgcacacaccggatccatccaggtcgagcttgacgacaatgtcggtctcgcccgtcttgcgggttacctcggcatagcggtccatctacatctcctccttcaccagcgcggcaaacgcggccagcacctcgtcgttttcctgcggggtgcccacggtaatgcgcaggcagtccgcgagccccggcgcgtagctaaagtcgcgcaccaaaattgaatactcgtcgcgcagacgctcgcgcacgcgcgtggcatgcggcgtgcgcgcgagcacaaaatttgccgcgctcggccatacctccacgggcaggccctcggcagccattgcgcgtagggcgcacagctcgcgctcgcgctcggatgcaacctgcgccaccacgggcgcgtatgcatcgcgggcacgcacgcaggcaagcgctgcggcctggctcagcacgttgaccgaatagatctggcgaatcgccgcgaacacatcgatgacctcgggcgccgcgatcacatagcccagacgcgtgccggcggcgccaaacgccttggacagcgtatgcaaaatcaccaggttgggatgctcggcgataaggccttgcgccgtggttgccgtgccaaacgaatcgtcggcaaactcaacgtaggcctcgtcgaccatcaccatgccagggcaggcatcgcacagcgccgcgacaaagtcgagtggcgccacatcgcccgtgggattgttgggcgaggtcacgatggccaggttgcactcgggcgccgccgcaagcacggcagcctgatcgagctcaaaggttgccggatcgcgccacacgtcgcgcacctcggtctggcacagcgatgcaaagaaggcgtactcgctaaagcacggcgggcagttgagcagggtccgccccgcgccgccaaacgccagcaggtagttatagagcagctcgtcgccaccgttgcccacgcagatgttctcgcgcgtcacgccatgccagacagcaagctcgtcgcgcaggtcgttagacatgggatcgggatagcggttgagcggcgtggcggcaagggccgcatcgaccgcctcgcgtacacctgccggcacgggataggtgttctcgttggccgaaaggttgatgcgcgtgggcgtaaagttgggatcatagggctcaataccggccaggtaaggctggacgagctccttcatgcggggtgaaagctcggccatgttaggcctcctcgccggccgcaccggcggcactgctcgcagccgccgccaggtccacgccctcggcaacagtcgcgatcgtatcgcccggccaggcgaccttggtcaggtcggccgcggccagcgactcggcactcacggagtcctcgccctgctccagcacgcgacggcgcagtgcggccgaaagtgcgtgtgcccacaggccctcggcctcagccaggcgctgcgtagcgggagcgtcggaaagcaggccctcgggcgtatagcagataacgctcgagcgtttgacgaactcctccaccgaaagcgggttggagaacatggccgtgccgccggtcggcagcgtgtggttggggccggcgacgtaatcgccgagcggctcggagctccaggcgcccacaaagatggcgccagcgttgcgaatgcctccgagcaggcccatcgcgtccttgcagtgcagctccaagtgctcgggcgccacggtgttcacggcctcgacggcggcggccatgtcggcggccaccacgatggtgccctcgttatcgagcgaggcacgcgtgatctcggcgcgcggcgactgcgccaccagaatatcgatacccgcctcgacctcgcgcgcaaactgctcgtcgcaggtcaccagatagcaggcggccagcggatcgtgctcggcctgagccatcaggtcggccgcgaccaccatgggcttggccgtggcatcggccagcacgcagacctcggacgggccggcgaccatgtcgatgcccacgtcgcccgacacgatctgcttggccgcggcgacaaaggcgttgcccgggccggtgatcttatcgacacgcggaatgctctcggtgccgtacgccagcgcagcgacagcctgggcgccacccaccatatagatctcgtccacgccgccgagcttggcagccgcgagcgtatacgggctgatcaggccatccttttgcggcggggtcaccatgaccacgcgtttaacgccggccaccttggccggaatggcgttcatgagcacggtggagggatactgcgcacggccgcccggcacatagatgccggcagctgcgagcggggtcaccttgacgccgagcatcgtgccgtccgggcgcgtggtaaaccagctctgctcgacctcgcgctggtggaactcgcgaatctggcgcgcggccttctcgagcgcggcaacaaaggccgggtcgaggccttcgagcgcggtgtcaatctgctcctgcggaaggcggaaactctgcagctcaacgccgtcaaaacgctggcaataatcgcgcactgcgacatcgccgttggcgcgcacgttggccacgatatcgcgggcggcgtcgacgatgttttgcggcagcacgcccttgcggttgagctggttagtaacgaggcgctcaccgggagcaagtttgatggtcttcatatcggtatcccctatcggttaggttgcgtttgagaaacgagaagccgggcggtggcgacaatcgacccgcagcccggacgtgggggcgcccgcgcgcgctcgcgctattgtgccgagcccgcgacgggctcaaaatgcttgtccttcacggcagccgccaggcggtcggccaggttacgcacacgcggatccaggcgcgcggcgcccgggttgacgaagaagcgcgccgtgcaatccatgatgcggccggtaatgaccaggtcgttgtcgcgcaaggtcgcacccgtggcggtgatgtccacgatacggtcggtcatgccgacgatggggcccaactcaatattgccgtgcagggagacgatatcggcattcacgccgcgctcggcataccaagcgctcgcgatgcgcgggtacttggtggctacgcgcagagaaccacgacgggcatagttgcgctcagcctggccggcgcgccatgcgggctccgcctcaataaaggtgcacaggccgtagcccagatcgaccagctgcagcaggttgaggtcggcctcgatgagcgaatcccaaccgcagatgccgcagtcggcgccgccgcaacccacaaaggcgggcgcgtcgctgggacgcacgatgacaaactcaatatcgccgaccgcgccctcgtcggcacgcgtgtcgcgaccgcgcacgatcaggtggcgaccgggatcgcgcagctcagagacatccaaacccgcggcctcgagcacgtcgagggtatcggccttgagcgaacccttgggcacggcgatgcgcagcgggccctcggcgccacgtcccacggcgtggtcgccatcggaggcggcgtcttcggccgaggtgtgcgcggcctccaggcgctcgagcgaaaaggcaaagcccgccgccggcacctcgatgccgtcgccgaacgcgccggtaaagatggagtcgtagcgaccgcccgaacccaccggatcgggcaggccaccggcataggccttaaagaccaggcccgtgtagtaatcgaaagaattcatgatggagaagtcgaaggacagcacctgtgcatcctcgggagccaggccctcaaccagggcacgcagctcgcgcgtcaacggcgcgacgataccggccgctgccagcagcgcgtccacgcggtcgagcacctcggcaccgccatgcaggcgcggcagctcgctaatggcggccttgacggcctcgggctcggcgctttccgccacgcgggcatcgaggcccacaaagtcgttggcgtgcacgcagcgcagcgcctcgacagccagctcgcgatcttcgcatgccgcgagcagctccttaaacggacgcacgctgcctgcgataatgtgcgcatcgggcagcgcgagtttgcgcacggcctccgctaccagcgagacaatctccacgtcgcccgcggtgtcacccgcgccaatgagctcaaagcccaactgcgtaaactgacgcgaaccgccggcattgcgttggcactcacgaaccaccggcgcctcgtagcgcaggcgcagtggcaggtcggccgcgcgcatgcgggtcgagaccaggcgcacgatcggcagcgtgttgtcgggacgaaccaccagcaggcgaccatcgtcgtcaaagagcttgaacggcgtatccgcgatgcggccgccctcctcaagcgaacccttgtcctcgagcagcggcgtctcgaccggaaggtaatgatgctccctaaagcagcccttcaccgtcagcgcaatctcctcgcgcgcctgagcctcctcgggcaatatgtcccggaatccccacggtgtggccgtcatctggtgagcctcctcatgctgtgcttcgtatagaacagaagaccggcatagctccgccggtcttctgggtactttagcatactagagtgcttgcggggagaatcgtctcccacggctcacagcgtattcatttggaaacattggggaaagcacatcccatttcgagcggccattccgggacacgctttccgcttgaagcctcaacgggaaaccgcatcccagaatagacgctcagaacgggacacactttccgaaacccaccccatcgggaaaatgcatcccggaatgagcctccagaatgggacacgctttcccaaacccatcccaacgggaaacggcatcccattccaggccctaattccggaacaagctttccgctaaggcttctaccggaaaccgcatcccactctgggcgctaattccgggacacgctttcccgaccagccccgcagagccactcgcactagcggccggcatgccccaacgcaaaaagggcgcccgcgcgaacacggacgcccttgtgtagggtcgagatatcaaccagccaagatatcggacctacgaccagctcttagtagtcgaactggtggtagtagcggcggtacttgaggttgtgcttggtgacc
